United States Patent 8,344,211 (PLANT NUCLEOTIDE SEQUENCES AND CORRESPONDING POLYPEPTIDES) - sequence listing, part 5

SEQ ID NO: 18551 - DNA, 641 bp, Zea mays
  misc_feature: Ceres CLONE 1384830-F
  misc_feature: Encodes the peptide sequence at SEQ ID NO. 18552
tggagctccccgcggtggcgggcgctctagaactagtggatcccccgggctgcgggaattcgcacgagaccattacctagaacatcctaatcgaaaaatcaaccatattattgagaccaacaagcaacatagaaagtggaatccagtagcaacaacagagcaacaatggcgaccaagatattttccctccttatggtccttgctctttctggatggggtgctaacgcgacaattttccctcaatggtcacaagctcctatagcttcccttcttcccccataccttccatcaatgatagcttcagtatgggaaaacccagctcttcagccctataggctccaacaagcaatcgcagcaagcaacatacctttatcacccttggtggttcaacaatcgccagccctatctttggtggagtcattggtacaaaccatcagggcacagcagctgcagcaactcgtgctacctgtgatcaaccaagtagctctggcaaacctttctccctactctcagcaacaacaatttcttccattcaaccaactggctacactgaaccctgctgcttatttgcagcaacaactattaccattcagccagctagctactggctactctcagcaacaacaacttcttccatttaa

SEQ ID NO: 18552 - protein, 158 aa, Zea mays
  misc_feature: Ceres CLONE 1384830-F
MATKIFSLLMVLALSGWGANATIFPQWSQAPIASLLPPYLPSMIASVWENPALQPYRLQQAIAASNIPLSPLVVQQSPALSLVESLVQTIRAQQLQQLVLPVINQVALANLSPYSQQQQFLPFNQLATLNPAAYLQQQLLPFSQLATGYSQQQQLLPF

SEQ ID NO: 18553 - DNA, 657 bp, Zea mays
  misc_feature: Ceres CLONE 1384835-F
  misc_feature: Translation starting site: 240
  misc_feature (472)..(472): n is a, c, t, g, unknown, or other
  misc_feature (506)..(506): n is a, c, t, g, unknown, or other
tccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaaccctaaccgccgacggtggccatgatggccaccgagcccttgtccccggggaatctcgtcgaggacgtcgaaacactacccctggactcctcctccactctcgcggctacgacggacccgctgctccgcccacctcccccctcgtccaccttctctcccaccgccggtgagaaccatggcgcttttctgggacgaggaggatgaggacgtggtggatgacttcacgcctccgctggctccccatgccgctacgnccgcgacgaagtcccgcgagggggtcaccgtggnttcgctgagatcactgtctccgagcctaggaagcacgcggagcccgggaccggaagccgtgggcgtcattcccggctcgggcagctacgtctcctacctcatcgccactcggtgggccgaacggaggggagttccgcgtgcgtcggcgatg

SEQ ID NO: 18554 - DNA, 587 bp, Zea mays
  misc_feature: Ceres CLONE 1384837-F
  misc_feature: Encodes the peptide sequence at SEQ ID NO. 18555
  misc_feature (248)..(248): n is a, c, t, g, unknown, or other
  misc_feature (249)..(249): n is a, c, t, g, unknown, or other
  misc_feature (256)..(256): n is a, c, t, g, unknown, or other
  misc_feature (293)..(293): n is a, c, t, g, unknown, or other
  misc_feature (300)..(300): n is a, c, t, g, unknown, or other
  misc_feature (419)..(419): n is a, c, t, g, unknown, or other
  misc_feature (475)..(475): n is a, c, t, g, unknown, or other
tccccgcggtggcggccgctctagaactagtggatcccccgggctgcaggaattcgcacgagaccattacctagaacatcctaatcgaaaacttgccgccagccagcccattaaccctcgttcctgtcgcgcagccacgacctccacttccgcatcttccccggcggcggcgcggtcagttggaccatggcggatccaaggccacctcggcggtcaccctccgcaaccggcagttcatgaccaaccgnnctctggnccgcaagcaattcgtgcttgaagtgatccaccccggncgcggcnacgtcttccaggcggagatgaaggagaagcttggccaggcggaccaagtgaaagacccaacaacatctttggcttccaagtccggaccacctcggaggaagaaaggcactggttttcgnctcatctacgacaactcgaggttggcaagaagtcgagccgaaataccgctcatcangaatggtcttgctacaaaagttgagaagtcccgcaagcaaatggaagagcggaagacagggccaagaagatccgtggtgtcaagaagaccaaagctggtgacgccaaaaaga

SEQ ID NO: 18555 - protein, 117 aa, Zea mays
  misc_feature: Ceres CLONE 1384837-F
  misc_feature (5)..(5): Xaa is any aa, unknown, or other
  misc_feature (7)..(7): Xaa is any aa, unknown, or other
  misc_feature (22)..(22): Xaa is any aa, unknown, or other
  misc_feature (80)..(80): Xaa is any aa, unknown, or other
MTNRXLXRKQFVLEVIHPGRGXVFQAEMKEKLGQADQVKDPTTSLASKSGPPRRKKGTGFRLIYDNSRLARSRAEIPLIXNGLATKVEKSRKQMEERKTGPRRSVVSRRPKLVTPKR

SEQ ID NO: 18556 - DNA, 683 bp, Zea mays
  misc_feature: Ceres CLONE 1384842-R
cgaattgggtaccgggccccccctcgaggtcgacggtatcgataagcttttttttttttttttttatccaatcacctggcaatgaaccatgatgtataactagatagataacaaaggtgtgttccggtcatggagacagacacagacacgggacgggacgggacggaagaagatgacgagcagctgcgggctacgctcaccgcgctgcccccaaattagggccgaagctcggcagccacttgagcagctcacacagaaacccaccagtcacccccaagccaaaggcacaaacttgatccataaccacacacttacggagaagtagagaagcgttagagacaaacgagacggcaatataccctgacaaactctagagaatcccatccacacctcttgttcagaagaaaaggctccatttttttcagagaggacctggacctggacctgagattaaggacacagactattgtttgacagcctgtgttgcgattggtgactagtcaacccaagcacgaaacagatcacgtaagacaccagagatgaatatgctatggagtagcagtgtgcatgtgataagtgcattagacaatattcaatactgtgaggaaaacggtctaacatgaggccgagtcattatgagcccatctatctcttcatgatatatcccagtagcattcccagga

SEQ ID NO: 18557 - DNA, 638 bp, Zea mays
  misc_feature: Ceres CLONE 1384845-F
  misc_feature (192)..(192): n is a, c, t, g, unknown, or other
  misc_feature (252)..(252): n is a, c, t, g, unknown, or other
  misc_feature (303)..(303): n is a, c, t, g, unknown, or other
  misc_feature (319)..(319): n is a, c, t, g, unknown, or other
  misc_feature (323)..(323): n is a, c, t, g, unknown, or other
  misc_feature (326)..(326): n is a, c, t, g, unknown, or other
  misc_feature (363)..(363): n is a, c, t, g, unknown, or other
tggagctccccgcggtggcggccgctctagaactagtggatcccccgggctgcaggaattcgcacgagaccattacctagaacatcctaatcgaaaacttttgagaactccccttctccgccactaccgaagcccttgtacccctcaccgccgccgctgctgctagggagcttccatccgcgcgcgcctacnacgagagctagcagcggtagcggccgttatcttgtcgctccggctccgttcgtgtacccnagtcccagcctagaatgcgcagatggagggggtcactgatcagatcgccgnccgctgggtcgctaangagncgntttccgagacggcccgtgggcttggcgaggaaccggntcttccaggtcgctcaacgggcaagggccggaaatcttggccccggggggccgcccccaccgggccccggggtttggctgcccccttcgccccaaggggattcccaatgtttccccggccctccccgccggccgggggggggggttttttttccccgccccaaaaccccggcgggtttaagaataataggccccaaagggggaaaccaaaggaatttgctgtcaaaggggaaaaaagggcccgaaattggaaaaggaaaaagttccccccccccc

SEQ ID NO: 18558 - DNA, 648 bp, Zea mays
  misc_feature: Ceres CLONE 1384849-F
  misc_feature: Encodes the peptide sequence at SEQ ID NO. 18559
  misc_feature (622)..(622): n is a, c, t, g, unknown, or other
  misc_feature (648)..(648): n is a, c, t, g, unknown, or other
tggagctccccgcggtggcggccgctctagaactagtggatcccccgggctgcaggaattcgcacgagaccattacctagaacatcctaatcgaaaaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccgggaagtgcggcgactccgtcggcgtgcccatcagccccaccgtcgactgcaccaagatcaactgatcgatggaccgtagtggaggtagctatgcctctgcatgctcgntggatggcagcgtggacatcagcagn

SEQ ID NO: 18559 - protein, 126 aa, Zea mays
  misc_feature: Ceres CLONE 1384849-F
  misc_feature (36)..(122): Pfam Name: Tryp_alpha_amyl Pfam Description: Protease inhibitor/seed storage/LTP family
MAARSSSQQLVAAAVLAAALLLLAAGAGTASAAVSCGEVTSSVAPCLGYAMGSAASPSAACCSGVRSLNSRASSTADRQATCNCLKSMTGRLGGGVSMANAANIPGKCGDSVGVPISPTVDCTKIN

SEQ ID NO: 18560 - DNA, 645 bp, Zea mays
  misc_feature: Ceres CLONE 1384856-F
  misc_feature: Encodes the peptide sequence at SEQ ID NO. 18561
tccccgcggtggcggccgctctagaactagtggatcccccgggctgcaggaattcgcacgagaccattacctagaacatcctaatcgaaaacctgtcgctcgctctccctgtctcccgcacgccgacccgcagccgccgccgttcgccatgggtttcctcgacgcgctctaccgtgtggtgatgcgccgcaacgccgtctacgttaccttcgtcgtcgccggcgctttcgcgggcgagcgggcggtggactacggcgttcacaagatctgggagatgaacaacctcgggaaaaggtacgaagacatatcggttttgcggcagaggccagctgaggaatgataaattttggtcaccagtttgcttcggtttgaccgtttcattttggcacagtaataaacgatgtaaacttacgctgctcctatgacctccttctcattcgtttactctgaaaatgcttttgtggggatttcgtggtgcatgattgaaacctgttagggcttgttcggttagctctcaatccacatccatgtggattgagtgggattggatagttttgaatcccaaacaagtcaaacttcttctcaattttttccaatctcatccaatccatatgtattaggaataaccgaataagcccttatata

SEQ ID NO: 18561 - protein, 63 aa, Zea mays
  misc_feature: Ceres CLONE 1384856-F
  misc_feature (4)..(58): Pfam Name: UCR_UQCRX_QCR9 Pfam Description: Ubiquinol-cytochrome C reductase, UQCRX/QCR9 like
MGFLDALYRVVMRRNAVYVTFVVAGAFAGERAVDYGVHKIWEMNNLGKRYEDISVLRQRPAEE

SEQ ID NO: 18562 - DNA, 649 bp, Zea mays
  misc_feature: Ceres CLONE 1384861-F
  misc_feature: Encodes the peptide sequence at SEQ ID NO. 18563
ccccgcggtggcggcgctctagaactagtggatcccccgggctgcaggaattccacgagaccattacctagaacatcctaatcaaagatttcgtagtaagtcctcgaccatccctgcaaattaccgcgatggctcccaagatcctagtcatccttgtgttcctcgccgtggcctcaccggcggtctggcgccttcgatgtgatagagatgctggcgacagcccacgtactccacgttcctgaactcctgcaggacaccaggtcgcgggcgagggaacagctccggcgggagctactgtcgccccgacaactgccagcctctggcgtcctgccgccgatagggggggcggcggtggaaaacaggcccttttcagtactcgacccctaaggttggacaagatgagaaaggaacggccttctcccccggttggtttcggtcccgaaaaaaaattcggggctcaaataacccggggccagaaacgggaaatatgatttttggggttcccggggccccctgggggcaaacttccgggaagggtgcgtaaaatggggcccaaacccctggtgcccctacgggaaatacacgcgacccctttttttcgtcgagcgggtctccccccccgactccgagcccccaccccccccattcg

SEQ ID NO: 18563 - protein, 37 aa, Zea mays
  misc_feature: Ceres CLONE 1384861-F
MAPKILVILVFLAVASPAVWRLRCDRDAGDSPRTPRS

SEQ ID NO: 18564 - DNA, 606 bp, Zea mays
  misc_feature: Ceres CLONE 1384863-F
  misc_feature: Encodes the peptide sequence at SEQ ID NO. 18565
  misc_feature (606)..(606): n is a, c, t, g, unknown, or other
cgcggtggcggccgctctagaactagtggatcccccgggctgcaggaattcgcacgagaccattacctagaacatcctaatcgaaaaactgcgatgtggtcctctcctcctatcacctgacctccacacacacacacagacagacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcaggagggctctgaggcctccgtcgccagctccccgccgccccagccgccgccgtcggcctcctcctggtggcgcgacatgcagcacccggctgcctacggcgcgtggcctccgtcccccgcggcgaggtggccgcccccggtatcgatggcgccggcagcgacgcagcagcagcagcagcacggcggcgggcgacgagtcctcgacggtctctcggcctccacgccacggaggtcttcacaacactccgggccgggtcagccggactccggggggacn

SEQ ID NO: 18565 - protein, 98 aa, Zea mays
  misc_feature: Ceres CLONE 1384863-F
MQCMAQEGSEASVASSPPPQPPPSASSWWRDMQHPAAYGAWPPSPAARWPPPVSMAPAATQQQQQHGGGRRVLDGLSASTPRRSSQHSGPGQPDSGGT

SEQ ID NO: 18566 - DNA, 666 bp, Zea mays
  misc_feature: Ceres CLONE 1384864-F
tccccgcggtggcggccgctctagaactagtggatcccccgggctgcaggaattcgcacgagaccattacctagaacatcctaatcgaaaaagcctttccctctcttctctgctctttgcatctctctcttgttcctcccttcctctctaaaaaaagggttctgatccctttctagaagctcctgggtttctgttgccgacccgagctccccaggggcgctcaggaggcgccgagccggcgaccgctccggcggatctgagaggccgccgcggtcgctttgcctccgttgcgatactgcacaggttccttgtaaactattgattgggaaacactctgaagaaagagtttgttggctgcataacatctcctgaagtggggttgaaagttgctgataggaaagatcatgggcgctctctgtgatttctgtgggggagagagggtctaaggtttactgccgatccgatggcgtatccttggggttatcatgggaacggaatgtgaattcagggtaatgctccttcctcggcggcctaccaggacatcttttatgtggccgggggtggcttcaaggcctggaaatggcccgcacacccaacacaaaaacggcccagctttggcaaaaattgggggatgtaaggcgcccgcagcggccgcacacctcacca

SEQ ID NO: 18567 - DNA, 677 bp, Zea mays
  misc_feature: Ceres CLONE 1384866-F
  misc_feature: Encodes the peptide sequence at SEQ ID NO. 18568
tggagctccccgcggtggcggccgctctagaactagtggatccaccgggctgcaggaattcgcacgagaccattacctagaacatcctaatcgaaaacttgtgaacatcgcagtgctgtagcctccttcgtcttgagcgagcatggagatgtcagccatggaggaagccctcccaagggcgatggagaggaggaagggaggcctcagaaccattccgttcatcatcttaaacgagatattcgagaaggtggccacgttcgggctgtcggccaacatgatcctgtacctcaccgagcggtatctcatgaccaacgcctttgccaccgtcgtcctctacttctggcatgccttctccaacttcctgcccatcttaggcgccgtggtcgccgacgcccgcctcggccgcttccgggtcatcaccctcggatcctgcggttagactcttcgggatgtgcctgatgtgaatgacggcgatcgcttcggcggacaagaacaccccggagagtgcgccgggttcgcgcgggtttgcagtcgttgtcttgccaatataagtggagcactcgggcggaaaacgaggaggccccaggggccgaggagggcgctatagatacccctgggggcctgcggcctgtggtcgtggcgggtgaatagcgtcgagacacatgtctacgtggttg

SEQ ID NO: 18568 - protein, 98 aa, Zea mays
  misc_feature: Ceres CLONE 1384866-F
MEMSAMEEALPRAMERRKGGLRTIPFIILNEIFEKVATFGLSANMILYLTERYLMTNAFATVVLYFWHAFSNFLPILGAVVADARLGRFRVITLGSCG

SEQ ID NO: 18569 - DNA, 580 bp, Zea mays
  misc_feature: Ceres CLONE 1384868-F
  misc_feature: Encodes the peptide sequence at SEQ ID NO. 18570
  misc_feature (323)..(323): n is a, c, t, g, unknown, or other
  misc_feature (456)..(456): n is a, c, t, g, unknown, or other
tggagctccaccgcggtggcggccgctctagaactagtggatcccccgggctgcaggaattcgcacgagaccattacctagaacatcctaatcgaaaaatcactgccaaatcccccagaaaatcaactcctccccaaatccacgctgccaccaactcgccgtcctccgcgccaagcaccaaagctccgatggcccgcacgaagcagacggcgcgcaagtcgacgggcggcaaggcgccccgcaagcagctggcgaccaaggcggcgcgcaagtctgcgccggccaccggcggcgtgaagaagccccaccgcttccgccccggnaccgtcgcgctccgggagattcgtaagtaccagagagcaggagctgctcatcgcaagtgccttccagcgctcgttcgtgagatcgcgcagactttcagaacgatctccgcttcagtcctccggcgtcgctggnctgcaggagggcgccgaggcttacctcggggggttctttgaggaactaacctgggggccatcccaggccagggggggaccctaaatggccaaggaattccggttcgcgggcgccaacaagggga

SEQ ID NO: 18570 - protein, 102 aa, Zea mays
  misc_feature: Ceres CLONE 1384868-F
  misc_feature (90)..(90): Xaa is any aa, unknown, or other
MARTKQTARKSTGGKAPRKQLATKAARKSAPATGGVKKPHRFRPGTVALREIRKYQRAGAAHRKCLPALVREIAQTFRTISASVLRRRWXAGGRRGLPRGVL

SEQ ID NO: 18571 - DNA, 534 bp, Zea mays
  misc_feature: Ceres CLONE 1384871-F
tccccgcggtggcggccgctctagaactagtggatcccccgggctgcaggaattcgcacgagaccattacctagaacatcctaatcgaaaaaattgtaaactgtgatcttccaggctgcaccaactccatctccaggtggaatggagttagcttgcctgcacactcagtcacggtggcgtccctataaggcgtagggcctgacgtcaccccaaggccctcgcctcgaacgggggcggcgccggcggcccgggcggaaagggaaagggcgaagggccaaacaaaagggaagggggaaaaacctaccacggagccggcggggtgttaaaaagaagggacccaccggggcgaaataatcgaggtggggcccccccccaggggcccccttcgcttcatcatgcgttccggggggcgggacccaccccaccgcttaacaccaccatccttcgttggatttatttatcaaatattaacactactcccccacactacggcctctagcatctatacaagtccgcccaccgcccgcaccgcca

SEQ ID NO: 18572 - DNA, 631 bp, Zea mays
  misc_feature: Ceres CLONE 1384875-F
  misc_feature: Encodes the peptide sequence at SEQ ID NO. 18573
ggagctccccgcggtggcggccgctctagaactagtggatcccccgggctgcaggaattcgcacgagaccattacctagaacatcctaatcgaaaaacaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttggtgttccctgggtcattcttggacactctgaaaggagagctctgctgggagaatcaaatgaatttgttggagacaaggttgcgtatgccctgtccagggactaaggtcattgccaatgtgttggtgagaacttgagcagaggggaggtggctcacccacgggtggagggtgtt

SEQ ID NO: 18573 - protein, 121 aa, Zea mays
  misc_feature: Ceres CLONE 1384875-F
  misc_feature (5)..(121): Pfam Name: TIM Pfam Description: Triosephosphate isomerase
  misc_feature: SWISSPROT Homolog: EC 5.3.1.1 Triose-phosphate isomerase
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSRD

SEQ ID NO: 18574 - DNA, 715 bp, Zea mays
  misc_feature: Ceres CLONE 1384882-F
  misc_feature: Encodes the peptide sequence at SEQ ID NO. 18575
ggagctccccgcggtggcggccgctctagaactagtggatcccccgggctgcaggaattcgcacgagaccattacctagaacatcctaatcgaaaagacgaaagctgccgcagtcaaacagcgaataaaagccaaagccaccaggccagcaacaatagaagcgagcgagcgagcagcagtaggcagcggcgcgggcgaggagcagaccagcacccagcagccctcgtcggggggcggcagctgcagcttcaccagccgccgcctttccccgtctcctctgcctctgcctctccccctaacccccttccatttctccaccccaccccgctcccgcttccgcttcctcgccacttagttcgttccgcacccgcagccgcggctgcgttcgcattgggggcacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcggagagcgcatataccttgtcttcgagtacctggatctggacctcaagaagttcatggactccttgcccggagtttgctaagaatcccactttgat

SEQ ID NO: 18575 - protein, 98 aa, Zea mays
  misc_feature: Ceres CLONE 1384882-F
  misc_feature: SWISSPROT Homolog: EC 2.7.11.22 Cyclin-dependent kinase
MEQYEKVEKIGEGTYGVVYKALDKATNETIALKKIRLEQEDEGVPSTAIREISLLKEMNHGNIVRLHDVVHSGERIYLVFEYLDLDLKKFMDSLPGVC

SEQ ID NO: 18576 - DNA, 662 bp, Zea mays
  misc_feature: Ceres CLONE 1384884-F
  misc_feature: Encodes the peptide sequence at SEQ ID NO. 18577
  misc_feature (229)..(229): n is a, c, t, g, unknown, or other
  misc_feature (274)..(274): n is a, c, t, g, unknown, or other
  misc_feature (275)..(275): n is a, c, t, g, unknown, or other
  misc_feature (625)..(625): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
ggagctccccgcggtggcggccgctctagaactagtggatcccccgggctgcaggaattcgcacgagaccattacctagtacatcctaatcgaaaaacctgccacatctggccatctctcagtctcacacgcgctgccatggacggatccatgtggtgcgctgccaactacgtgcctctgacgccgctcagcttcctggagcgcgccgcggtcgtgtacggcgaccgcngcggccgtcgtttgcggcgataggcggttctcgtggcgcgaacgnnagggagcggtgcctcgccggggcagccgctctcgctcgtctcggcgttggccgccgcgacgtggtcgcggtcatcgcctcgaacgtaccggcgatgtacgagctccatttcagcgtgccgatgaccggcgccgtcctgtgcacgctcaacacccgccacgacgcggccatggtgtccgtcctgctgaaacactcggaagccaaggtcttcctcgtggagtcgcagttccacgccgtggcccgcgacgcaatcaggctcctcgccgacgacgaaaacaggcttcctctcgtcatcacgggatctggaccgaaagcaacaacacgggggggggctgcggcagcaacgacggnagcgtcgcgggnnnngaagacaaaaaacttctgcgga

SEQ ID NO: 18577 - protein, 98 aa, Zea mays
  misc_feature: Ceres CLONE 1384884-F
  misc_feature (86)..(86): Xaa is any aa, unknown, or other
  misc_feature (90)..(90): Xaa is any aa, unknown, or other
  misc_feature (91)..(91): Xaa is any aa, unknown, or other
MYELHFSVPMTGAVLCTLNTRHDAAMVSVLLKHSEAKVFLVESQFHAVARDAIRLLADDENRLPLVITGSGPKATTRGGAAAATTXASRXXKTKNFCG

SEQ ID NO: 18578 - DNA, 623 bp, Zea mays
  misc_feature: Ceres CLONE 1384885-F
  misc_feature: Encodes the peptide sequence at SEQ ID NO. 18579
  misc_feature (358)..(358): n is a, c, t, g, unknown, or other
  misc_feature (448)..(448): n is a, c, t, g, unknown, or other
  misc_feature (487)..(487): n is a, c, t, g, unknown, or other
  misc_feature (595)..(595): n is a, c, t, g, unknown, or other
  misc_feature (596)..(596): n is a, c, t, g, unknown, or other
tggagctccccgcggtggcggccgctctagaactagtggatcccccgggctgcaggaattcgcacgagaccattacctagaacatcctaatcgaaaaacagatctctctccctttcccccctctctctctctccgaactctaccccgcagtctcggccgcggccatggcggaggacgcccccaacgccgtcgccgagggcagccagcccgcggcctccgagggatccgccgacgccgccctgccggctgccgcgggcgccaaggccgcggaggcgctgctcccgtcgctcagtatctggctgccgtcgcagcgcacgcgcgacgccgtggtgcgccgcctcgtgcagacgctcgcggngcccagcgtcctctcccagcgctacggtgccgtcccggagcccgaggccgagcgcgccgccgtggccgtcgaggccgaggccttcgccgncgcctccaagtccgccgccggcgccgccgagtggccggnctccgtcgaggaggggatagaggtgctccaggcctactccaaagaggtcagccgccgcctcctcgagctcgccaagacccgggtccgcgctggtgcggcgccccccgnncccgaagaggggacgcggagggggacc

SEQ ID NO: 18579 - protein, 153 aa, Zea mays
  misc_feature: Ceres CLONE 1384885-F
  misc_feature (65)..(65): Xaa is any aa, unknown, or other
  misc_feature (95)..(95): Xaa is any aa, unknown, or other
  misc_feature (108)..(108): Xaa is any aa, unknown, or other
  misc_feature (144)..(144): Xaa is any aa, unknown, or other
MAEDAPNAVAEGSQPAASEGSADAALPAAAGAKAAEALLPSLSIWLPSQRTRDAVVRRLVQTLAXPSVLSQRYGAVPEPEAERAAVAVEAEAFAXASKSAAGAAEWPXSVEEGIEVLQAYSKEVSRRLLELAKTRVRAGAAPPXPEEGTRRGT

SEQ ID NO: 18580 - DNA, 666 bp, Zea mays
  misc_feature: Ceres CLONE 1384887-F
  misc_feature (224)..(224): n is a, c, t, g, unknown, or other
  misc_feature (270)..(270): n is a, c, t, g, unknown, or other
  misc_feature (338)..(338): n is a, c, t, g, unknown, or other
  misc_feature (339)..(339): n is a, c, t, g, unknown, or other
  misc_feature (556)..(556): n is a, c, t, g, unknown, or other
gctctagaactagtggatcccccgggctgcaggaattcgcacgagaccattacctagaacatcctaatcgaaaaatcgtcatcgcaaaatgcaggctctcctgctccccgcgcgggccgcgccgccgacgccggcgatgcttcggcagcgtgcggtttctgcctccgcgtgtgcgtcgcaggtctgccgccccctattcggtgccgccagttgcatctcctgtngggtccacggaagcgttcggcggcacctcacagtggcggtggcggnggccccgccctcgccttcgtcctcaccttcgtcgggaccgttctacccgacgcctccacccaccgagnnagaagggggggagggtccagctcgagcaggttattgggggaatttaaaaaaacggcagggtatttccagaaatttgggcaccccggggggttctgggcccaatttggggggggccaatattttctggggggaattttgggtttttgcccagggggagggggggagggggaaaccccccttaatattaaaaagggggggggggggggggtttttatcnccccgggggttggcccccccccccggggggaaaaaaaaaaaaaatgtggcccccccgggggtgggaaaaaaaaaagggcttttttattggcggccctccacaaagacaaa

SEQ ID NO: 18581 - DNA, 699 bp, Zea mays
  misc_feature: Ceres CLONE 1384890-F
  misc_feature: Encodes the peptide sequence at SEQ ID NO. 18582
aaagctggagctccccgcggtggcggccgctctagaactagtggatcccccgggctgcaggaattcgcacgagaccattacctagaacatcctaacgaaaaaatcaattctccagaccctccccggcaaccgcgtccggccgtccgcttccgtctccttggataaccacgacgcccgccggcaagcgaaagcgaagcgagccaacccagccatggagaaggcgatcgatcggcagcgggtcctcctggcgcacctcctcccctccctctccgccgcctcctcgcagcctcagcttgcggcgtcggcgtgcgcggccggggacagcgccgcctaccagaggtcctcctccttcggggacgatgtcgtcgtcgtcgctgcctacaggacgccgatatgcaaggccaagcgaggaggcttcaaggacacctacccagaggacctcctcactgttgttctcaaggctggtctggacaacactaggaaccatccagctgacatcggagacatcggcggtggcaacggtgcttggccctggctcccaaccgggcacacgagtgcaacgaggcctggcatggtgggcgggacttccctgaacgcgccccagttaaaactgttaaccgcgcgggcgtcatccggccctcccgccagaagcggatgcccacagctgcgaagaaaagctccccaccaaccctccggccc

SEQ ID NO: 18582 - protein, 162 aa, Zea mays
  misc_feature: Ceres CLONE 1384890-F
  misc_feature: SWISSPROT Homolog: EC 2.3.1.16 Acetyl-CoA C-acyltransferase
MEKAIDRQRVLLAHLLPSLSAASSQPQLAASACAAGDSAAYQRSSSFGDDVVVVAAYRTPICKAKRGGFKDTYPEDLLTVVLKAGLDNTRNHPADIGDIGGGNGAWPWLPTGHTSATRPGMVGGTSLNAPQLKLLTARASSGPPARSGCPQLRRKAPHQPSG

SEQ ID NO: 18583 - DNA, 738 bp, Zea mays
  misc_feature: Ceres CLONE 1384892-F
  misc_feature: Encodes the peptide sequence at SEQ ID NO. 18584
  misc_feature (45)..(45): n is a, c, t, g, unknown, or other
  misc_feature (60)..(60): n is a, c, t, g, unknown, or other
  misc_feature (66)..(66): n is a, c, t, g, unknown, or other
  misc_feature (74)..(74): n is a, c, t, g, unknown, or other
  misc_feature (80)..(80): n is a, c, t, g, unknown, or other
  misc_feature (81)..(81): n is a, c, t, g, unknown, or other
  misc_feature (234)..(234): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
tggagtccccgcggtggcggcgctctagaactagtggatcccccngggctgcaggaattncgcacngagaccanttaccnntagaacatcctaatcaaaaaaaatcctccgaaccccgccgccgacgagcgagctatggcgctggcgcggcggctgctccgccttactccctacctcggcacgctctcgctcccaccccccaactcgcatctcctccggaatcgcacctatatnctctgacatgcgccgctctgccttcgtcgaccgcttgctccgttccctacgctccgaaaatctccctccttcgaaaaactcccgccccccccccnnnnnccccccccccccccgcgtagcgcccccggggcgggccacgccccccccggcccgaccgcgcgtcggacccgcagaccgccacccgacccccccgcgccacacggaagacgagatcgcgcgcgcgcccccccctcccccctaaaaaggggcccccccttttttttcccccaccccacatatttttgggagggggggggggaaaaaccggggggccccccccggggggggggctggcggaaaagacacaaaaggggggggtgggggggccccccccgcccggccgccctcttgggggagggggagcccccccccgcccgcggcgggggggcgggcgtgcctccctcctccacccccccgccgtgggggcgcgccgcgcgccggcgccgccgtaatccccccgtcgcg

SEQ ID NO: 18584 - protein, 34 aa, Zea mays
  misc_feature: Ceres CLONE 1384892-F
  misc_feature (33)..(33): Xaa is any aa, unknown, or other
MALARRLLRLTPYLGTLSLPPPNSHLLRNRTYXL

SEQ ID NO: 18585 - DNA, 672 bp, Zea mays
  misc_feature: Ceres CLONE 1384893-F
  misc_feature (435)..(435): n is a, c, t, g, unknown, or other
  misc_feature (465)..(465): n is a, c, t, g, unknown, or other
  misc_feature (472)..(472): n is a, c, t, g, unknown, or other
  misc_feature (473)..(473): n is a, c, t, g, unknown, or other
  misc_feature (509)..(509): n is a, c, t, g, unknown, or other
  misc_feature (511)..(511): n is a, c, t, g, unknown, or other
  misc_feature (512)..(512): n is a, c, t, g, unknown, or other
ggagctccccgcggtggcggccgctctagaactagtggatcccccgggctgcaggaattcgcacgagaccattacctagaacatcctaatcgaaaacaccattgaaacactctctgaccctcactcgctccctgtcacacacactacactcgcaattcatccgcagtcacaagctcggctgctgctcccgctaacggttgaggcgttgctggtgcacacaggaagggaagggaagggagagctgcacacagctttgctctggctcttggctcccctgtccagctgtcctgtccgtccatcatggaggaaacgcccagcccgcagctctagccgccgtcaatctcgtctcgtatcggagtcgaaggaagtaagaggcgggatggcatgaagcgacctaccaagaatgagaggctgggcaacccccggcacaagtangaggaagaacccgagcaccgagccacaggnaggaggnnagagatgggcaactgcggccacggaaggagaatggncnntcgtcctgccaacgcgcaagtcagcaactccacttgttacaacagccttccaaaaacgccaaggcaaaaaggaagcaaccggcagggcaccaaaaatagggcccttcccacccaaggaaaggtggaagaggccagaaatttttcaatatcaacggatggg

SEQ ID NO: 18586 - DNA, 610 bp, Zea mays
  misc_feature: Ceres CLONE 1384894-F
  misc_feature: Translation starting site: 200
  misc_feature: SWISSPROT Homolog: EC 3.4.25.1 Proteasome endopeptidase complex
  misc_feature (386)..(386): n is a, c, t, g, unknown, or other
aagctggagctccccgcggtggcggccgctctagaactagtggatcccccgggctgcaggaattcgcacgagaccattacctagaacatcctaatcgaaaaaccaccaccgctctgcctcgcctcgcctcgcgtcgtctcacctcacctcacctcgccgactagggttttgtaccgccgtggatctcgccgtccccgccatggacgtctcgcacgcgggatcctccgtcgccggcgaggctccgaccaccggggagcaccggatggggactaccatcgtcggggtctgctacgagggcggcgtcgtcctgggcgccgattccaggaccagcactggaatgtatgtagcccaccgtgctttcagacagatttactcactgacagacnatggtgtatgtctgtcgctctggatctgctgctgatacacagtcatttcggattatgtacgctatttcctcccacacacaccaatcagcttggacaaccagtaccggtaaagtggcagcaccttggataagggtgctagcttatcaaaacagaaactgttccagttggattgatttgtttggaggtgggaacaaattccggggaggccaaaattttcccgcccc

SEQ ID NO: 18587 - DNA, 678 bp, Zea mays
  misc_feature: Ceres CLONE 1384900-F
  misc_feature: Encodes the peptide sequence at SEQ ID NO. 18588
  misc_feature (557)..(557): n is a, c, t, g, unknown, or other
  misc_feature (657)..(657): n is a, c, t, g, unknown, or other
cgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacnaggaccacggcggcgtgcacgacggcaccgccgtcgtgctctgggagtggtgcaagggcgagaaccagagctggaagatcctgccgtggggtcccgaggncaactcccctcgcggccacgg

SEQ ID NO: 18588 - protein, 181 aa, Zea mays
  misc_feature: Ceres CLONE 1384900-F
  misc_feature (142)..(142): Xaa is any aa, unknown, or other
  misc_feature (175)..(175): Xaa is any aa, unknown, or other
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDXDHGGVHDGTAVVLWEWCKGENQSWKILPWGPEXNSPRGH

SEQ ID NO: 18589 - DNA, 611 bp, Zea mays
  misc_feature: Ceres CLONE 1384901-F
  misc_feature: Translation starting site: 201
  misc_feature (611)..(611): n is a, c, t, g, unknown, or other
ccccgcggtggcggccgctctagaactagtggatcccccgggctgcaggaattcgcacgagaccattacctagaacatcctaatcgaaaagctttcttagaggtgggttggcttctcctccccctccggttcgggttcggcctcgtgaggttctccggcggtcgggatcgtggccgagcggatcgagatggcgacgtcggatgtggagtaccgctgcttcgtcggcgggcctcgtctgggccacggacgaccactccctccacaacgccttcaggacctacggcgaggtgctcgatgtctagatcatcctcgatgcgaagatgcacaggtgccgcgactgtcgggttcattaccttctacacgccagaggcgatgcggaacgctttccgagggatgcaccgccgggacgtggacgagcggacatcaccgtcaacgaaagggcaacctgttatacacagcgtttcctcttcagtagagtttctagagagaagtgcactgtctcttacctacttttgctatttttgtatccggaggatgttatctttgttgccacaagaaggatcatgcgtcctcccaagaagggtgcagctgttcagaggtcacgcaacagn

SEQ ID NO: 18590 - DNA, 722 bp, Zea mays
  misc_feature: Ceres CLONE 1384918-F
  misc_feature (722)..(722): n is a, c, t, g, unknown, or other
tggcggccgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcagcggcgccagcctgcaggaagccagcccctattcgagacaaggtcgatctttgctgccttggcgagcttcagccgaatcaaggtcgagcatggcggcaggccagtaaatagagcaacacaaaacccttcaaattaatggagacctctgcagcaaccccgaccccggccgccacaccagggagggcacttccccatcgccatcgccctcgacgaagctgaagctgtgcaggcccatgggcccagcggaacatgtggcaccagggggccccttccgagacgccgtcaaggaaccagagagttggtcgccggttgccgcccgtccgcctcccaggcttcccctctctgtcaaagagaaccttcccctgcctgccttgn

SEQ ID NO: 18591 - DNA, 655 bp, Zea mays
  misc_feature: Ceres CLONE 1384921-F
  misc_feature: Translation starting site: 251
aaagctggagctccccgcggtggcggccgctctagaactagtggatcccccgggctgcaggaattcgcacgagaccattacctagaacatcctaatcgaaaaaggaccggtcactcggcacgcaggctagcagcacagcagcagccagagccatcccctctcctcgctacgcttcgcttcctcggcgccgattcctcctcctcctcctccaccctcgtccgtccccttccggcgcgcgagctcgcccgagatggcgaacgcgagatcgggtgtcgctgtgaacgatgagtgcatgctgaagtttggcgagctgcagtcgaagaggctgcaccgcttcataactttcaagatggacgacaagttcaaggagatagttgtggacccaggtcggggatcgcgctaccagctacgatgacttcacaaacagcctccctgagaatgactgccgatacgcgatctatggattcgacttttgtactgcagaggatgtccagaaagcaggatcttccatatcctatggccccatcctccgccaagggaagagacagagctttattgcagctcaacccaaaaatcaagaggggccccaggggtttcgggtgaactccggccccagaggggagggaatccccccccaaggaacagggtccgggca

SEQ ID NO: 18592 - DNA, 609 bp, Zea mays
  misc_feature: Ceres CLONE 1384925-F
  misc_feature: Encodes the peptide sequence at SEQ ID NO. 18593
  misc_feature (406)..(406): n is a, c, t, g, unknown, or other
  misc_feature (407)..(407): n is a, c, t, g, unknown, or other
  misc_feature (475)..(475): n is a, c, t, g, unknown, or other
  misc_feature (501)..(501): n is a, c, t, g, unknown, or other
  misc_feature (537)..(537): n is a, c, t, g, unknown, or other
  misc_feature (609)..(609): n is a, c, t, g, unknown, or other
tccccgcggtggcggccgctctagaactagtggatcccccgggctgcaggaattcgcacgagaccattacctagaacatcctaatcgaaaagaaggcgaagaagaccaaccaaagcaaagccaacgggatctccctctcattccagaggactccgcgtcgtcaggcccgcttcgcgtgcgacgccggcatatagggtttcgccggcgccggcgatggacccaccccccgtgagccccgatcgctgggggcccagtcagggcgctggcgtcgggccctccggcctccgccgatatggcctcaatttctccgcctccagcctcctccaggcccccatcgcggccctccttgagtactccggcgtagtccagtccggccctgccctggcggcgcaccacccgtccgcgnngccctcgtcgccgttgtcggcgtcggaggtcgatggtcttctctccgctgccgccgctggggacgggnagttttcgatccggattcagggcggnccaggcgacacggaggccacgggcggggcggatgcngggacctcgtctgaggatttgatcgaggcgaccgccggctctgaggttgaccagcctcgctgcgggccaggn

SEQ ID NO: 18593 - protein, 132 aa, Zea mays
  misc_feature: Ceres CLONE 1384925-F
  misc_feature (65)..(65): Xaa is any aa, unknown, or other
  misc_feature (88)..(88): Xaa is any aa, unknown, or other
MDPPPVSPDRWGPSQGAGVGPSGLRRYGLNFSASSLLQAPIAALLEYSGVVQSGPALAAHHPSAXPSSPLSASEVDGLLSAAAAGDGXFSIRIQGGPGDTEATGGADAGTSSEDLIEATAGSEVDQPRCGPG

SEQ ID NO: 18594 - DNA, 601 bp, Zea mays
  misc_feature: Ceres CLONE 1384937-F
  misc_feature (467)..(467): n is a, c, t, g, unknown, or other
  misc_feature (571)..(571): n is a, c, t, g, unknown, or other
tggagctccccgcggtggcggccgctctagaactagtggatcccccgggctgcaggaattcgcacgagaccattacctagaacatcctaatcaaaaagagggggaggcagagagcttgccatcccaagcaaaggttccctctccttccccacctcgcgctcaacccccctcatcctcccacatccgattgtgccctgcgctctgccgttctcttatccaagatttcgccggcggcggctcagggagcggacaaagattgtttttttttcgggctatggagacgaggcctgattcattcagccccgggcggtggagtggcttcctgaccgggtctgattcgtattggttcaaatgatctgggcggcttaattggttgcatccgcttccaccggggaatcggagctaaggctgtggtttgttggccggctggtgaattcgtcggcttgggtctggtgagatcttgaggntttctggttcagcacacgggccgcaggtctgcgtaaatccccctctcgattccgtgccggatttggttagggttttggtttgagtctgggggaagaatgataancaaatcctttggcaggctgccgaggaaacc

SEQ ID NO: 18595 - DNA, 509 bp, Zea mays
  misc_feature: Ceres CLONE 1384939-F
  misc_feature (233)..(233): n is a, c, t, g, unknown, or other
  misc_feature (390)..(390): n is a, c, t, g, unknown, or other
tccccgcggtggcggccgctctagaactagtggatcccccgggctgcaggaattcgcacgagaccattacctagaacatcctaatcgaaaaattggatttgccccagtgtactacagactcgacaggtgagcataaaagaggagagccgataagcacaatggcgcctgaggaaaggatgaagcagacagagggcagtcacaaggtggtaacagcagcaggtggcaagatggcnggtcggagtggaggagcatcgtgacctcccttggcttttcttcatcctagcagctcgtcgtgttctcctctcgacagagaagcgggctccagaagaacagcgatagagccccggcgcgcaacaagagtgcagctggtctccggggcgctggttgacnacacgtgtcccggcgctgtacgagggctccaatgggcctttctctttccccgagggggccttgggaaaattttgggcaggaaaagattttcctttgtcccccccccttggggaaggggg

SEQ ID NO: 18596 - DNA, 731 bp, Zea mays
  misc_feature: Ceres CLONE 1384952-F
  misc_feature: Encodes the peptide sequence at SEQ ID NO. 18597
  misc_feature (644)..(644): n is a, c, t, g, unknown, or other
tccccgcggtggcggccgctctagaactagtggatcccccgggctgcaggaattcgcacgagaccattacctagaacatcctaatcaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacgtacccgctaacttgctcgtgctttgatcgggttgagcgctgctccgacgcctgtaaggagtgcgtggaaacggaggactcgcgccacgtctgcgtcgacaggtaccgtggcgaccccgggcccaggtgccacgacgaggacgggaggagcggcggacccgctgacgacgacgctggtgggcaagcgacgccgacggcagtgatggcagatgacaagaaagcaggcggcggcgacgacgacnagaagaagaggccgtggaaatgctgcgacgtgccatctgcaccagtcctgggctccggtgtgccgctgcgcgacccccggtggagcg

SEQ ID NO: 18597 - protein, 185 aa, Zea mays
  misc_feature: Ceres CLONE 1384952-F
  misc_feature (157)..(157): Xaa is any aa, unknown, or other
MAMGAASILLMMVSLEALLLAAAAGGGTIRLPSDVGGVAADLVTAMARARARAKHQLRDEERPWGECCDLAVCVKTYPLTCSCFDRVERCSDACKECVETEDSRHVCVDRYRGDPGPRCHDEDGRSGGPADDDAGGQATPTAVMADDKKAGGGDDDXKKRPWKCCDVPSAPVLGSGVPLRDPRWS

SEQ ID NO: 18598 - DNA, 858 bp, Zea mays
  misc_feature: Ceres CLONE 1384957-F
  misc_feature: Encodes the peptide sequence at SEQ ID NO. 18599
  misc_feature (1)..(1): n is a, c, t, g, unknown, or other
  misc_feature (2)..(2): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
nncccttttnnntttnnnttttttgcccttccctccccccagaatttataaagatggggctccccgcggtggcggccgctctagaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgcctcccgttcgtgctcgcgaacctcgggcgcctctacgacgccatcaccgacgccctccacggggtccgggtgcacgctagtggttcccgccgggaccgagcaatcggcccgcagcggaccttccccgaatgaaagagcccaccccggcgtcccccgttcccgcgaaccggaactgcgtcgaatgacactccccgccgctgcccaagctacgtgggtgagaccataatgctccttattcgaaagatacgctatcgggcccggacgttgggcgggcatgaggcacctggcaacgaacagccgcgactgacacggcgccaggacggaaccgcgacgaaacgggcgcgcgcgccccgggcgcggccctccccccccacaccaccgcccgcacacctcccggacccacacgccacacacacccacacacgcgcgaacccgccccgcccactcaccgaacactatgcgccccgccggctgatcttgtcccatgcgtgtgccgcgaggtgctcgtac

SEQ ID NO: 18599 - protein, 73 aa, Zea mays
  misc_feature: Ceres CLONE 1384957-F
MGALRSLAISYPEFLVAGLCFVSLSALRHAMRERRQRAPLSWPVVGMPPVRAREPRAPLRRHHRRPPRGPGAR

SEQ ID NO: 18600 - DNA, 684 bp, Zea mays
  misc_feature: Ceres CLONE 1384967-F
  misc_feature: Translation starting site: 168
  misc_feature (287)..(287): n is a, c, t, g, unknown, or other
  misc_feature (288)..(288): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (302)..(302): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (326)..(326): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (657)..(657): n is a, c, t, g, unknown, or other
  misc_feature (658)..(658): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (669)..(669): n is a, c, t, g, unknown, or other
  misc_feature (671)..(671): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (684)..(684): n is a, c, t, g, unknown, or other
ggagctccccgcggtggcggccgctctagaactagtggatcccccgggctgcaggaattcgcacgagaccattacctaaaacatcctaatcgaaaaatccaattcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcgnngnnnnnnnnnnaancgcatctccnnnctcatctacaangagacccgcggcgggctcaaaatctttctgaaaaactgcgggggggggggcggcctaacccatcacggaatgacccccccccgccccccggctccgcccgtggggggcgcctgggtccgggacgaccccgccccccgggcaggacgcctgggctgccgcccttccgtcatcgtcctccccaaatatgacaggtctcacgcccgcccgctgccgtcgctttctccaggcacgtatacatccggcagtgccgacgtcccccaatccacctccactttcctctatgggggcaggnnnnnnnnnnnnnnnnnnnnnnnnnnncnnnnnnnnnntnngnnnnnntttntntnnnnnnnnnngn

SEQ ID NO: 18601 - DNA, 636 bp, Zea mays
  misc_feature: Ceres CLONE 1384973-F
  misc_feature: Encodes the peptide sequence at SEQ ID NO. 18602
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (502)..(502): n is a, c, t, g, unknown, or other
aaagctggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcggcgttgcaggggttcctgtgcctggaggaggtggacgggaggcggtggagctacgtggtggacgtggnnnnccgcgaaggggaggagcnaggggcggggccgtccccgctggggccgccggtcagggccgtgccgctgcagtcgccgcttccgcctgccgaggaaataatggcattcataagaatcatatgtggtgccctgaaggttttccagacagtgttac

SEQ ID NO: 18602 - protein, 126 aa, Zea mays
  misc_feature: Ceres CLONE 1384973-F
  misc_feature (75)..(75): Xaa is any aa, unknown, or other
  misc_feature (76)..(76): Xaa is any aa, unknown, or other
  misc_feature (82)..(82): Xaa is any aa, unknown, or other
MAPAVGLKRSATQTITLPPPDTRLAVRDVMRSTIPSQPAVAPASTERQAPAAALQGFLCLEEVDGRRWSYVVDVXXREGEEXGAGPSPLGPPVRAVPLQSPLPPAEEIMAFIRIICGALKVFQTVL

SEQ ID NO: 18603 - DNA, 732 bp, Zea mays
  misc_feature: Ceres CLONE 1384980-F
  misc_feature: Encodes the peptide sequence at SEQ ID NO. 18604
  misc_feature (53)..(53): n is a, c, t, g, unknown, or other
  misc_feature (74)..(74): n is a, c, t, g, unknown, or other
  misc_feature (78)..(78): n is a, c, t, g, unknown, or other
  misc_feature (82)..(82): n is a, c, t, g, unknown, or other
  misc_feature (104)..(104): n is a, c, t, g, unknown, or other
aagctggagctccccgcggtggcggccgctctagaactagtggatcccccggnctcaaagctgggagctcacgncggngggncggccgctctagaactagtggnatccccccgggctgcaggaaattcgcccgagaacctttaccctaaaaacatccctattccaaaaaaaggcggcatagaatcctctccgccccccttggccctttgatagattcccccgggattgtgcccccaggggctcccccccagatgttcccaaattttggggggtggagagggacgacaaacaggtcgggggggggaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggtgccaagaaggttgtcatttctgctcctagcaaggatgcccccatgttcgttgttggtgtcaacgagaaggagtacaagtctgacatcaacattgtctctaatgctagctgcacaaccaactgccttgctccgcttgctaaggtcatcaatgacaagttcggtattgttgagggtct

SEQ ID NO: 18604 - protein, 133 aa, Zea mays
  misc_feature: Ceres CLONE 1384980-F
  misc_feature (1)..(112): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEG

SEQ ID NO: 18605 - DNA, 731 bp, Zea mays
  misc_feature: Ceres CLONE 1384987-F
  misc_feature: Encodes the peptide sequence at SEQ ID NO. 18606
  misc_feature (484)..(484): n is a, c, t, g, unknown, or other
  misc_feature (485)..(485): n is a, c, t, g, unknown, or other
  misc_feature (488)..(488): n is a, c, t, g, unknown, or other
  misc_feature (489)..(489): n is a, c, t, g, unknown, or other
  misc_feature (492)..(492): n is a, c, t, g, unknown, or other
ggagctccccgcggtggcggccgctctagaactagtggatcccccgggctgcaggaattcgcacgagaccattacctagaacatcctaatcgaaaaatttacacgcgcacactccacttcatcaccggatcaccagcctacagctcgtcacatctctctctccgcccggccggcctctagactcactctagccatatggccacggtgcacggcagcaggctcatcttcctcttcgagggcacgctcttctcggcgctgctgctcgtcccggcacgccctgcttccgccacagacggcagcgcgtacccggccggcgactgcccctacccgtgcctgccgccgcccgccgtcaccgccaactgcccgccgcctccgccggctgcggcgtcgtactcgtacccgccaccgccgggggcttacattccctacttccagcctgcggcggatggcggtggtggcgcgtagtgggggggggtacgagaanntanncgnaagacgacgacgaccagaaggttgcagcgacgccgcaatcggacgcaaaagctcacgtggtgggatggccaccaatccgaagctacggcaagaacacgatgtctaccacccagctgaagggcagcaaggaggatgctgagggcaagcaggaccaggggttcctgtacgtcaaggtcattatggatggcgcgccgtacctcaggaaaaatgacctccagaattaccagaactacagggag

SEQ ID NO: 18606 - protein, 47 aa, Zea mays
  misc_feature: Ceres CLONE 1384987-F
MSTTQLKGSKEDAEGKQDQGFLYVKVIMDGAPYLRKNDLQNYQNYRE

SEQ ID NO: 18607 - DNA, 729 bp, Zea mays
  misc_feature: Ceres CLONE 1384989-F
  misc_feature: Encodes the peptide sequence at SEQ ID NO. 18608
tggagctccccgcggtggcggccgctctagaactagtggatcccccgggctgcaggaattcgcacgagaccattacctagaacatcctaattgaaaactcgcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcgggtgctgtggaccgagagcaaggacgtgggcagggctttcgctggatccgattggtaaccaacacccgcctcaactttcagccctttcaacggggaaaaggaacccggggggggtgaccaagggcccccccgctgggttttgggaaggggggcaagggcaaaaaaccaaatgtggaaaacctcgtgcggggggccccaggggaaaatttctcccgggccccacccggagggcccccccccccgg

SEQ ID NO: 18608 - protein, 147 aa, Zea mays
  misc_feature: Ceres CLONE 1384989-F
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASGAVDREQGRGQGFRWIRLVTNTRLNFQPFQRGKGTRGG

SEQ ID NO: 18609 - DNA, 656 bp, Zea mays
  misc_feature: Ceres CLONE 1384991-F
  misc_feature: Encodes the peptide sequence at SEQ ID NO. 18610
  misc_feature (463)..(463): n is a, c, t, g, unknown, or other
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcgaaaatcccacgatcgtcccccctgacctgcccatttcgctctcctccctaggcaactaaacttcgtgctcccgcacacggtaccagccgccgcgagggggtcctcgtcctcgccaccgccaccaccgccgctgccactgcccatgattgggagcgccgaagacctcaccatcttcatcactgcggcatcccccgctaacacgccccggctcgctggcggaacgccaccactcgagtttccgcgctcggatatctccacagccatcctgcaaagagcagtgccgtggtcctcactttctacctctccggggaattactagagtcatttcgtgtcgtctgcgtcggtgttcacccctgccccgccgnctgcttctgtgaatgtcgcgctgccgccggagaatgtgccgcctctcttctactaagaggcgtacgcgagccgacagcatgacgtatcgccgtctccgatgcttcgtgggacgccctcatgagcgtctagaaagtgcacaccagcctcaaggacgacgtggcgtactgctacgacctgctgcacgtcctgtan

SEQ ID NO: 18610 - protein, 58 aa, Zea mays
  misc_feature: Ceres CLONE 1384991-F
MIGSAEDLTIFITAASPANTPRLAGGTPPLEFPRSDISTAILQRAVPWSSLSTSPGNY

SEQ ID NO: 18611 - DNA, 634 bp, Zea mays
  misc_feature: Ceres CLONE 1384992-F
  misc_feature: Encodes the peptide sequence at SEQ ID NO. 18612
  misc_feature (159)..(159): n is a, c, t, g, unknown, or other
  misc_feature (163)..(163): n is a, c, t, g, unknown, or other
  misc_feature (165)..(165): n is a, c, t, g, unknown, or other
  misc_feature (167)..(167): n is a, c, t, g, unknown, or other
  misc_feature (168)..(168): n is a, c, t, g, unknown, or other
  misc_feature (330)..(330): n is a, c, t, g, unknown, or other
  misc_feature (382)..(382): n is a, c, t, g, unknown, or other
  misc_feature (387)..(387): n is a, c, t, g, unknown, or other
  misc_feature (411)..(411): n is a, c, t, g, unknown, or other
  misc_feature (424)..(424): n is a, c, t, g, unknown, or other
aagctggagctccccgcggtggcggccgctctagaactagtggatcccccgggctgcaggaattcgcacgagaccattacctagaacatcctaatcgaaaaatcatccaatccagatcagcaaagcggcagtgcgtagagaggatccgtcgaacagaanaccnangnnccatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcgnagtacctgaggcagccgcagtgcagcccgctggcggcggcgccctactacgnccggntgtgggcagccgatcgccatgttnccagccgctccgnaaacagtgctgccagcaacagatgaggatgatggacgtgaattcccgtcgcgcaacaacctggaaatgatgatgcaactttgaccggtgccgtttgccccaaaaaaaatcttgtacgaaacagcttttgattgaaaaacaaaaaacaaattgtttggaaaccccaggtttttcacccccctggggcctttgaaaattgggcccaaaaaaa

SEQ ID NO: 18612 - protein, 92 aa, Zea mays
  misc_feature: Ceres CLONE 1384992-F
  misc_feature (54)..(54): Xaa is any aa, unknown, or other
  misc_feature (71)..(71): Xaa is any aa, unknown, or other
  misc_feature (73)..(73): Xaa is any aa, unknown, or other
  misc_feature (81)..(81): Xaa is any aa, unknown, or other
  misc_feature (85)..(85): Xaa is any aa, unknown, or other
MKMVIVLVVCLALSAASASAMQMPCPCAGLQGLYGAGAGLTTMMGAGGLYPYAXYLRQPQCSPLAAAPYYXRXWAADRHVXSRSXNSAASNR

SEQ ID NO: 18613 - DNA, 658 bp, Zea mays
  misc_feature: Ceres CLONE 1385000-F
  misc_feature: Encodes the peptide sequence at SEQ ID NO. 18614
  misc_feature (545)..(545): n is a, c, t, g, unknown, or other
  misc_feature (555)..(555): n is a, c, t, g, unknown, or other
aaagctggagctccccgcggtggcggccgctctagaactagtggatcccccgggctgcaggaattcgcacgagaccattacctagaacatcctaatcgaaaaatacctcctcaaggcacgttcaccacagtcctctctttccccggcaccaccaccaccacccaggctaacaggactggaccgagtgttgaacaacactgcagtgagtgacggcaggcatggtgagccgtgaaaatttgcacctggtgctggacccggcgtctctgggcgcgccttgggccgacccgtccgccgcagagatcccgccgcagctcctcgccgcgctgggagagtacctctcctccgcccgcggcgacgtcgagacggaggcggacgacgagttcatgatgcacgagttcaaggtgcggcggtgcgcgcgcgcgcggagccacgactggacggcgtgcccctacgcgcacccgggggaggccgcgcggcggcgggacccgcgccgcgtggcctacgcgggggagccgtgcccggacttccggcgccgcccgggccgnggcgccgcgntgcccgcgcggggccgcctgcccgctcgcgcacggcaccttcgagctgtggctccacccgtcccgctaccgcacgcgccccttgccgcgcgggcgctgcctgc

SEQ ID NO: 18614 - protein, 146 aa, Zea mays
  misc_feature: Ceres CLONE 1385000-F
  misc_feature (113)..(113): Xaa is any aa, unknown, or other
MVSRENLHLVLDPASLGAPWADPSAAEIPPQLLAALGEYLSSARGDVETEADDEFMMHEFKVRRCARARSHDWTACPYAHPGEAARRRDPRRVAYAGEPCPDFRRRPGRGAAXPARGRLPARARHLRAVAPPVPLPHAPLAARALP

SEQ ID NO: 18615 - DNA, 620 bp, Zea mays
  misc_feature: Ceres CLONE 1385004-F
  misc_feature (490)..(490): n is a, c, t, g, unknown, or other
  misc_feature (494)..(494): n is a, c, t, g, unknown, or other
  misc_feature (495)..(495): n is a, c, t, g, unknown, or other
  misc_feature (498)..(498): n is a, c, t, g, unknown, or other
  misc_feature (513)..(513): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (570)..(570): n is a, c, t, g, unknown, or other
  misc_feature (592)..(592): n is a, c, t, g, unknown, or other
tggagctccccgcggtggcggccgctctagaactagtggatcccccgggctgcaggaattcgcacgagaccattacctagaacatcctaaccgaaaaatcgcacatattattgagaccaactagcaacatagaaagcacaatagcgtaccaacaatggcagccaacatattttgcttccttatgctccttggcctttctgcaagtgctgctaccgcaaccattttcccacaatggtcacaagctcctatagcttcccttcttcccccatacctctcaccagcggtgtcttcaatgtgtgaaaacccaattgttcaaccctacaggatcaaacaggcaatcgcaacagccatcgtacccattatcaccctttggttctccccaacaaccgtgggggccttttttaaggggggaacccccttgtcccccccctttttttggggaacaaaaaaaaacttcggggggcgcccccccccaactattttattgagngggnnccngttggggtggggggnagaaggggaaaaaccaaggggcccccggcggcctctnnnttctcccccccccaccanttttttctttttttctttcctnagacacccgggggggggtgtttcctctc

SEQ ID NO: 18616 - DNA, 683 bp, Zea mays
  misc_feature: Ceres CLONE 1385007-F
  misc_feature: Translation starting site: 177
  misc_feature (537)..(537): n is a, c, t, g, unknown, or other
  misc_feature (582)..(582): n is a, c, t, g, unknown, or other
  misc_feature (629)..(629): n is a, c, t, g, unknown, or other
tccccgcggtggcggccgctctagaactagtggatcccccgggctgcaggaattcgcacgagaccattacctagaacatcctaatcgaaaaatcgcgtctaaacccttgtctccttcttatccccacctccctcgcggatcactcgccgccgccgccggccgcagccatcgccgtgatgctgtccctgtcgagggcgatcgggaggcggctcttctcgtccgccgaggccgcgtcgacggctgcggtgaggacggcgcagaacccgctcgaggagttcttcgaggtcgagcggagccaccgaggagggcaagcctcctccccactacggcgccagctggaaggcttctgaactgcgactaagatcttggggatgaccttcagaaatttgtggtatgttcttctagaggaaaagaacatgctaatgacacagcgtcaaatgctgcattcgagaaggcatgaggttcccaaatccagaacgaatttccaagggaaaggaaatcaatgtgcgggaaaaagcatgtcttggactgagaggncttatagcggagccgaatccaaggaggatcttggaaaatggaagnggaggataaatggccctgggattcactcacaggcattcctccctggnaacttttgatgggactttattaaaaaagactggtgggcctcctgggtggatctt

SEQ ID NO: 18617 - DNA, 757 bp, Zea mays
  misc_feature: Ceres CLONE 1385014-F
  misc_feature: Translation starting site: 164
  misc_feature (469)..(469): n is a, c, t, g, unknown, or other
  misc_feature (675)..(675): n is a, c, t, g, unknown, or other
  misc_feature (677)..(677): n is a, c, t, g, unknown, or other
aaagctggagctccccgcggtggcggccgctctagaactagtggatcccccgggctgcaggaattcgcacgagaccattacctagaacatcctaatcgaaaaattgtggctcctcacttccgcgccgccacccccttcaggtaaggaagaggaggagggcaggatgtcgcaccgtaagttcgagcacccgaggcacggctccctcggcttccttcccaggaagcgctcctcccgccaccgcggcaaggtgaagtcattccccagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactncaactctgtttgggcccaacatcttagcgaagaagtggaggagaaggttctacaagaactggtgcaaaggcaagaagaaggctttcacaaagtatgctctcaaatatgaaaaatgatggctggcaagaaggaaattcagctgcagctttgagaagatgaaaaaaatatgctttctgttatccgtgtcattgctcatacaagattangnaaaaaaaatgaagggtttgaaaacagaagaaggctcacctgaatggagattcaggggtcaatgggtggtaccattgcctt

SEQ ID NO: 18618 - DNA, 746 bp, Zea mays
  misc_feature: Ceres CLONE 1385018-F
  misc_feature: Encodes the peptide sequence at SEQ ID NO. 18619
  misc_feature (406)..(406): n is a, c, t, g, unknown, or other
  misc_feature (441)..(441): n is a, c, t, g, unknown, or other
  misc_feature (448)..(448): n is a, c, t, g, unknown, or other
  misc_feature (455)..(455): n is a, c, t, g, unknown, or other
  misc_feature (502)..(502): n is a, c, t, g, unknown, or other
  misc_feature (515)..(515): n is a, c, t, g, unknown, or other
aagctggagctccccgcggtggcggccgctctagaactagtggatcccccgggctgcaggaattcgcacgagaccattacctagaacatcctaatcgaaaaaatatcgcattgacagatcgttcatcgtagcctcctccagtcgtctcccgggatcttctccggctataaatttccgccccaattccccaatccagatgcgcaaacatcgaatcgtctcgctcgtggctgccctgctcatactgcttgccctcgccgtatcgtccacccgcaacgcacaggaggattccatggccgacaacaccgggacgttggcgggcggcatcaaggacgtgccggggaacgagaacgaccttcacctccaggaactcgcccgcttcgccgtcgatgagcacaacaagaagggncatgctcttctggggttcgagaagcttgtgaaggncagacancagtggntgctggcacgatgtactatctcactattgaagtgaaggatggcgaantgaaaaactctancaagctaaggctgggagaaagcatgggagaacttcagggactgcagggattccagcctggttaaaagggggctagcgcctaaggatttctccttcctcagggggagccttgaagttcaaagaaagttgcaaaaaaggggcccccctccaaaggggaaaaccggggcccttgggaaatttcaaaaaaaaaaaccctttttagggttgggcccttggggtcggggcaaaagaa

SEQ ID NO: 18619 - protein, 97 aa, Zea mays
  misc_feature: Ceres CLONE 1385018-F
  misc_feature (82)..(82): Xaa is any aa, unknown, or other
  misc_feature (84)..(84): Xaa is any aa, unknown, or other
  misc_feature (87)..(87): Xaa is any aa, unknown, or other
MRKHRIVSLVAALLILLALAVSSTRNAQEDSMADNTGTLAGGIKDVPGNENDLHLQELARFAVDEHNKKGHALLGFEKLVKXRXQWXLARCTISLLK

SEQ ID NO: 18620 - DNA, 658 bp, Zea mays
  misc_feature: Ceres CLONE 1385022-F
  misc_feature: Encodes the peptide sequence at SEQ ID NO. 18621
  misc_feature (658)..(658): n is a, c, t, g, unknown, or other
agagctggagctccccgcggtggcggccgctctagaactagtggatcccccgggctgcaggaattcgcacgagaccattacctagaacatcctaatcgaaaaaaaaaaactcccaaacaggacctgttgaactgtccttgcttctaaacggagtgagtagcgatagtgacgcagtcgtcttgccgccgccgtcccaaacgtccgcgcggtcgtcctcgatcttcccgtaccatcccgacgcgatggccgccggcgcgaagcccgataccgccgcgcccccgcaagcgccttcggcggcgaagggggtcttcatgcgccgcatcttccccttcctcctcgcgacgaacgtcttcatcggagtttatgtatttgccaagacctacaaaagagaccaggaaaagaaaaatgctcagactactgccgctgcagcattgtcatccccagcaagtacatctgccgaggctccagatcctgctcctgcacctgcgcccaaatcggttctcccacctctatccgaagatgagcagtggaatctgtacaaatggattctggaagaggagcggaagatcaaaccacgcaacgccactgagaagaagaagatcgctgaggagaaagctcttctcaaggagataattcgggataagtctctccctcgttn

SEQ ID NO: 18621 - protein, 138 aa, Zea mays
  misc_feature: Ceres CLONE 1385022-F
MAAGAKPDTAAPPQAPSAAKGVFMRRIFPFLLATNVFIGVYVFAKTYKRDQEKKNAQTTAAAALSSPASTSAEAPDPAPAPAPKSVLPPLSEDEQWNLYKWILEEERKIKPRNATEKKKIAEEKALLKEIIRDKSLPR

SEQ ID NO: 18622 - DNA, 715 bp, Zea mays
  misc_feature: Ceres CLONE 1385031-F
  misc_feature: Encodes the peptide sequence at SEQ ID NO. 18623
  misc_feature (438)..(438): n is a, c, t, g, unknown, or other
tggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcacctttctcagccagactggtgctgggaagcacngtccccgtgcaatctttcgtgatctagaacccactgggatcgatgaggtgggcactgggacgtaccgccaggtcttccaacctgagcagttcatcagtggccaggagggatgcggttacaattccgcccggggccaccaaccaattggcaaaggaaatggtggatttgggctctgaccgtatcccaaggttggttgaaattggcccggccccagggggttccgggctttaagggccgtgggggggggactggctcttgccctggtcccccccccctg

SEQ ID NO: 18623 - protein, 119 aa, Zea mays
  misc_feature: Ceres CLONE 1385031-F
  misc_feature (62)..(62): Xaa is any aa, unknown, or other
MRECISVHIGQAGIQVGNACWELYCLEHGIQPDGQVPGDKTAGHHDDAFSTFLSQTGAGKHXPRAIFRDLEPTGIDEVGTGTYRQVFQPEQFISGQEGCGYNSARGHQPIGKGNGGFGL

SEQ ID NO: 18624 - DNA, 509 bp, Zea mays
  misc_feature: Ceres CLONE 1385034-F
  misc_feature: Encodes the peptide sequence at SEQ ID NO. 18625
  misc_feature (304)..(304): n is a, c, t, g, unknown, or other
aagctggagctccccgcggtggcggccgctctagaactagtggatcccccgggctgcaggaattcgcacgagaccattacctagaacatcctaatcgaaaatcgtctccactgctctgctgctcctcgcaccgccgccgccgccgccgcagcgacgtaatggcttccgccgcggtgctccggaacgccggctcccggcgcctcttctcctaccctactctccgcgccgctgcgatatatgtaccttctgcgctacccgatgcgcccgcggcggcggcagcgccggcccagccgccaccgacggncgggaccctctgggcgaggtctatggccaccttcacgcgcacgagccccatgtgatgtcggcaccattgggcacgtcgatcacggcaaaccactctcactgctgtcatttaccaggtcctggccgaggcaggggagggccaaagcccgtgcttttcgacgagatcgacaagggctccggaggagaaaggcagagggatccccata

SEQ ID NO: 18625 - protein, 66 aa, Zea mays
  misc_feature: Ceres CLONE 1385034-F
  misc_feature (49)..(49): Xaa is any aa, unknown, or other
MASAAVLRNAGSRRLFSYPTLRAAAIYVPSALPDAPAAAAAPAQPPPTXGTLWARSMATFTRTSPM

SEQ ID NO: 18626 - DNA, 614 bp, Zea mays
  misc_feature: Ceres CLONE 1385035-F
  misc_feature: Encodes the peptide sequence at SEQ ID NO. 18627
aaagctggagctccccgcggtggcggccgctctagaactagtggatcccccgggctgcaggaattcgcacgagaccattacctagaacatcctaatcgaaaagattcaggaggggatagcatcgtcatcgcaaaatgcaggctctcctgctccccgcgcgggccgcgccgccgacgccggcgatgcttcggcagcgtgcggtttctgcctccgcgtgtgcgtcgcaggtctgccgccccctattcggtgccgccaattgcatctcctgtggggtctacggaagcgttcggcggcacctcacagtggcggtggcggcggccccgccctcgccttcgtcctcaccttcgtcgggaccgctctacccgacgcctccacccaccgagcaggaggtggagagggtcaagctcgagcaggttatgaggagactagagaaaaacagcagggtatttcaaggatttggggtaccctggggggttcttggccccaatttggggggggcacaaataatatttcggggcggaaaaatttggggattttttcccccaagcgggagaaacacgggggaaaagaggggaaaacaccccccccctccctttttttttgttggtgggggt

SEQ ID NO: 18627 - protein, 160 aa, Zea mays
  misc_feature: Ceres CLONE 1385035-F
MQALLLPARAAPPTPAMLRQRAVSASACASQVCRPLFGAANCISCGVYGSVRRHLTVAVAAAPPSPSSSPSSGPLYPTPPPTEQEVERVKLEQVMRRLEKNSRVFQGFGVPWGVLGPNLGGAQIIFRGGKIWGFFPPSGRNTGEKRGKHPPPPFFFVGGG

SEQ ID NO: 18628 - DNA, 656 bp, Zea mays
  misc_feature: Ceres CLONE 1385039-F
  misc_feature: Encodes the peptide sequence at SEQ ID NO. 18629
aaagctggagctccccgcggtggcggccgctctataactagtggatcccccgggctgcaggaattcgcacgagaccattacctagaacatcctaatcgaaaagctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcggatacggtggtggccgtggaggcggcggctacggcggtggcgggcgccgtgatggcggcggcggctacggcggtgccggcggctacggtggtgccggcggcgtctacggtgatggtggcggcggctacggcggtggcaaccgtggcggcggctacggcaactccgacg

SEQ ID NO: 18629 - protein, 152 aa, Zea mays
  misc_feature: Ceres CLONE 1385039-F
  misc_feature (10)..(81): Pfam Name: RRM_1 Pfam Description: RNA recognition motif. (a.k.a. RRM, RBD, or RNP domain)
  misc_feature (48)..(152): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGGYGGGRGGGGYGGGGRRDGGGGYGGAGGYGGAGGVYGDGGGGYGGGNRGGGYGNSD

SEQ ID NO: 18630 - DNA, 628 bp, Zea mays
  misc_feature: Ceres CLONE 1385044-F
  misc_feature: Encodes the peptide sequence at SEQ ID NO. 18631
aagctggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcctgcgtccgagcgagcgggtcgaggtacggcggaaccgctacaaggtggcggttcacgcgtaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaattatcaaaacaggtgtagttccaagatttgtgcagtctctcaccagag

SEQ ID NO: 18631 - protein, 80 aa, Zea mays
  misc_feature: Ceres CLONE 1385044-F
  misc_feature (1)..(60): Pfam Name: IBB Pfam Description: Importin beta binding domain
MVEIRKSRREESLLKRRREGLQAQVPAPPSGVEKKLESLPAMVSGVYSDDNNLQLEATTQFRKLLSIERSPPIEELSKQV

SEQ ID NO: 18632 - DNA, 651 bp, Zea mays
  misc_feature: Ceres CLONE 1385045-F
  misc_feature: Encodes the peptide sequence at SEQ ID NO. 18633
  misc_feature (283)..(283): n is a, c, t, g, unknown, or other
  misc_feature (299)..(299): n is a, c, t, g, unknown, or other
  misc_feature (445)..(445): n is a, c, t, g, unknown, or other
  misc_feature (593)..(593): n is a, c, t, g, unknown, or other
  misc_feature (596)..(596): n is a, c, t, g, unknown, or other
  misc_feature (601)..(601): n is a, c, t, g, unknown, or other
  misc_feature (611)..(611): n is a, c, t, g, unknown, or other
tccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggctgcggacgatgnatggggcgccggcggnctgtacccctacgcggagtacctgaggcagccgcagtgcagccccgctggcggcggcgcctactaacgccgggtggtgggcagacgagcgccatgtaccagccgctccggcaacagtgctgccagcagcagatggaggatgatggnacgtgcagtccgtcgcgcagcagctgcagatgatgatgcagcttgagcgtgccgctgccgccagcagcagcctgtacgagccagctctgatgcagcagcagcagcagctgctggcagcccagggtctcaaccccttggccatgatganggncgcanaacatgccgnccatgggtggactctaccagtaccagtaccagctgcccag

SEQ ID NO: 18633 - protein, 59 aa, Zea mays
  misc_feature: Ceres CLONE 1385045-F
  misc_feature (40)..(40): Xaa is any aa, unknown, or other
  misc_feature (41)..(41): Xaa is any aa, unknown, or other
  misc_feature (43)..(43): Xaa is any aa, unknown, or other
  misc_feature (46)..(46): Xaa is any aa, unknown, or other
MMMQLERAAAASSSLYEPALMQQQQQLLAAQGLNPLAMMXXAXHAXHGWTLPVPVPAAQ

SEQ ID NO: 18634 - DNA, 613 bp, Zea mays
  misc_feature: Ceres CLONE 1385046-F
  misc_feature: Translation starting site: 248
  misc_feature (420)..(420): n is a, c, t, g, unknown, or other
  misc_feature (444)..(444): n is a, c, t, g, unknown, or other
  misc_feature (445)..(445): n is a, c, t, g, unknown, or other
  misc_feature (452)..(452): n is a, c, t, g, unknown, or other
aaagctggagctccccgcggtggcggccgctctagaactagtggatcccccgggctgcaggaattcgcacgagaccattacctagaacatcctaatcgaaaaatcacccatattattgataccaactagcaacatacatagtgaagtacactagcaacatcttagcaccaatgggagccaagatttttgccctccttgccctccttgctctttcagcaagcgctgctacctcgacttttattccacaatgctcacaacaatacctctctccggtgacagccgcgggatttcaatacccaactatacaatcctacatggtacaagaggccatccaagcaagcatcttacggtcattagcattaaccctccaacaaccatatgctctattgcacagccatccttagtgcatctgtatctccnaagaaatcgcgcacaacaactacnnacacagntgctaccaacaaaatcatcagtaggtgcagcgaaccttgctgctttacctcagcaacacagtttcttccattcaatcactagctggggtgaccctgctatctactggcaggacaacagttactaccatttacccaactggcgggagcccttatggcttctt

SEQ ID NO: 18635 - DNA, 660 bp, Zea mays
  misc_feature: Ceres CLONE 1385052-F
  misc_feature: Translation starting site: 502
  misc_feature (500)..(500): n is a, c, t, g, unknown, or other
aaagctggagctccccgcggtggcggccgctctagaactagtggatcccccgggctgcaggaattcgcacgagaccattacctagaacatcctaatcgaaaaactcacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggtgggtagtagtcaatacctgcttagcaatgggaccgccctagtgctcttcctctccccggtgcctacgttcatccgcatctggaagaaggggtcggtggagcagtactcgccgatcccgtacgtggcgacgctgctgaactgncatgatgtgggtgttgtacgggctgccgctggtgcacccgcacagcatgctggtgatcaccatcaacggcaccggcatgctcatccagctgacctacgtggcgctcttctcgtctactcccgcggggggcgggcgcgccgcaaggtgtccctctgttggg

SEQ ID NO: 18636 - DNA, 707 bp, Zea mays
  misc_feature: Ceres CLONE 1385055-F
  misc_feature: Encodes the peptide sequence at SEQ ID NO. 18637
gctctagaactagtggatcccccgggctgcaggaattcgcacgagaccattacctagaacatcctaatcaaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcacccctacaggatccaacaggcaatcgcagctggcatcttacctttatccacccttgtgcctcccaacatcatcagcccctattaccacagttacccttttggggcattttattgggcaccaaaacatccagggcaccaacaaactacaacaaccttggggttagcaaaaccctggcttggctacttctcagcaaacaggaagtttccttcccattccacccaactaaaggtcccctggagacccccgccttcttaatttggaaaaaaaaaaaaaaaacaatttaagcccagttaccttggtggccacacccccaaaaattttctttccttctcccccattaagcaggattgggaaccccccccgggtttttttaagggggaaaaaaaattaaaatcatttcgcccggtgtagggg

SEQ ID NO: 18637 - protein, 138 aa, Zea mays
  misc_feature: Ceres CLONE 1385055-F
MAAKIFCLLMLLGLSASAATATIFPQCSQAPIASLLPPYLSPAVSSVCENPILHPYRIQQAIAAGILPLSTLVPPNIISPYYHSYPFGAFYWAPKHPGHQQTTTTLGLAKPWLGYFSANRKFPSHSTQLKVPWRPPPS

SEQ ID NO: 18638 - DNA, 589 bp, Zea mays
  misc_feature: Ceres CLONE 1385072-F
  misc_feature (196)..(196): n is a, c, t, g, unknown, or other
  misc_feature (197)..(197): n is a, c, t, g, unknown, or other
  misc_feature (268)..(268): n is a, c, t, g, unknown, or other
  misc_feature (476)..(476): n is a, c, t, g, unknown, or other
tccccgcggtggcggccgctctagaactagtggatcccccgggctgcaggaattcgcacgagaccattacctagaacatcctaatcgaaaaactgatggatcactcctgcagctgcagctgcagtgcgtcgccgctactccatcgtctattaattcctcgtgtagctccagcgctcggcttaagacagcctctccnnacatgagctcctgggttggatgcacccggaagtacgacagaacagtaatgatgtgttcaaagagttcaacnacgcctggaggtgggacgtgcaactgcatcaccgggctgggcgggtcggaacccggccacttttctcggcaccggcaaaggaataattcgccgccgacaaagatttcacaaaaattattcattggtggcggccgccgacctctttaaccttgggggggaggcggcctcctccacacttgggacgcttaggattctcccccccccccgntgtgcttccaaatgttataaaaaattattataaaggcccaccccccaaggttgaatccccaattttaacaacaacgcacaccccccgccgggggattaacaaaaaacaaggcc

SEQ ID NO: 18639 - DNA, 629 bp, Zea mays
  misc_feature: Ceres CLONE 1385073-F
  misc_feature (596)..(596): n is a, c, t, g, unknown, or other
  misc_feature (629)..(629): n is a, c, t, g, unknown, or other
tccccgcggtggcggccgctctagaactagtggatcccccgggctgcaggaattcgcacgagaccattacctagaacatcctaatcgaaaagaaaggtagatattttttcccgtctcgctcaatgattcaccccatcgcagccatcgatcagaaaatttacggctcataattctcgtctgcttatccgctcccttctctccctcaacttcagcaagttccccgcaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaaaaaaagcatccgccgcgtcgcttcatcctgaagccacctctcgatgacgagcgccttacccggcggttcctcagcagcccgcagctgtcgctcaaggcgctcccgctgctctcttcctgcctcccctcccgcgcgntctcccacgccgacagggactggatggacgagn

SEQ ID NO: 18640 - DNA, 632 bp, Zea mays
  misc_feature: Ceres CLONE 1385075-F
  misc_feature: Encodes the peptide sequence at SEQ ID NO. 18641
aagctggagctccccgcggtggcggccgctctagaactagtggatcccccgggctgcaggaattcgcacgagaccattacctagaacatcctaatcgaaaaacttactggtcctcactcccacaccaaccaaccaacctcctctgcctgccgcttctcctgctgcgggcggtcacggatgcaagaactagaggaggacatccgcttccattactgcgcctgcgaggatcggaggaaccagtagcggaggcttcgattttcggcggtggcaataaatttcccgcatggctcggaggggcgcgtcctcgctcgtctcccgctgcctcctggagagggaccctgccggtgcgccgcccgctgccccctctgcgctgcgcaggacagtgcctgcagatgagatgcacaggctgttgccaggtgtccttcagaggttcagcactgcagcagcagtagaggagcccatcacgccgtcagtccatgagaactacacaaagctcctcattaatggcaactttgttgattccgcatccggcaagaccttcccaactctggaccctcgtacaggcgaggtgattgctcatgtggctgaccgtgacgcagaggacattaaccgtgcagtagctgcggctcgca

SEQ ID NO: 18641 - protein, 116 aa, Zea mays
  misc_feature: Ceres CLONE 1385075-F
  misc_feature: SWISSPROT Homolog: EC 1.2.1.3 Aldehyde dehydrogenase (NAD(+))
MARRGASSLVSRCLLERDPAGAPPAAPSALRRTVPADEMHRLLPGVLQRFSTAAAVEEPITPSVHENYTKLLINGNFVDSASGKTFPTLDPRTGEVIAHVADRDAEDINRAVAAAR

SEQ ID NO: 18642 - DNA, 581 bp, Zea mays
  misc_feature: Ceres CLONE 1385081-F
  misc_feature (204)..(204): n is a, c, t, g, unknown, or other
  misc_feature (205)..(205): n is a, c, t, g, unknown, or other
  misc_feature (237)..(237): n is a, c, t, g, unknown, or other
  misc_feature (238)..(238): n is a, c, t, g, unknown, or other
  misc_feature (243)..(243): n is a, c, t, g, unknown, or other
  misc_feature (254)..(254): n is a, c, t, g, unknown, or other
cgcggtggcggccgctctagaactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccgcgnncgaggtagtcgtgaccgaagctgcgccggcgnnagcgnaggtgcctggncgcgccggagctgaagcccgagcccaggatgagaagaaaggtgacgaggcggagctcaccgccatgacccgggggtgggaacccggtcgtccaagaggaaaacaactgggggggaaacctgcccaacccggaaaaaaaggggctcacacatttaaagaattggttcgttgtgcccctccccccccgggggttaaaattgcttccccccccccccccccccaaaggcccaggaaaaaaaaggggggaaacccaaggcccccggggggttgggaacccccccgttaagggagcaaaaaaaaagggggcccccccccccaaaagacacaa

SEQ ID NO: 18643 - DNA, 667 bp, Zea mays
  misc_feature: Ceres CLONE 1385087-F
  misc_feature: Encodes the peptide sequence at SEQ ID NO. 18644
  misc_feature (437)..(437): n is a, c, t, g, unknown, or other
  misc_feature (465)..(465): n is a, c, t, g, unknown, or other
  misc_feature (466)..(466): n is a, c, t, g, unknown, or other
  misc_feature (498)..(498): n is a, c, t, g, unknown, or other
gcggtggcggccgctctagaactagtggatcccccgggctgcaggaattcgcacgagaccattacctagaacatcctaatcgaaaaaagagataaagaaaataaaacttcacaagacagaacacagagagagagagatgagccgttgctgctctcttgggctctgtgccccgaatgcgttgtctctttcttcaacccctcgcagtgtcaaagctcctctctctattacatctcacaccaaacccatctctaacaccgattctcttcttcataatattgccaagatgagagcaaaggctggtgacttctttggagcaaagaagacaatctttgcagctcaactcgggacagttcttgccacgattgatcacccggccttggcaataactggagtcaaccacgagcaggaactggagcagcgtcgtgctcgatatcagnaatcataatcggtctggtacttctaaanntaatgccaccaattatcatgaactggctgagnagtaaatgggaccacgaaaggaagttcttcgagatgtatctacaggttcatgggccgtctttcatgtttcttccccggggctacttctatgggcaccatttctcaatttcagaagtttcccaagagatcgggtctatgaagtatccttgggacaaaccaaaagaccctt

SEQ ID NO: 18644 - protein, 102 aa, Zea mays
  misc_feature: Ceres CLONE 1385087-F
  misc_feature (101)..(101): Xaa is any aa, unknown, or other
MSRCCSLGLCAPNALSLSSTPRSVKAPLSITSHTKPISNTDSLLHNIAKMRAKAGDFFGAKKTIFAAQLGTVLATIDHPALAITGVNHEQELEQRRARYQXS

SEQ ID NO: 18645 - DNA, 554 bp, Zea mays
  misc_feature: Ceres CLONE 1385089-F
  misc_feature: Encodes the peptide sequence at SEQ ID NO. 18646
  misc_feature (208)..(208): n is a, c, t, g, unknown, or other
  misc_feature (217)..(217): n is a, c, t, g, unknown, or other
  misc_feature (218)..(218): n is a, c, t, g, unknown, or other
tccccgcggtggcggccgctctagaactagtggatcccccgggctgcaggaattcgcacgagaccattacctagaacatcctaatcgaaaagcgcattgtggctcctcacttctgcgccgccacccactacaggtaaggaagaggaggagggcaggatgtcgcaccgtaagttcgagcacccgaggcacggctccctcggcttccttnccaggaagnngctccctccccgccacgcgggaaggtgagtcatttccagggatgacccaagaagcctggcatttcacggctttcttggtaacaggttggatgactaaattggcccggggggtggaaaccccggatccaattcctaaaagggaattgggggggggttacctcattgaaaccccccctttgcattggggggccgggggaaatgggaaaaacccggggggcccgaaaacaaaatttggggggggcccacttttggggagaggggggggggggggttcccaaaaggggggggaaaaaaaaaaaaaaggttctcaaagagagggcccccaaaaagagaggg

SEQ ID NO: 18646 - protein, 29 aa, Zea mays
  misc_feature: Ceres CLONE 1385089-F
  misc_feature (18)..(18): Xaa is any aa, unknown, or other
  misc_feature (21)..(21): Xaa is any aa, unknown, or other
MSHRKFEHPRHGSLGFLXRKXLPPRHAGR

SEQ ID NO: 18647 - DNA, 625 bp, Zea mays
  misc_feature: Ceres CLONE 1385098-F
  misc_feature: Encodes the peptide sequence at SEQ ID NO. 18648
  misc_feature (425)..(425): n is a, c, t, g, unknown, or other
  misc_feature (498)..(498): n is a, c, t, g, unknown, or other
tccccgcggtggcggccgctctagaactagtggatcccccgggctgcaggaattcgcacgagaccattacctagaacatcctaatcgaaaaacaaacacctccgatccgtccccgatcatcgcaccacctgtagcccacctcgctctcgagtctcgacccagcgacgagatggccgcggtggatctgaccccaaggacgcccaagaaggcctacggcggcgacggcggcgcctactacgagtggagccccgccgacctgcctatgctcgccgtcgcctccatcggcgccgccaagctctcgctcgccgccggcggcctctccctccccagctactccgactccgccaaggtcgcctacgtcctacaaggcgtcggtacctgcggcctcgtcctccccgaggcgacgaaggagaaggtggtggcgntgaaggagggcgacgcgctggcgctgcccttcggcgcggtgacgtggtggcacaacggccccgccgcgcaggncgacctcacggtgctcttcctcggcgacaccctccaaggccacaagcggggggcaggttcaccaacttccaagcttccgggggggcccgcgggggtatttttccgggggccgggccccccagggggc

SEQ ID NO: 18648 - protein, 152 aa, Zea mays
  misc_feature: Ceres CLONE 1385098-F
  misc_feature (6)..(133): Pfam Name: Cupin_1 Pfam Description: Cupin
  misc_feature (86)..(86): Xaa is any aa, unknown, or other
  misc_feature (110)..(110): Xaa is any aa, unknown, or other
MAAVDLTPRTPKKAYGGDGGAYYEWSPADLPMLAVASIGAAKLSLAAGGLSLPSYSDSAKVAYVLQGVGTCGLVLPEATKEKVVAXKEGDALALPFGAVTWWHNGPAAQXDLTVLFLGDTLQGHKRGAGSPTSKLPGGPAGVFFRGPGPPGG

SEQ ID NO: 18649 - DNA, 653 bp, Zea mays
  misc_feature: Ceres CLONE 1385101-F
  misc_feature: Encodes the peptide sequence at SEQ ID NO. 18650
  misc_feature (333)..(333): n is a, c, t, g, unknown, or other
  misc_feature (358)..(358): n is a, c, t, g, unknown, or other
  misc_feature (383)..(383): n is a, c, t, g, unknown, or other
  misc_feature (384)..(384): n is a, c, t, g, unknown, or other
  misc_feature (402)..(402): n is a, c, t, g, unknown, or other
  misc_feature (433)..(433): n is a, c, t, g, unknown, or other
cgctctagaactagtggatcccccgggctgcaggaattcgcacgagaccattacctagaacatcctaatcgaaaactctgtctctctagggtttttgattttagccgccgccgctgctcatctcacatccctcgagaagacgcctgctactcgccgatcgatacgatggccgtcttctccgacctccacaccgccgacggcctcaagtccctcgaggctcacctcgccggcaaaacctatgtgtctggtgacgccattagtaaggatgacattaaggtcttcgccgcggtgccgtcgaagcctggcgctgagtttcctaatgccgcccgctgntacgagaccgtctctgcggctgtanccctcagattcctgggtaaggctgnntggtgtaatctgcctgcnggatcagctcctggcgcagctgctcctgcgnatgaggctgaagaatgatgaatgaccttgaattctttttggggaggaacctgagagggacaagaaggcacttgattgacggggccgccctttgccaaggctcttcaaaaaaaaaaggaagggggaaaacccccggccctttggggggccaacccggggccctggaactggattaaaaaatttgggggggtgttccccagggccaaaagggggggttctat

SEQ ID NO: 18650 - protein, 94 aa, Zea mays
  misc_feature: Ceres CLONE 1385101-F
  misc_feature (56)..(56): Xaa is any aa, unknown, or other
  misc_feature (65)..(65): Xaa is any aa, unknown, or other
  misc_feature (73)..(73): Xaa is any aa, unknown, or other
  misc_feature (90)..(90): Xaa is any aa, unknown, or other
MAVFSDLHTADGLKSLEAHLAGKTYVSGDAISKDDIKVFAAVPSKPGAEFPNAARXYETVSAAVXLRFLGKAXWCNLPAGSAPGAAAPAXEAEE

SEQ ID NO: 18651 - DNA, 636 bp, Zea mays
  misc_feature: Ceres CLONE 1385102-F
  misc_feature: Translation starting site: 77
  misc_feature (478)..(478): n is a, c, t, g, unknown, or other
gctctagtactagtggatcccccgggctgcaggaattcgcacgagaccattacctagaacatcctaatcgaaaactatgactggtgaaagtggaatcagtaccgtgctagacagcaccagaaatactctgagcagtagtggctgtgatagcatttccaaccagatcactgcccctactgaatcatccaatgtatataaggatgttcctgaaaccccaagcgccgaagggtcacggcatctgagccagcgtgaggctgcactgaacaagttccggctaaagaggaaggataggtgcttttgagaagaaggttcgataccagagccggaaattactcgcagagcagcgtccacgggtcaaggggccagtttgttcgtcaagatcatagcatccaaggaagctagggtccagttactgagctggaactctattctattatctaaaaaagtcactgcaagtgactccactgcggtctgcggntatcctgatgtcagattttgtcgaatagttggaagcagtcacactgagttacaggttgctctgtatatttggctgaagcttgaccatatgtatgtataccctccgctgtcctttcctagctaagcgcacggacctggcccgtttgacgcccatcccca

SEQ ID NO: 18652 - DNA, 719 bp, Zea mays
  misc_feature: Ceres CLONE 1385103-F
  misc_feature: Encodes the peptide sequence at SEQ ID NO. 18653
  misc_feature (532)..(532): n is a, c, t, g, unknown, or other
tggagctccccgcggtggcggccgctctagaactagtggatcccccgggctgcaggaattcgcacgagaccattacctagaacatcctaatcgaaaaaagatccaccaccccaccaaccaactactctcacagtctcacctcccgctcctgccccctccctctcgttctcttcctaaatggcggacgagtccgccaggccgccctcgccgccgcgcgactccggctgccccgcgggcgcgggagactccaccagctcccagctgaccgcgacctacctcggcgtcagcttcgcgctcttcctcgccacgctcccgtcgggcaccgcggcgcgccacgtggcctcgctccagtcgcggggccgcctcctcgcctcgcgcctgctggacgccgaggaccagctgcggcagctgcgcgcgcgccgccgcgaggacgcccgcgccaacgcccgcgccgacgagatcttctcgggccaccgcgccgcctgaatggaggccagagcgcgcctgcaggcccgcgaccgctgcgtcgcgnatgaggtcgactccctacgagcgaacctcgccgactgcgaggacgactccgctgcgctgcacgcccgcaccaatcgactcgagagcgaggccaccaagcggtatgagctgatcgcgtgctcctcttggccacataagaggacgaaaatcatgatggggaccgcttaccatttgcaggaggaaatatg

SEQ ID NO: 18653 - protein, 102 aa, Zea mays
  misc_feature: Ceres CLONE 1385103-F
MADESARPPSPPRDSGCPAGAGDSTSSQLTATYLGVSFALFLATLPSGTAARHVASLQSRGRLLASRLLDAEDQLRQLRARRREDARANARADEIFSGHRAA

SEQ ID NO: 18654 - DNA, 720 bp, Zea mays
  misc_feature: Ceres CLONE 1385106-F
  misc_feature: Encodes the peptide sequence at SEQ ID NO. 18655
  misc_feature (720)..(720): n is a, c, t, g, unknown, or other
aagctggagctccccgcggtggcggccgctctagaactagtggatcccccgggctgcaggaattcgcacgagaccattacctagaacatcctaatcgaaaatcatgcagcagcgaacaacacaaattaagtagtggagtgtcagaacttgggaggcacaaattaagtacaaagcagtctaattaatgacgggcccgatggagattccggtgatcgatctcggcggcctcaacggcggcggcgaggagaggtcgcggaccttggcggagctccacgacgcctgcaaggactggggcttcttctgggtggagaaccacggcgtggacgcgccgctgatggacgaggtcaagcgcttcgtctacggccactacgaggagcacctggaggccaagttctacgcctccgccctcgccatggacctcgaggccgccaccagaggtgacactgatgagaagccctccgacgagggtggactgggagtccacctacttcatccagcaccaccccaagaccaacgtcgccgacttcccagagatcacgccgccgacacgagagacgctggacgcgtacgtcgccgcagatggtgtccctcgcggagcgtctggccgagtgcatgagcctcaacctggccctccccggggcccacgtcgccgccttttcgcggcccgccggtcggtgggcaccaaggtcggcatgtacccgtctgccgcgccccgggaan

SEQ ID NO: 18655 - protein, 139 aa, Zea mays
  misc_feature: Ceres CLONE 1385106-F
  misc_feature: SWISSPROT Homolog: EC 1.14.17.4 Aminocyclopropanecarboxylate oxidase
MEIPVIDLGGLNGGGEERSRTLAELHDACKDWGFFWVENHGVDAPLMDEVKRFVYGHYEEHLEAKFYASALAMDLEAATRGDTDEKPSDEGGLGVHLLHPAPPQDQRRRLPRDHAADTRDAGRVRRRRWCPSRSVWPSA

SEQ ID NO: 18656 - DNA, 732 bp, Zea mays
  misc_feature: Ceres CLONE 1385110-F
  misc_feature: Encodes the peptide sequence at SEQ ID NO. 18657
  misc_feature (552)..(552): n is a, c, t, g, unknown, or other
  misc_feature (691)..(691): n is a, c, t, g, unknown, or other
tggagctccccgcggtggcggccgctctagaactagtggatcccccgggctgcaggaattcgcacgagaccattacctagaacatcctaatcgaaaactccactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcaccggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaaaaggcggcggaagccgtcggcgacaaggccccgcagatcgacgtcacgcagttcggctacttcaaggtgctcggggaagggggtgctgccgcccaagcccatcgtcgtcaaggccaagctcatctccaaggntcgccgagaagaagatcaaagccgcccgcgggcgccgtcgtgctccccgccctaagtttcagtccttattcgccctctttgggttttgagatctatatcttggactagcaggtgctttcttgtctcacctaattgtggntaagaagaacgtagtttttaaatcccatggctcccttccgg

SEQ ID NO: 18657 - protein, 164 aa, Zea mays
  misc_feature: Ceres CLONE 1385110-F
MTTRFKKNRKKRGHVSAGHGRIGKHRKHPGGRGNAGGMHHHRILFDKYHPGYFGKVGMRYFHKLRNKFYCPAVNIERLWSMVPAEKAAEAVGDKAPQIDVTQFGYFKVLGEGGAAAQAHRRQGQAHLQGSPRRRSKPPAGAVVLPALSFSPYSPSLGFEIYILD

SEQ ID NO: 18658 - DNA, 731 bp, Zea mays
  misc_feature: Ceres CLONE 1385111-F
  misc_feature: Encodes the peptide sequence at SEQ ID NO. 18659
  misc_feature (590)..(590): n is a, c, t, g, unknown, or other
  misc_feature (616)..(616): n is a, c, t, g, unknown, or other
ggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggtgagggggaatcggggaaggaggaggtgagggagtatgagagcgacatgaggaagctggaggagctgctttctaagctgaacccctccggcggaggagttcgtgccgcagtcccgccgccgcgtggacggcggcgctccccgcctttcggccgacgcgcccgtgttcgtgtcgccggcgatcgactactacgcgcgccaccaccagctcccgccgccgcagcttctgcagcagcagcagccgatgcacntggttgcagtttgtggctgccgtcgncgggtttggaatgggtgccgcccgggggaaggacttccagcagcgccgaatccgcattggtcacccgatcgacggaaaagaaagggttcctcagagcaggaaaagccggaacctg

SEQ ID NO: 18659 - protein, 165 aa, Zea mays
  misc_feature: Ceres CLONE 1385111-F
  misc_feature (119)..(119): Xaa is any aa, unknown, or other
  misc_feature (128)..(128): Xaa is any aa, unknown, or other
MVAVAVDGLIRGADAVPAAEREAVRAAAAEAAAKGGEGESGKEEVREYESDMRKLEELLSKLNPSGGGVRAAVPPPRGRRRSPPFGRRARVRVAGDRLLRAPPPAPAAAASAAAAADAXGCSLWLPSXGLEWVPPGGRTSSSAESALVTRSTEKKGFLRAGKAGT

SEQ ID NO: 18660 - DNA, 738 bp, Zea mays
  misc_feature: Ceres CLONE 1385115-F
  misc_feature: Encodes the peptide sequence at SEQ ID NO. 18661
  misc_feature (649)..(649): n is a, c, t, g, unknown, or other
  misc_feature (655)..(655): n is a, c, t, g, unknown, or other
  misc_feature (657)..(657): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (704)..(704): n is a, c, t, g, unknown, or other
tggagctccccgcggtggcggccgctctagaactagtggatcccccgggctgcaggaattcgcacgagaccattacctagaacatcctaatcgaaaaaacttcttttctattctcctccccagccgccattcacatccggccgccaggaagcaccggcgcctggacgacggcgagcctctcttttcccttctctgtcttctgttttcgttctatcagctgcgcagaacttcagccgccaaggaactctggttcttggccgaccgcgcgctgcttcttcctctctgttttttttttctttgccgcgctcgtccggccgcaaggaggctcctagctgaccgcgacgtggttatcctgaccgagcggttccctggctgaccgagtgatctctctgttcttctttttcttaaaaaaatgagcatggccgaccgcacttgttgctctaattatgtcttttctttctttccctgtctttggtttttgtgcgttctctagcatctggccactagttcactggagcacatgcagttcattcgttacaccactggccatacagcataatgcctcacggtctctctcctttttttttttgcatcacttgaactcagcgaaaaaataccgtgtggctcatggggccgttttctggttacncttatnanaaaannnnnaaaaaaggaaaaaaaaaaaaaaaagcttatcgaaccgncccaacaccccggaaggggggggccccggtaccc

SEQ ID NO: 18661 - protein, 97 aa, Zea mays
  misc_feature: Ceres CLONE 1385115-F
  misc_feature (68)..(68): Xaa is any aa, unknown, or other
  misc_feature (70)..(70): Xaa is any aa, unknown, or other
  misc_feature (71)..(71): Xaa is any aa, unknown, or other
  misc_feature (72)..(72): Xaa is any aa, unknown, or other
  misc_feature (73)..(73): Xaa is any aa, unknown, or other
  misc_feature (74)..(74): Xaa is any aa, unknown, or other
MSFLSFPVFGFCAFSSIWPLVHWSTCSSFVTPLAIQHNASRSLSFFFLHHLNSAKKYRVAHGAVFWLXLXXXXXKRKKKKKSLSNRPNTPEGGGPGT

SEQ ID NO: 18662 - DNA, 733 bp, Zea mays
  misc_feature: Ceres CLONE 1385123-F
  misc_feature: Encodes the peptide sequence at SEQ ID NO. 18663
  misc_feature (634)..(634): n is a, c, t, g, unknown, or other
  misc_feature (638)..(638): n is a, c, t, g, unknown, or other
  misc_feature (641)..(641): n is a, c, t, g, unknown, or other
  misc_feature (656)..(656): n is a, c, t, g, unknown, or other
tggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgaggactggcacctaccgccagctcttccaccctgagcagctcatcagtgggaaggaggatgcagccaacaactttgcccgtggtcactacaccattggcaaggagattgttgacctatgccttgatcgcatcaggaagcttgcccgacactgcactggtctccagggcttcctcgtctttcacgctgntggntgnagaacgggctctggncttgggtccctctccctagagcgctgtctggtgactacgcagaagccaagcttgggtcactgtgtaccctcccccaa

SEQ ID NO: 18663 - protein, 173 aa, Zea mays
  misc_feature: Ceres CLONE 1385123-F
  misc_feature (49)..(172): Pfam Name: Tubulin Pfam Description: Tubulin/FtsZ family, GTPase domain
  misc_feature (141)..(141): Xaa is any aa, unknown, or other
  misc_feature (143)..(143): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLARHCTGLQGFLVFHAXGXRTGSGLGSLSLERCLVTTQKPSLGHCVPSP

SEQ ID NO: 18664 - DNA, 712 bp, Zea mays
  misc_feature: Ceres CLONE 1385127-F
  misc_feature: Translation starting site: 216
  misc_feature: SWISSPROT Homolog: EC 2.4.1.207 Xyloglucan:xyloglucosyl transferase
  misc_feature (501)..(501): n is a, c, t, g, unknown, or other
  misc_feature (511)..(511): n is a, c, t, g, unknown, or other
  misc_feature (661)..(661): n is a, c, t, g, unknown, or other
tccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcgggcgcgggctggacctgacgctggaccgcacgtccggctcccgggttccagtccaagagcgagtacctgttcggcaagatcgacatgcagatcaagctggtggcaggcaactcccgtggcacggtcaccacccttctacctgtcgtcccnaggcgacggncacgacgagatcggacttcgagttcctgggcaacgcggagcggggagccctacacgctgcacaccaacgtgttcacgcgcggacagggccagggggaagcagcagttcccgcctctggttcgaccctaccactgcctttcacacctactncaatcttgtggaccccgcagccgtgtattcttcccggggaagggacccccg

SEQ ID NO: 18665 - DNA, 735 bp, Zea mays
  misc_feature: Ceres CLONE 1385129-F
  misc_feature: Translation starting site: 216
  misc_feature: SWISSPROT Homolog: EC 2.4.1.207 Xyloglucan:xyloglucosyl transferase
  misc_feature (421)..(421): n is a, c, t, g, unknown, or other
  misc_feature (602)..(602): n is a, c, t, g, unknown, or other
tccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcgggcgcgggctggaactgacgctggaccgcacgtccggctccgggttccagtccaagagcgagtacctggntcggcagatcgacatgcagatcaggctggtgccaggcaactccgtggcacggtcaccaccttctacctgtcgttccagggcgacgcgcacgacgagatcggacttccagtccttgggcacgggagcggggagccctaaccgctgcacccaacgggttcccgccggaacaggccagcggaancaacattcccccctctggtttgaactaacctgtgcttccaaactattcctttcgggggaccccaagcggggttctttccgggggacggaaccccggggggggattaaaaacccggaggggggggggggggcgc

SEQ ID NO: 18666 - DNA, 715 bp, Zea mays
  misc_feature: Ceres CLONE 1385130-F
  misc_feature: Encodes the peptide sequence at SEQ ID NO. 18667
  misc_feature (417)..(417): n is a, c, t, g, unknown, or other
  misc_feature (572)..(572): n is a, c, t, g, unknown, or other
aagctggagctccccgcggtggcggccgctctagaactagtggatcccccgggctgcaggaattcgcacgagaccattacctagaacatcctaatcgaaaactaacacttttcccgtctcccccttcctcgccgcctccactacagggctttgctcctcccaactctcgaaaccctacccacgcgatgagagatcgatcggtcgagcgcgaattccccagccgcgagcggggggatcggccgccgcccggggtgctgggtcccccgcgccgcgggccggcttacaagacgaagttgtgcgcgctgtggcagcgcggcggctgttcccgcgacacatgcagcttcgcgcacggacacgccgagctccgccggttccccggatcgcgcacctcgttcccaccccgcgccgggagaaagnattatagaggtggtgactttagagataggtttgataggaggcgctcacctcataggaggcattcccctgatggagattccaggggcatcgctcccttcgtgaccgacgaccaattcccaggaaagggatctagctattccggctcccagtagaangagtgaaatgagcatgataagagcctgatgatggagaactactcatctaggagtctcagtgctctgacaatatgatgatgaaaaaggagccctggtaagggtgattgaaaagggacccgaaatcggctcaaccaatagacggg

SEQ ID NO: 18667 - protein, 127 aa, Zea mays
  misc_feature: Ceres CLONE 1385130-F
  misc_feature (33)..(57): Pfam Name: zf-CCCH Pfam Description: Zinc finger C-x8-C-x5-C-x3-H type (and similar)
  misc_feature (78)..(78): Xaa is any aa, unknown, or other
MRDRSVEREFPSRERGDRPPPGVLGPPRRGPAYKTKLCALWQRGGCSRDTCSFAHGHAELRRFPGSRTSFPPRAGRKXYRGGDFRDRFDRRRSPHRRHSPDGDSRGIAPFVTDDQFPGKGSSYSGSQ

SEQ ID NO: 18668 - DNA, 691 bp, Zea mays
  misc_feature: Ceres CLONE 1385131-F
  misc_feature: Translation starting site: 240
  misc_feature: SWISSPROT Homolog: EC 6.3.2.19 Ubiquitin--protein ligase
  misc_feature (601)..(601): n is a, c, t, g, unknown, or other
tggagctccccgcggtggcggccgctctagaactagtggatcccccgggctgcaggaattcgcacgagaccattacctagaacatcctaatcgaaaagaaacccgtctcgcaccacaagcgagcgagggacccggggcggaagaagagagagaagacgtctctctcctctcggcgtccccgttccccaacctctcgtctgctgcctgcctgcctgcctgcctgcaaaaaggagtttgtcatggcgtctaagcgcatcctcaaggagctgaaggacctgcagaaggacccccccacatcatgcagtgcaggtcctgctggtgaggacatgtttcattggcaagcaacaattatgggaccacctgacagtccctatgctgggtggtgtttttttagtgaacattcatttcccgccagattaccccttcaaacctccaaaggtttctttcaagacaaaggtcttccatcctaatatcacaggcaatgggaagtatatgccttgacattctcaaagagcagtggagccctgctttgcaaattttctaaggtcctgctctccatctgctccctgctgacgaccccaacccgaacgacttcttgggncccgggagattgccacatgtacaagacgaaccggccgagtaaccgagcgaggtccccaacttgggacgaaaaaataccccgaggggttga

SEQ ID NO: 18669 - DNA, 746 bp, Zea mays
  misc_feature: Ceres CLONE 1385132-F
  misc_feature: Encodes the peptide sequence at SEQ ID NO. 18670
  misc_feature (542)..(542): n is a, c, t, g, unknown, or other
  misc_feature (587)..(587): n is a, c, t, g, unknown, or other
  misc_feature (593)..(593): n is a, c, t, g, unknown, or other
  misc_feature (654)..(654): n is a, c, t, g, unknown, or other
  misc_feature (678)..(678): n is a, c, t, g, unknown, or other
  misc_feature (679)..(679): n is a, c, t, g, unknown, or other
  misc_feature (691)..(691): n is a, c, t, g, unknown, or other
  misc_feature (692)..(692): n is a, c, t, g, unknown, or other
  misc_feature (707)..(707): n is a, c, t, g, unknown, or other
tggagctccccgcggtggcggccgctctagaactagtggatcccccgggctgcaggaattcgcacgagaccattacctagaacatcctaatcgaaaaatcacactcgcgaaccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtgggggttcggttggtgctgaatatgttgttgagtctactggtgttttcactgaccaggagaaggctgcagctcactttgaagggtggtgccaagaaggntgtcatctctgctcctagcaagatgcccccagggttggtcgttgntgtcancgagaaagagtacaagtctgacattaacattgtctcccatgctagctgcacaaccactgcnttgctccctcttgtaagcaatcannggacagtttcgnnaaacggtgaaagggncatgatgaccactggtcatgccatcatgctaccaagaaa

SEQ ID NO: 18670 - protein, 94 aa, Zea mays
  misc_feature: Ceres CLONE 1385132-F
  misc_feature (4)..(94): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLVARVALQSDDVELVAVNDPFISTDYMTYMFKYDTVHGQWKHHEVKVKDSKTLLFGEKEVAVFGCRNPEEIPWGFGWC

SEQ ID NO: 18671 - DNA, 706 bp, Zea mays
  misc_feature: Ceres CLONE 1385133-F
  misc_feature: Encodes the peptide sequence at SEQ ID NO. 18672
  misc_feature (430)..(430): n is a, c, t, g, unknown, or other
  misc_feature (644)..(644): n is a, c, t, g, unknown, or other
  misc_feature (656)..(656): n is a, c, t, g, unknown, or other
tccccgcggtggcggccgctctagaactagtggatcccccgggctgcaggaattcgcacgagaccattacctagaacatcctaatccaaaaatccgccttcgcctccaaccgcgtgcgctccacgcctcctccaggaaagcgagagcttctgcataagaacaacaaatcaaaagcttgatcagctcggtgcctacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaaagaggaattctgctgncatggtactgtagttcaggacccagagctaggccaggtcattcagctccaaggtgaccagcgcaagaatgttgctacttttctaagtcaaggctgggattgcgaagaaagaggacatcaagaattcacgggttctaggggacctgtaaatgcttgtgcccctatatgtgtgcctcacatattgggggagcttgaagcatcgacaggtacttagncatggcttactnattatagaacataagtaggatttgctattggccagggggcctgcttggaa

SEQ ID NO: 18672 - protein, 141 aa, Zea mays
  misc_feature: Ceres CLONE 1385133-F
  misc_feature (27)..(108): Pfam Name: SUI1 Pfam Description: Translation initiation factor SUI1
  misc_feature (71)..(71): Xaa is any aa, unknown, or other
MSDLDVQLPSAFDPFAEANAEDSGAGPGTKDYVHVRIQQRNGRKSLTTVQGLKKEFSYNKILKDLKEEFCXHGTVVQDPELGQVIQLQGDQRKNVATFLSQGWDCEERGHQEFTGSRGPVNACAPICVPHILGELEASTGT

SEQ ID NO: 18673 - DNA, 717 bp, Zea mays
  misc_feature: Ceres CLONE 1385137-F
  misc_feature: Translation starting site: 272
  misc_feature (301)..(301): n is a, c, t, g, unknown, or other
  misc_feature (558)..(558): n is a, c, t, g, unknown, or other
tccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccanaatggttctgtgtatgtctgcaatctacctcctggaactgatgaaaatatgttggctgaatattttgcaccataggcttggctaaaagggtatggtcttaccagaaagacaaagggactgggcgtccaaaaatttggatatacagggacaaagttactaatgaaccaaaaggttgatgcaacagtcaccctatgaggatccacatgctgcttcagctgcctgtggaatggttcgataacaaggatttccatgggagnaactattcaggttcacatagctgagtcaaaaagcaaggatgcattcgatacccccacagtttgaacatcatttgggggggggttggggaaccagatggaatggaataatggagcagcaaaggcaaagggcgtggtgatgtccaaggcaagcttggcaga

SEQ ID NO: 18674 - DNA, 710 bp, Zea mays
  misc_feature: Ceres CLONE 1385139-F
  misc_feature: Encodes the peptide sequence at SEQ ID NO. 18675
tggagctccccgcggtggcggccgctctagaactagtggatcccccgggctgcaggaattcgcacgagaccattacctagaacatcctaatcgaaaactcttttccgccctccacccctcgcgagctctccacccctccacacgaccctcctcggcggcggcggcggcgatgcagatggcggcgaccaccaccgagtcccaggcggccgtgccgcctcaacaccctcacgcccacccccacgcgcccccgcagcatgctcacccgcaccaccacatgccgcagccacggtgggtcgtcatcccgtacccgccgccgccgcccatggtggccgcgccaccaccgccgccgcagtttgccaagcacttcgctgctgggccgcccccgccgccccaagctggtgctgggcgccgcacgccgaccccgccctcgtctggatccggcgggaacgggtgcgaagaaaataaaaccatttgggtcggtgacctccagtactggatggatgaaaactacctacataactgcttcgggcccagcgggggagtggttacaataaaaagtatccgcaataggcaaacaggacagtcagagggggtatggattttgttgaggtcttttccccatgcatcagcaaaaaaagctcttcaaaaatttaccgggcatgggaaggcaaacctgggccggccttttaaattgaactgggcatcgaaaa

SEQ ID NO: 18675 - protein, 180 aa, Zea mays
  misc_feature: Ceres CLONE 1385139-F
MQMAATTTESQAAVPPQHPHAHPHAPPQHAHPHHHMPQPRWVVIPYPPPPPMVAAPPPPPQFAKHFAAGPPPPPQAGAGRRTPTPPSSGSGGNGCEENKTIWVGDLQYWMDENYLHNCFGPSGGVVTIKSIRNRQTGQSEGVWILLRSFPHASAKKALQKFTGHGKANLGRPFKLNWASK

SEQ ID NO: 18676 - DNA, 747 bp, Zea mays
  misc_feature: Ceres CLONE 1385149-R
  misc_feature (21)..(21): n is a, c, t, g, unknown, or other
ttcttcttctttttctttctntccattcccccccccccccaccccaagaaagaaatacaaatgggtacgggccccccctcgaggtcgacagtatcgataagcttttttttttttttttttactgtaagctattcatatttgaccaagaaataacaaaaatattgtaggccctccctacagtaacttaacttaaaaaaaattacgtcgtcccttaagttgacaaagtattaacacaactagaatgcaattttttttgatatggcactacgtttttcagtcatctgataagttcagtatgatccctgttttccatgtaggcgtgatatttttcatacaacaatatgagcttaatcaattctaaggatttaaatggggcctagtaaagttccaagattgcgatcaaaagctgcatctgcaagtgctgtaggacaaagtattaacccgactagaatgtacacttcttgatatggctctcaacgtttttcagccatctgataagttcagtgagctccttgttttccatgtaagcgtacaaaaatgcagcaaggtcatcattcactcctatattctccagagagacttggacagaactttgcagtttcctcaccccaactcatagttcattaatactatcaagtccccaatataacaattttacggtgggctacgaaacattaagtcagagacaaccttttgtcaataagaccctataaaaaaaaagaagaaacctggcataaaaaacccgca

SEQ ID NO: 18677 - DNA, 732 bp, Zea mays
  misc_feature: Ceres CLONE 1385155-F
  misc_feature: Encodes the peptide sequence at SEQ ID NO. 18678
cgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatggcgggcgggttcgtcacctccggcggcctcggcgtcgctgcgctgtccgtgttctcctggatgtacaagtacctgacggggaagcacccgccgggggccgaccagctgggaccacgccaaggcgagggctggcggcccagggcccgcgaccttaagggatggggcacaggacccggatcgacccgggcgcaagggggccttggagagaagaacccacctgcgaaggggaccgcggggcggcgaacctcccttggaaccaattggccggggcgggggggaattaggg

SEQ ID NO: 18678 - protein, 187 aa, Zea mays
  misc_feature: Ceres CLONE 1385155-F
  misc_feature (36)..(147): Pfam Name: Oleosin Pfam Description: Oleosin
MADHHRGATGGGGGYGDLQRGGGMHGEAQQQQKQGAMMTALKAATAATFGGSMLVLSGLILAGTVIALTVATPVLVIFSPVLVPAAIALALMAGGFVTSGGLGVAALSVFSWMYKYLTGKHPPGADQLGPRQGEGWRPRARDLKGWGTGPGSTRAQGGLGEKNPPAKGTAGRRTSLGTNWPGRGGIR

SEQ ID NO: 18679 - DNA, 660 bp, Zea mays
  misc_feature: Ceres CLONE 1385157-F
  misc_feature: Encodes the peptide sequence at SEQ ID NO. 18680
tccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatccccaaagtagctctggcaaaacttttctccctactcccaggaaacaacaatttctccattcaaccactggcaaattgaaccgggctgttatttgcagaacaattattaccatttcgccggtaggtactgccaacccccaaaaaaaaaaatttcttccatttaacaatttggccccactgaaacccccttggtatt

SEQ ID NO: 18680 - protein, 127 aa, Zea mays
  misc_feature: Ceres CLONE 1385157-F
MATKIFSLLMLLALSACVANATIFPQCSQAPIASLLPPYLPSMIASVCENPALQPYRLQQAIAASNIPLSPLFQQSPALSLVQSLVQTIRAQQLQQLVLPVIPKVALAKLFSLLPGNNNFSIQPLAN

SEQ ID NO: 18681 - DNA, 818 bp, Zea mays
  misc_feature: Ceres CLONE 1385164-F
  misc_feature: Encodes the peptide sequence at SEQ ID NO. 18682
ggagctccccgcggtggcggccgctctagaactagtggatcccccgggctgcaggaattcgcacgagaccattacctagaacatcctaatcgaaaacttaaagcacgcgcgcgccctgtgctccccctcagtcctcgctagtcctttctccatcacaaacgctattcttttttccctaaagctcggagaccgccggaagcgagcgatggcgtgcaagacgaagagcctgctgttggcgctcagcgtggcggcgctgctcgcggagcagtcggactcccacggcctgggggacttcacgagcgggagcggcgaggcgacgacgacgccggagatgcagaccttcttcaagccccagggccattgcggcgctcccggaagaccctcagaagcctccatggcccgccaagcctggaggcggcccggcggagggtaactccccggccactaacaaggggaccggctcaggaggccctaatgacaaccgacctcgacaaggccagaggatccttgggcccgctccaaagggggccactgcgcacaaggcccggccccagggcccctggatccagagatcaacatgggaaccgggaggccctcccttgtggcggactccctggttcgccgtcacccccaccagaatgcgaagaagctccctctcccccccccccggggagacccacctactgcccaacggtcccgcccgcataaaaccccacccatcctacaagacgcggtcctactgtacgaaagagggctatggcctagaacctcatgaatagaggggaggtgtatctcacctccacggtgggttaggagtg

SEQ ID NO: 18682 - protein, 75 aa, Zea mays
  misc_feature: Ceres CLONE 1385164-F
MACKTKSLLLALSVAALLAEQSDSHGLGDFTSGSGEATTTPEMQTFFKPQGHCGAPGRPSEASMARQAWRRPGGG

SEQ ID NO: 18683 - DNA, 773 bp, Zea mays
  misc_feature: Ceres CLONE 1385167-F
  misc_feature: Encodes the peptide sequence at SEQ ID NO. 18684
  misc_feature (54)..(54): n is a, c, t, g, unknown, or other
ggcgggtggggaagcgtgtggtggggggggtggggaagacgcggtggccggggntccccgtcagggcgggggctctcgaacaatggatcccccggccctccggggtgcaggaggcgccccaccccattacttccaacctcctagtcgatgtgtctcacctcagggcggacagccctcgccccactggggagctctgcactctgagtagctccgagattcagcgccttcgttgcttgggccacccggtccagacacacgcaccagtacgtgcacctgcactgcaccaatggccggcggcgaggcccaggtcccgactgccgctcccggccaggacgtcgcccagttggccgacgcctccgccgtccagatcacgaacgaggagaccgctgctccgacagtggacaccgaggtcgtcgtcactaaggagccgttgccgcgcgaggccgagactgactcccaggaggtccaggtcgagggtgaggccgaggccgagaccgcagctgaggctgagccgaccgaggtagagcccgaggccgccttgcctggagcagagaccgtggccaaggaagcagagccggagggctgcttgcccgcagcaaggacggaggcctgcttctgccccgggcgaggctgcttgacccccagatagcccccgaggaccaaagagagggggtggcgcgacccttctacccaagacaagggcgacgtaggaagagccccgccgattgctggacaaccacccgcaggtcccctcggaccggggcggaaggaag

SEQ ID NO: 18684 - protein, 120 aa, Zea mays
  misc_feature: Ceres CLONE 1385167-F
MAGGEAQVPTAAPGQDVAQLADASAVQITNEETAAPTVDTEVVVTKEPLPREAETDSQEVQVEGEAEAETAAEAEPTEVEPEAALPGAETVAKEAEPEGCLPAARTEACFCPGRGCLTPR

SEQ ID NO: 18685 - DNA, 656 bp, Zea mays
  misc_feature: Ceres CLONE 1385169-F
  misc_feature: Encodes the peptide sequence at SEQ ID NO. 18686
tccccgcggtggcggccgctctagaactagtggatcccccgggctgcaggaattcgcacgagaccattacctagaacatcctaatcgaaaaatcaaatcttacagttatagcaatggacactccaagtggcactatcatcttcaccaccgttggtcgcactcactacggcttcgacgttttctctctccacatcgcctcctctgtcgaacgccgtttaacagacggagtttccgtcaacttcaacgctcagttcgctgacgacaacggtaacgatatcgtgttcgtttcggaacgagctggatctgcccggattttcagaacccgacccgggaattccaaacccgagcagcttcccggagctccggaaagcttcttccacgaccgtccaatcatcactcaagacaacactctctacttcatctccgctcacgagcagcctgatcgccatttcaagaactggacagcgctctactccgtgaacagccaagggaaagaagtgacacgtgtcactccaccagacaccgccgacttcagccccgcggtttctaaatcgggaaagtatttcgccgtggcgtcgtacggatctcgctcatggggcggcgagtttcacgagatcaactctgacatcgttgtcttcaaaccatctgagccggag

SEQ ID NO: 18686 - protein, 181 aa, Zea mays
  misc_feature: Ceres CLONE 1385169-F
MDTPSGTIIFTTVGRTHYGFDVFSLHIASSVERRLTDGVSVNFNAQFADDNGNDIVFVSERAGSARIFRTRPGNSKPEQLPGAPESFFHDRPIITQDNTLYFISAHEQPDRHFKNWTALYSVNSQGKEVTRVTPPDTADFSPAVSKSGKYFAVASYGSRSWGGEFHEINSDIVVFKPSEPE

SEQ ID NO: 18687 - DNA, 659 bp, Zea mays
  misc_feature: Ceres CLONE 1385172-F
  misc_feature: Encodes the peptide sequence at SEQ ID NO. 18688
  misc_feature (388)..(388): n is a, c, t, g, unknown, or other
tccccgcggtggcggccgctctagaactagtggatcccccgggctgcaggaattcgcacgagaccattacctagaacatcctaatcgaaaaatccgacactaggccaccaccagcgggcgggctccagtcgcaactcgcaacacagacgccgccgccgcccaaagaaagacgtcaactccaggagacaagatagtgagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattgggtcagggttcangtgatcaaaggatggggacgagggagttatgaccatggcaggtgggtgaagttgctcgtatccagtgcacggctggatatgcttatggagccggcgggttcccaggcctggggaattcaaccaactcagtgcgtgtggtccagattgaagtcctcagtggccaggaattcgcatctggcagctatggaaacgttggccatggctctcaaggtatggaataattcggtggccactcatggtactacaggagattggggtacgaggtaaatcc

SEQ ID NO: 18688 - protein, 58 aa, Zea mays
  misc_feature: Ceres CLONE 1385172-F
  misc_feature: SWISSPROT Homolog: EC 5.2.1.8 Peptidylprolyl isomerase
MGFEKQILRSGTGPKPIKGQKVTVHCTGYGKDRDLSKKFWSTKDPGQQPFSFSIGSGF

SEQ ID NO: 18689 - DNA, 702 bp, Zea mays
  misc_feature: Ceres CLONE 1385175-F
  misc_feature: Pfam Name: Lipase_3 Pfam Description: Lipase (class 3)
  misc_feature (629)..(629): n is a, c, t, g, unknown, or other
ggagctccccgcggtggcggccgctctagaactagtggatcccccgggctgcaggaattcgcacgagaacattacctagaacatcctaatcgaaaacataataaaacacagcggagtgtagaaaatgtgcaccaggagcagtttacaaacagcggttcttttttgtgctgaaccaccagtagttgagccgtgaaggaatggaaaaactttccacttgctcatttccgagcgccttctcattcattgtatgcatgttttggactcgtggctggacgtcttgcacacaggaatccaatcactggagttgcaagatactggtatgaaaaatccagactgctgttctcgtgatattttgttcggaatgttatacaacgttgaagattttgtccgtgaatgcgctggcgttcgcgagcccgcgcgtcgggggcggcaacttcaagagggcgctggcctcgttcccggacctgcaggcgctccacgtgaaaacgccgggaacatcgcgccgacgtacgtacccgccgctggggtacgtggccgtgcagctgcctatcgccacggggggacggggcggtcgccgcacctgcggcagcccgggacgatcgcgacgctgcagagcctcgggcgttggngacatggcgtggccgacgagcaggtcagcgccggagggttcagacatcaggcttggaggtggatcgcgacatc

SEQ ID NO: 18690 - DNA, 669 bp, Zea mays
  misc_feature: Ceres CLONE 1385177-F
  misc_feature: Encodes the peptide sequence at SEQ ID NO. 18691
  misc_feature (392)..(392): n is a, c, t, g, unknown, or other
  misc_feature (421)..(421): n is a, c, t, g, unknown, or other
  misc_feature (427)..(427): n is a, c, t, g, unknown, or other
  misc_feature (450)..(450): n is a, c, t, g, unknown, or other
  misc_feature (468)..(468): n is a, c, t, g, unknown, or other
tccccgcggtggcggccgctctagaactagtggatcccccgggctgcaggaattcgcacgagaccattacctagaacatcctaatcgaaaaaaccacatccagtccaccccatccccctcgaccccgacaaccccgagtcccgacccgatggcgcccaaggccgagaagaagccagcggagaagaagccggcggccgaggagaaggcggagaagacgaccgcaggcaagaagcccaagtccgagaagcgcctgcccgcctcgaagtcctccggcaaggagggcggcgagaagaaggggaagaagaaggccaagaagagcgtggagacctacaaaatctacatcttcaaggtcctaaagcaggtgcacccccgacattcggcatctccctccnagggccatgggtccatcatgacttctttncatcancgacattcttcgaagaagctcgnccgggcgagggccgcttnagcttcgcccgggtaacaacaagaaggcccaccaatctactttccggggggaatccaaaaacctcccggggggccttcgtcccttccccgggggagggtttccccaaaaaaacccccccgttttccgggggggaaaccaagggggggcgccccccagtgtttcccccccaaatttttttttgggcccccctccgcgccccc

SEQ ID NO: 18691 - protein, 111 aa, Zea mays
  misc_feature: Ceres CLONE 1385177-F
  misc_feature (82)..(82): Xaa is any aa, unknown, or other
  misc_feature (91)..(91): Xaa is any aa, unknown, or other
  misc_feature (93)..(93): Xaa is any aa, unknown, or other
  misc_feature (101)..(101): Xaa is any aa, unknown, or other
  misc_feature (107)..(107): Xaa is any aa, unknown, or other
MAPKAEKKPAEKKPAAEEKAEKTTAGKKPKSEKRLPASKSSGKEGGEKKGKKKAKKSVETYKIYIFKVLKQVHPRHSASPSXGHGSIMTSXHXRHSSKKLXRARAAXASPG

SEQ ID NO: 18692 - DNA, 674 bp, Zea mays
  misc_feature: Ceres CLONE 1385178-F
  misc_feature: Translation starting site: 196
  misc_feature (555)..(555): n is a, c, t, g, unknown, or other
  misc_feature (660)..(660): n is a, c, t, g, unknown, or other
tggagctccccgcggtggcggccgctctagaactagtggatcccccgggctgcaggaattcgcacgagaccattacctagaacatcctaatcgaaaactcgttgtcttggcggctgcggcggagcacggaggcgaaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgctttatgacaccaagggcccgcttccgtcttcacccaatcagggatgaggatgcccnagttcagctctggcaggtgaggtccgttcagtttggccagaagggcatcccctacccctgacactacgacggccgtaccatccgctaccccgacccgctcatcanggccaacgacacat

SEQ ID NO: 18693 - DNA, 724 bp, Zea mays
  misc_feature: Ceres CLONE 1385181-F
  misc_feature: Encodes the peptide sequence at SEQ ID NO. 18694
tccccgcggtggcggccgctctagaactagtggatcccccgggctgcaggaattcgcacgagaccattacctagaacatcctaatcgaaaaaacccagggtgagtctccggatccgtcgccgtctggtctccgtgtgctctcgtcgccgtcgccgtcgccgccgtctgactgaccccctcgcctcccgcggcgtcgggtctctggtgctgctgctactgctgctgcgtgcagggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaggaagttgagaagttggctgccgctttgccagaaggtggagttctgctcctagagaatgttagattctacaaggaggaagagaagaacgaacctgagtttgctaagaagctagcatctgttgctgacctttatgtcaatgatgcttttggcacggcacacagagctcatgcttcaacccgagg

SEQ ID NO: 18694 - protein, 161 aa, Zea mays
  misc_feature: Ceres CLONE 1385181-F
  misc_feature (3)..(161): Pfam Name: PGK Pfam Description: Phosphoglycerate kinase
  misc_feature: SWISSPROT Homolog: EC 2.7.2.3 Phosphoglycerate kinase
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTR

SEQ ID NO: 18695 - DNA, 675 bp, Zea mays
  misc_feature: Ceres CLONE 1385182-F
  misc_feature (485)..(485): n is a, c, t, g, unknown, or other
  misc_feature (501)..(501): n is a, c, t, g, unknown, or other
  misc_feature (607)..(607): n is a, c, t, g, unknown, or other
  misc_feature (626)..(626): n is a, c, t, g, unknown, or other
tggagctccccgcggtggcggccgctctagaactagtggatcccccgggctgcaggaattcgcacgagaccattacctagaacatcctaatcgaaaaattatctccctgactcgcctcgtcctccagatatcggccgccaccttcacctccaccgccccggcgcacctgtgcgtctccatcgtcgccgcctctcctccttcggacacgactgaccttccactggcgccaacgaagaaaacacataggaagaagctcaccgccaaacctcatccagatccagtcgctgccctccgaaggccgcatacggaacgtctcgtctcttcctttggatccggcggtcaactccatcacccccagcttcacctcccttagtccccctccgtccgctctcacccacccgcttctatatcgccacctctctcgttgtagaagaagacactgaggatctggctttctggaaatcacatttctgagaactatctgntggagaactaaactangctcttgtttcatatatggatcagcaagctaagattgatgctgattttcttgaaccactggtactctagatgagacacatacccaggagggtacaaaaatgctatnatgatggttggcaatcctnaaaggaaaaggggaggccaggtggtttaagatgggtttcccaggcgggg

SEQ ID NO: 18696 - DNA, 726 bp, Zea mays
  misc_feature: Ceres CLONE 1385184-F
  misc_feature: Encodes the peptide sequence at SEQ ID NO. 18697
  misc_feature (489)..(489): n is a, c, t, g, unknown, or other
  misc_feature (490)..(490): n is a, c, t, g, unknown, or other
  misc_feature (507)..(507): n is a, c, t, g, unknown, or other
  misc_feature (514)..(514): n is a, c, t, g, unknown, or other
  misc_feature (515)..(515): n is a, c, t, g, unknown, or other
  misc_feature (524)..(524): n is a, c, t, g, unknown, or other
tccccgcggtggcggccgctctagaactagtggatcccccgggctgcaggaattcgcacgagaccattacctagaacatcctaatcgaaaaactgccctggtcccccattcaattcttccaactccgccgcttcgcctcgttccgtccgccgcccccatggcgtccgccgccgccacgaccacctccgcccccgcccagaacctcaatccccttagtatcaacatcaagctccccccatggctcagcgggctgcgctgccccttcaccttcgtctgcccgcccccgcccccgcctccgccgccgccgccgcctcctcccccgctgccacctacggaacccgtggtcccacggtcgcggaggttaccaagcctgcgggtgaccacggagtacgatagcgaagagggcgtgtttgtgaacaaggtgtcgtgcaagcttgcgggggacctcgccaaactgcggctctccttccagagcgacccgcaggaggnnaaaaagggggggggggnaaaaaannggaacccgntaacggaggtcttcggcgcgccgatggtggggctcatcaccaagcgtttctccgtgctctacgacgtcgaggcacgcaacgcgctgctccgcggagactgctcgcttcccggaggcgccgtccagcttcgtgcctcgcatgatgtcaggcacaacaaagaaaaagttcggggatcaccagttttgggggatccatagtataa

SEQ ID NO: 18697 - protein, 187 aa, Zea mays
  misc_feature: Ceres CLONE 1385184-F
  misc_feature (111)..(111): Xaa is any aa, unknown, or other
  misc_feature (117)..(117): Xaa is any aa, unknown, or other
  misc_feature (119)..(119): Xaa is any aa, unknown, or other
  misc_feature (120)..(120): Xaa is any aa, unknown, or other
  misc_feature (123)..(123): Xaa is any aa, unknown, or other
MASAAATTTSAPAQNLNPLSINIKLPPWLSGLRCPFTFVCPPPPPPPPPPPPPPPLPPTEPVVPRSRRLPSLRVTTEYDSEEGVFVNKVSCKLAGDLAKLRLSFQSDPQEXKKGGGXKXXNPXTEVFGAPMVGLITKRFSVLYDVEARNALLRGDCSLPGGAVQLRASHDVRHNKEKVRGSPVLGDP

SEQ ID NO: 18698 - DNA, 746 bp, Zea mays
  misc_feature: Ceres CLONE 1385185-F
  misc_feature: Encodes the peptide sequence at SEQ ID NO. 18699
  misc_feature (255)..(255): n is a, c, t, g, unknown, or other
  misc_feature (338)..(338): n is a, c, t, g, unknown, or other
  misc_feature (412)..(412): n is a, c, t, g, unknown, or other
tggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctncaggcggcgttcgctgagttcatctccaccctcatcttcgtcttcgccggccagggctccggcatgggctttcagcagctgancggcggcggcccgacgaccccggcgggcctgatcgcggcgggcgtggcgcacgcgttcgcgctgttcgtggcgntggctggggccgcgaacatctccggggggcacgtggaccctggcggggacctccggggccttgggggcgggaacattaccctggttcgggggcttcctgaactgggtgggcccaattgctggggggcccccggggggggggtttccgggtcccttttttcaaggggggggaagggcccagggcccctttgggtttaaaggggtgttttttggggggaaagccctttgggtttaaaaaaccggaaaacccctccgggggggggaacccggggaaaccccccgggggggggacccacaaaaaaagggcccggggggcaaccctcccccctttgtcg

SEQ ID NO: 18699 - protein, 137 aa, Zea mays
  misc_feature: Ceres CLONE 1385185-F
  misc_feature (13)..(137): Pfam Name: MIP Pfam Description: Major intrinsic protein
  misc_feature (48)..(48): Xaa is any aa, unknown, or other
  misc_feature (73)..(73): Xaa is any aa, unknown, or other
MPINRIALGSHQEVYHPGALQAAFAEFISTLIFVFAGQGSGMGFQQLXGGGPTTPAGLIAAGVAHAFALFVAXAGAANISGGHVDPGGDLRGLGGGNITLVRGLPELGGPNCWGAPGGGVSGSLFSRGGKGPGPLWV

SEQ ID NO: 18700 - DNA, 677 bp, Zea mays
  misc_feature: Ceres CLONE 1385186-F
  misc_feature: Translation starting site: 231
  misc_feature: SWISSPROT Homolog: EC 1.2.4.1 Pyruvate dehydrogenase (acetyl-transferring)
  misc_feature (410)..(410): n is a, c, t, g, unknown, or other
  misc_feature (470)..(470): n is a, c, t, g, unknown, or other
  misc_feature (613)..(613): n is a, c, t, g, unknown, or other
  misc_feature (662)..(662): n is a, c, t, g, unknown, or other
aagctggagctccccgcggtggcggccgctctagaactagtggatcccccgggctgcaggaattcgcacgagaccattacctagaacatcctaatcgaaaactccaccagtccaccatcgccacctacgcccaaccaaacccaactccatctcttccgactataaacgcaacccaccaccgctgccgcgaacctctgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggncatgaggtcttgctgtttgaagctcttcgtgaggccttgatggaagagatggaatagatncaacagtgtgtggatttggtggagatgttggccattacggtggttcttacaaggtgacaaaagggttggctgatacgtttggagacctttcgagttctggacacccctatggcggagaactcgtttactggcatgggagttgnagcgggaatgaaaaggctgagggcccgtccttgaaggcatgaacatggnaattcctgctccttg

SEQ ID NO: 18701 - DNA, 768 bp, Zea mays
  misc_feature: Ceres CLONE 1385189-F
  misc_feature: Encodes the peptide sequence at SEQ ID NO. 18702
  misc_feature (651)..(651): n is a, c, t, g, unknown, or other
  misc_feature (669)..(669): n is a, c, t, g, unknown, or other
  misc_feature (670)..(670): n is a, c, t, g, unknown, or other
tggagctccccgcggtggcggccgctctagaactagtggatcccccgggctgcaggaattcgcacgagaccattacctagaacatcctaatcgaaaaacaaacacctccgatccgtccccgatcatcgcaccacctgtagcccacctcgctctcgagtctcgacccagcgacgagatggccgcggtggatctgaccccaaggacgcccaagaaggcctacggcggcgacggcggcgcctactacgagtggagccccgccgacctgcctatgctcgccgtcgcctccatcggagccgccaagctctcgctcgacgacgggggcctctccctcccagctactccgactccgggcagatcgtctacgtcctacaagcgtcggaacctggggcctcggcctcccgagggaataaagggaaggggggggcaggtaagaaggggaacggctgggctggccttccaagggggggagggggggaaaaaggccccccccgcggggggggggccccagggggttttccccgggaaacccccaagggcccacaggggggggggaagcccactttccccttcggaggggcccgcggcctctcccagaaatgtgccccccttttttttaaacaggggggtgtattctcggaacaccacaccccncgcggtgggtggaggaannccccgccccgagaaaaaaatattctcccccccaccccccagtttcaaaggggggggtggaaaacaagggggggggggggtggggcaccttaagggggg

SEQ ID NO: 18702 - protein, 197 aa, Zea mays
  misc_feature: Ceres CLONE 1385189-F
  misc_feature (159)..(159): Xaa is any aa, unknown, or other
  misc_feature (165)..(165): Xaa is any aa, unknown, or other
MAAVDLTPRTPKKAYGGDGGAYYEWSPADLPMLAVASIGAAKLSLDDGGLSLPATPTPGRSSTSYKRRNLGPRPPEGIKGRGGQVRRGTAGLAFQGGEGGKKAPPAGGGPQGVFPGKPPRAHRGGGSPLSPSEGPAASPRNVPPFFLNRGVYSRNTTPXAVGGGXPRPEKKIFSPPPPSFKGGGGKQGGGGVGHLKG

SEQ ID NO: 18703 - DNA, 688 bp, Zea mays
  misc_feature: Ceres CLONE 1385191-F
  misc_feature: Encodes the peptide sequence at SEQ ID NO. 18704
agagctggagctccccgcggtggcggccgctctagaactagtggatcccccgggctgcaggaattcgcacgagaccattacctagaacatcctaattgaaaactcgcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtgcaagggcgagaaccagagctggaagatcctgccgtggggtcccgaggcc

SEQ ID NO: 18704 - protein, 175 aa, Zea mays
  misc_feature: Ceres CLONE 1385191-F
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGGVHDGTAVVLWEWCKGENQSWKILPWGPEA

SEQ ID NO: 18705 - DNA, 728 bp, Zea mays
  misc_feature: Ceres CLONE 1385197-F
  misc_feature: Translation starting site: 376
  misc_feature: Pfam Name: Rieske Pfam Description: Rieske [2Fe-2S] domain
  misc_feature: SWISSPROT Homolog: EC 1.10.99.1 Plastoquinol--plastocyanin reductase
cgcggtggcggccgctctagaactagtggatcccccgggctgcaggaattcgcacgagaccattacctagaacatcctaatcgaaaaataaagctctgtgactgatcccacttagccttcatcctccataagaacaacacctccatcgcccaaaccctttcatattttcaactcaacatctccatgacttcatcaagggcaccctcatccctttcaccaagaactcagcttgcgacgagcagaaccactatgatgtcagatgtatcctgagacgttagctacaccaacgaatcatactacggtgagaaaggacaagcttgacctaagaattgcttgatcaatcataccgagacaccagcagacaaagctccatatatgaaaaagaccaaactattgaatcttcctcttgtcgcagctctatcactcccaactgccctccatgacttgtccctaactctaccttcatagcccctcctgcatccgcatctggacatggcgcaacaccagtcaatcacgcactaggaaatcatgtcgcttcgacacaatggcttaagactcatggtcccgtcgatcgaaccttgacacaaggatcaaagggagatacaacttaccttgtcgaggataacgactcaccctagcaacatactgaatacacggatgtgcactcatctcgtatgggcagcgacatgatacatacctgagaacaagtgcctaagaccttgtcatga

SEQ ID NO: 18706 - DNA, 730 bp, Zea mays
  misc_feature: Ceres CLONE 1385199-F
  misc_feature: Encodes the peptide sequence at SEQ ID NO. 18707
  misc_feature (507)..(507): n is a, c, t, g, unknown, or other
  misc_feature (529)..(529): n is a, c, t, g, unknown, or other
  misc_feature (530)..(530): n is a, c, t, g, unknown, or other
  misc_feature (563)..(563): n is a, c, t, g, unknown, or other
  misc_feature (647)..(647): n is a, c, t, g, unknown, or other
ggagctccccgcggtggcggccgctctagaactagtggatcccccgggctgcaggaattcgcacgagaccattacctagaacatcctaacgaaaaaatcaattctccagaccctccccggcaaccgcgtccggccgtccgcttccgtctccttggataaccacgacgcccgccggcaagcgaaagcgaagcgagccaacccagccatggagaaggcgatcgatcggcagcgggtcctcctggcgcacctcctcccctccctctccgccgcctcctcgcagcctcagcttgcggcgtcggcgtgcgcggccggggacagcgccgcctaccagaggtcctcctccttcggggacgatgtcgtcgtcgtcgctgcctacaggacgccgatatgcaaggccaagcgaggaggcttcaaggacacctacccagaggacctcctcactgttgttctcaaggctgttctggacaacactagaaatcatccagctgacatcggtgacatcgtcgntgggacggtgcttggccctggnntccagcgtgcaaacgagtgcaggatgcctgcgntgtttgctggattcccctgaaccgtccctggtagaactgtcacccgcagtgttcatctgggctacagcaataactgatgtccanctgctataaaggctggtacatgacataaggattggggctggttggaaatcatggcaataattcattggctggaaaggcaagta

SEQ ID NO: 18707 - protein, 125 aa, Zea mays
  misc_feature: Ceres CLONE 1385199-F
  misc_feature: SWISSPROT Homolog: EC 2.3.1.16 Acetyl-CoA C-acyltransferase
  misc_feature (101)..(101): Xaa is any aa, unknown, or other
  misc_feature (109)..(109): Xaa is any aa, unknown, or other
  misc_feature (120)..(120): Xaa is any aa, unknown, or other
MEKAIDRQRVLLAHLLPSLSAASSQPQLAASACAAGDSAAYQRSSSFGDDVVVVAAYRTPICKAKRGGFKDTYPEDLLTVVLKAVLDNTRNHPADIGDIVXGTVLGPGXQRANECRMPAXFAGFP

SEQ ID NO: 18708 - DNA, 673 bp, Zea mays
  misc_feature: Ceres CLONE 1385201-F
  misc_feature: Encodes the peptide sequence at SEQ ID NO. 18709
aaagctggagctccccgcggtggcggccgctctagaactagtggatcccccgggctgcaggaattcgcacgagaccattacctagaacatcctaatcgaaaaacagcagcaagcaaagcaagcaagagatagacaagcagctccagtccaaccaagaacaaacaacaaccgcagcaagaggagaggaggctcaccggtcgcgaccaaattctcccagagacggtcggaaatgaggagccaagcgctgttcttcctcacgatcgcccttctcaccgtgctcgcgcgatccagcaacaggcaccaccaccaccactcccacgttcaaagcaaaggtatgtaggaaagcttaactagttcaagatttgtcctttcggttattcagtctggctggctcacggggttccgaatcggtctgcggtttcagggcagggagcagcatcaggaggaggagcaggacgggagctggcgagccgggggaaggaggcggcgagcgcgtggccgcggtgcaatacctagaacggttgacccatggcgaaaagcgcttctgtgccgggagtctgaacgcggcgccccgcgtggcgccgccggcctgccggggttgcctcaggtcgagcttcatcagaatccggcgggaaatcagtggatggaccccgcccctgaaggtggcagcaca

SEQ ID NO: 18709 - protein, 36 aa, Zea mays
  misc_feature: Ceres CLONE 1385201-F
MRSQALFFLTIALLTVLARSSNRHHHHHSHVQSKGM

SEQ ID NO: 18710 - DNA, 668 bp, Zea mays
  misc_feature: Ceres CLONE 1385205-F
  misc_feature: Translation starting site: 177
  misc_feature: SWISSPROT Homolog: EC 4.1.1.35 UDP-glucuronate decarboxylase
  misc_feature (333)..(333): n is a, c, t, g, unknown, or other
  misc_feature (668)..(668): n is a, c, t, g, unknown, or other
cgctctagaactagtggatcccccgggctgcaggaattcgcacgagaccattacctagaacatcctaatcgaaaagtccgccccagtctaatccgattcaaaccgcccgttccccgtgtccgtgccaagcaagccgagcccaacccccaagagccagctgctcggtgctccacgcgatggcgcagaaggagactaatggcagcaacggcgatcacatctccacccgcccgccgccgaccccctcgcccctccgcttctccaagttctttcaggctaacctgcggatcctggtcactggtggggcgggcttcatcggctcgcacctcgtagacnagctcatggagaacgagaagcacgaggtcattgttgctgataactttttcactgggtcaaaagacaacctgaagaagtggattggccacccaagatttgagctcatccgtcatgatgtcaccgagccgcttcttggggggaagttgaccaaatctatcaccttggctgccctggttcaccaatcttctacaaggacaaccctgttaaaccatcaaaacaaatggtattggtaccctgaacatggtaggatttgcaaaaaaaggtggaactaggaatttggtgaatccacccccggaagtttaggggggatcccttggggcctcccaaatgggggn

SEQ ID NO: 18711 - DNA, 724 bp, Zea mays
  misc_feature: Ceres CLONE 1385206-F
  misc_feature (326)..(326): n is a, c, t, g, unknown, or other
  misc_feature (336)..(336): n is a, c, t, g, unknown, or other
  misc_feature (339)..(339): n is a, c, t, g, unknown, or other
  misc_feature (347)..(347): n is a, c, t, g, unknown, or other
  misc_feature (369)..(369): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (436)..(436): n is a, c, t, g, unknown, or other
  misc_feature (469)..(469): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (515)..(515): n is a, c, t, g, unknown, or other
  misc_feature (543)..(543): n is a, c, t, g, unknown, or other
  misc_feature (633)..(633): n is a, c, t, g, unknown, or other
  misc_feature (666)..(666): n is a, c, t, g, unknown, or other
  misc_feature (667)..(667): n is a, c, t, g, unknown, or other
  misc_feature (670)..(670): n is a, c, t, g, unknown, or other
  misc_feature (677)..(677): n is a, c, t, g, unknown, or other
  misc_feature (678)..(678): n is a, c, t, g, unknown, or other
  misc_feature (681)..(681): n is a, c, t, g, unknown, or other
cgcggtggcggccgctctagaactagtggatcccccgggctgcaggaattcgcacgagaccattacctagaacatcctaatcgaaaagtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggnccggaattgncangaacatgntggcgccgctcctggtgctcancctcatcatgtacatcatcggcatcggttttcnnnnngagaggctgggggaaccctctgggaaaaanccaccccttttcattccaacggggggaaaaaanaaaacccccaaaaatcttttaacccccgccgggggggggnnnntgntggttggtgggtccccccccgcggcgcncaaaaaaaaaaaggcggggcagacgttccaaactttttccccgggggggggggggtctccccccccccattccctttgggccccccccgnttttgggggtggggggccccccccccccgcggnnccnccgccgnncgncgcaccaccaaaaaaaaattgtgtttgggggggggcggggggg

SEQ ID NO: 18712 - DNA, 720 bp, Zea mays
  misc_feature: Ceres CLONE 1385207-F
  misc_feature: Encodes the peptide sequence at SEQ ID NO. 18713
tggagctccccgcggtggcggccgctctagaactagtggatcccccgggctgcaggaattcgcacgagaccattacctagaacatcctaatcgaaaaagattagtcacactcttcgcaagcacacaaaaaaaaaaaacccccaaatagcgtaaggataagcctcgccggcgacgaaatcagggtttcatcgaacaagaagatggctcacgcttgcgtctccacatcagcttcctctctcaggtttacagccggattcgtctccgcgagtcccaacgcctcctctttcgattctcagaagctttccctccctttcgagcctcttcgttcaagaaagacgaagaagttggttagcggcagaaagacggctccgaaggctgtatactccggcaatgtctggactccggagactccttcgcctcaaggagtttggtccatcagagatgatttacaagtcccttcttcgccgtattttcctgtgtacgctcaaggacaaggaccacctcctatggtgcaagagcgtttccagagtatcataagccagctcttccaatataggattattcgttgtggtggtgctgtggatgatgatatggccaacataatcgtagctcagcttctttacctcgatgctgttgatcctactaaggatattgttatgtatgtgaactctcctggtggatcagttacagctggtatggctatattcgatactatgaggc

SEQ ID NO: 18713 - protein, 71 aa, Zea mays
  misc_feature: Ceres CLONE 1385207-F
  misc_feature (1)..(71): Pfam Name: CLP_protease Pfam Description: Clp protease
  misc_feature: SWISSPROT Homolog: EC 3.4.21.92 Endopeptidase Clp
MVQERFQSIISQLFQYRIIRCGGAVDDDMANIIVAQLLYLDAVDPTKDIVMYVNSPGGSVTAGMAIFDTMR

SEQ ID NO: 18714 - DNA, 681 bp, Zea mays
  misc_feature: Ceres CLONE 1385221-F
tggagctccccgcggtggcggccgctctagaactagtggatcccccgggctgcaggaattcgcacgagaccattacctagaacatcctaatcgaaaaattggggcaggatcccgcgatggctcccagctcggtggcgtggaacccgtccgtggcgcccgcgaggccgaggtcgagctcggtgagcgccgcggctgctgccgggtgcgctgcgagcgccggcccgatgtcctccgtccagcagtagaactcggagaggtcgagcgccctgagcgctgggcagtccccgaggagcggctcgagatccgcgccggcgtcgaggcccggcgggcgctggtgccagcgcacgagcttgacgctgcggaggcgggacctccagtgcggggtgaggctgacgagcgtggtggggtcgcggcagtagacggcgagcgaggacacggcggggaagcagtaggcgaggcgcgccgcgaccagctcgttctgctccgcgacctgctgcggcgtcacggacggcgcgacggcgtccgccgacggcgccgcggaggagaggaaacggtggcccccacgggacgccagcgagaggtcgagccgctccagcgcccggaagcagaacgccggcctgaggaagaggaacgcgggcgaccgtgggtccccgcgcagcgacagcgcggcccgtgtgcccc

SEQ ID NO: 18715 - DNA, 616 bp, Zea mays
  misc_feature: Ceres CLONE 1385224-F
  misc_feature: Encodes the peptide sequence at SEQ ID NO. 18716
  misc_feature (455)..(455): n is a, c, t, g, unknown, or other
tccccgcggtggcggccgctctagaactagtggatcccccgggctgcaggaattcgcacgagaccattacctagaacatcctaatcaaaaatctttaccactagtcgccgtgccgtcccctccccttctctctctcctctctccccacgccacgcatcgcctcgtcggaacggaaggcggcagcgctgcgagcaagggagggagggagcggggatgaggatgctgtcgaaggcgtgctcgattgtggcctcctccctcccgcgctgctcctcctccgccgccgcccccacgatgagggggcagccgtccttgctgccaagcgtgcggaagcaatggcccgggaagccactgctgtatggaatcggcaccctgttggtcatgccactgaggacactgtatggagtgggtcgtgtttttggcgcaggacggtttctctgcaacatgaccaacgtctncttcgtcgctgcaaattggagcctgggatcattgcctttccagaaaaaactagtgggggaatcccgggtggaggggaaaccggagaaatggggaaaggggccctttggggggttggccctttaaaagggtgggaaaaagaaaaccaaaatttgtttttttt

SEQ ID NO: 18716 - protein, 121 aa, Zea mays
  misc_feature: Ceres CLONE 1385224-F
  misc_feature: SWISSPROT Homolog: EC 3.1.2.6 Hydroxyacylglutathione hydrolase
  misc_feature (81)..(81): Xaa is any aa, unknown, or other
MRMLSKACSIVASSLPRCSSSAAAPTMRGQPSLLPSVRKQWPGKPLLYGIGTLLVMPLRTLYGVGRVFGAGRFLCNMTNVXFVAANWSLGSLPFQKKLVGESRVEGKPEKWGKGPFGGLAL

SEQ ID NO: 18717 - DNA, 785 bp, Zea mays
  misc_feature: Ceres CLONE 1385227-F
  misc_feature: Encodes the peptide sequence at SEQ ID NO. 18718
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (785)..(785): n is a, c, t, g, unknown, or other
nnnnnnnnnccccccnnnnncccacctccccccccnngggggggngggccaaagctggactccaccgcggtggcggccgctctagaactagtggatcccccgggctgcaggaattcgcacgagaccattacctagaacatcctaatcgaaaaatcagacttgttcggcctcttcgacggcgtgcccgtctccccgagctcattcgccatgccttcctcagcctccgcgagaggaggacgagggctcctcttgccggcggctgctgaggcggttgtggtgctaatattgggtgcagtggcgccagcggcgggttgttatccgcgcgtgttcagcttcggggactcgctggccgacacggcgaactacccgttcgtctacggcaacgactctgggtctgggggggccgcgctccggccaccctacggcgagaccttcttccaccggcgccaccggggcgccgcctccaaatgggcgcctcggggccgaacttcatcgcggacacgcttgggcctccccgttcgtggcgaccgtatctggaccggcacggagcgcgcaggaactttcgtcgaagcgggggcccaactttcccccggccggcgggcgcccacggcgcctccaggcccggaatttttttgccgtggcaaggggagtttccgaacacccattggggaaaaacaaaggcgggaacccttcccacaatgggaaaaattgaaagttgggtttccccgcgggcgccctggtttctcaaaccttaaatccctgggttcccggggtaacattttccn

SEQ ID NO: 18718 - protein, 192 aa, Zea mays
  misc_feature: Ceres CLONE 1385227-F
MPSSASARGGRGLLLPAAAEAVVVLILGAVAPAAGCYPRVFSFGDSLADTANYPFVYGNDSGSGGAALRPPYGETFFHRRHRGAASKWAPRGRTSSRTRLGLPVRGDRIWTGTERAGTFVEAGAQLSPGRRAPTAPPGPEFFCRGKGSFRTPIGEKQRREPFPQWEKLKVGFPRGRPGFSNLKSLGSRGNIF

SEQ ID NO: 18719 - DNA, 620 bp, Zea mays
  misc_feature: Ceres CLONE 1385228-F
  misc_feature: Encodes the peptide sequence at SEQ ID NO. 18720
gcgggaattcgcacgagaccattacctagaacatcctaatcgaaaaaatcgcaagctcaagcaaaaacacaaagcgcttaaaccacactcaaaccaaccgccagccaacaaacaggcctcctagtcccgaccagaactcgctcgtagccccgagaacccgacagcgcgagatggctcccgagctgatgacagccaagatgaccgccaaggccgccgcggcggcggcggcggcggcggcggcgaagcctgccacgagggcgtacgtgacgttcctggcgggcgacggcgactactggaagggcgtggtggggctggccaagggcctccgcaaggtccgctcggcctaccccctggtgggggccgtgctgcccgacgtgcccgagtcccaccgccgcatcctcgtctcgcagggctgcgtcctccgcgagatcgagcccgtgtacccgcctgagaaccagacgaagttcgccatggcgtactacgtcatcaactactccaagctccccatctgggagttcggggaatacgagaggatggtgtacctggacgccgacatccagggggttccagaacctcgacggcctggtccagctccaggaagggtaatttctacgggggga

SEQ ID NO: 18720 - protein, 150 aa, Zea mays
  misc_feature: Ceres CLONE 1385228-F
  misc_feature: SWISSPROT Homolog: EC 2.4.1.186 Glycogenin glucosyltransferase
MAPELMTAKMTAKAAAAAAAAAAAKPATRAYVTFLAGDGDYWKGVVGLAKGLRKVRSAYPLVGAVLPDVPESHRRILVSQGCVLREIEPVYPPENQTKFAMAYYVINYSKLPIWEFGEYERMVYLDADIQGVPEPRRPGPAPGRVISTGG

SEQ ID NO: 18721 - DNA, 684 bp, Zea mays
  misc_feature: Ceres CLONE 1385230-F
  misc_feature: Encodes the peptide sequence at SEQ ID NO. 18722
agagctggagctccccgcggtggcggccgctctagaactagtggatcccccgggctgcaggaattcgcacgagaccattacctagaacatcctaatcgaaaaacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaacccactagctgcattgaactttgcttcttatttgcaacaacaacaactaccattcaggcaggtaccctgctgcctacccccagcaatttccttccattccaccaaactggcagcatttgaactccccctgcttaatttacaggcagcaaccaactactaccattttcagcc

SEQ ID NO: 18722 - protein, 176 aa, Zea mays
  misc_feature: Ceres CLONE 1385230-F
MAAKIFCLLMLLGLSASAATATIFPQCSQAPIASLLPPYLSPAVSSVCENPILQPYRIQQAITAGILPLSPLFLQQSSALLHQLPLVHLLAQNIRAQQLQQLVLANLAAYSQQQQFLPFNPLAALNFASYLQQQQLPFRQVPCCLPPAISFHSTKLAAFELPLLNLQAATNYYHFQ

SEQ ID NO: 18723 - DNA, 760 bp, Zea mays
  misc_feature: Ceres CLONE 1385234-F
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (12)..(12): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
aaaannnccccnaacaaaaannnacggagacagcggggggggcttccccccccaaagctggagctccaccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcgggcttcgcgagctggaacctgaaccacttcatcaacgggcagaccaactaccccgggcgtggccggcaacggcccgacgttctacttcctggtgttcgccatcctggcccggcgtggtgggccccggcgatccaagcttgggggggcgtggacccacgtggcgccccctgggcgcccccgaacaccctgggcccacccaacggcccggggttcgttggtttcaatccgcccttgggggcacatcaggcgggggggcttcgggcctttcggggggtttggggccctggagc

SEQ ID NO: 18724 - DNA, 680 bp, Zea mays
  misc_feature: Ceres CLONE 1385235-F
  misc_feature: Encodes the peptide sequence at SEQ ID NO. 18725
aagctggagctccccgcggtggcggccgctctagaactagtggatcccccgggctgcaggaattcgcacgagaccattacctagaacatcctaatcgaaaaagcgaatcacgtgacttcccctccccttctcccctctccactccatcgtcaaggaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccagagtttgggtgccaaaatccccgccgccgccccctctttcgaaagtcccaagagatcttccatggacgacattgatgaccacggtgatgacgaccaccatttggatatgagggatcccctcctgagcaagacaactccatgaaggattggtgagtctgatctgaactcaaggaagatttgaccgcttgaccttggtgacccccccagaagagggaaatccttcggggaagggactgagaaaaccgggatgcttcccaaaaacaaaagggaggttttaaaagccattttcgaagagaaatttgaaaagggttttgacccccttccacccgcaaagggggggaacccccccccgaaaatggggggggacc

SEQ ID NO: 18725 - protein, 82 aa, Zea mays
  misc_feature: Ceres CLONE 1385235-F
MDASKLRELRDFVEACKKNPSLLADPNLSFFRDYLQSLGAKIPAAAPSFESPKRSSMDDIDDHGDDDHHLDMRDPLLSKTTP

SEQ ID NO: 18726 - DNA, 627 bp, Zea mays
  misc_feature: Ceres CLONE 1385236-F
  misc_feature: Encodes the peptide sequence at SEQ ID NO. 18727
gcggcggttcaggcgagagcgtgagcgagaacatcctaatccaaaagaccaccaccgttatataacacagcacaggcagctcgagagagagagagagagaaagatgtcgtggttcgggcaccaccaccacaaccaggggggtcccccggcgtcgggccccaaccaggtgttcaagatcttctgccgcgccaacgagaactactgcctggccgtccgcgacggcgccgtcgtgctggccccggtcaaccccaaggacgaccaccaacactggtacaaggacatgcgcttcagcacccgggtcaaggacgacgaacgcatggcgggggtgccgctcggcaacaaggccacgggggtcgccatcaaggactccctcgggcagtcccacccggccaagctcgcgccctttcagcccggaccaggaggacgctcccgtgctgtggaccgagagcacggacatgggcaaggggttccgctgcatctgcatggggaagaacacccgggcgccactgcgaccccttccaccgccgacaagggaccaccccgggggtgcacgaacgggacggcccggtgttgcttttggaaacgccgcaaggggcggaaaaccatagcctgcaacatccctgccgg

SEQ ID NO: 18727 - protein, 174 aa, Zea mays
  misc_feature: Ceres CLONE 1385236-F
MSWFGHHHHNQGGPPASGPNQVFKIFCRANENYCLAVRDGAVVLAPVNPKDDHQHWYKDMRFSTRVKDDERMAGVPLGNKATGVAIKDSLGQSHPAKLAPFQPGPGGRSRAVDREHGHGQGVPLHLHGEEHPGATATPSTADKGPPRGCTNGTARCCFWKRRKGRKTIACNIPA

SEQ ID NO: 18728 - DNA, 721 bp, Zea mays
  misc_feature: Ceres CLONE 1385239-F
  misc_feature: Encodes the peptide sequence at SEQ ID NO. 18729
  misc_feature (461)..(461): n is a, c, t, g, unknown, or other
  misc_feature (467)..(467): n is a, c, t, g, unknown, or other
  misc_feature (468)..(468): n is a, c, t, g, unknown, or other
  misc_feature (521)..(521): n is a, c, t, g, unknown, or other
  misc_feature (648)..(648): n is a, c, t, g, unknown, or other
  misc_feature (649)..(649): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (687)..(687): n is a, c, t, g, unknown, or other
  misc_feature (688)..(688): n is a, c, t, g, unknown, or other
  misc_feature (690)..(690): n is a, c, t, g, unknown, or other
  misc_feature (691)..(691): n is a, c, t, g, unknown, or other
  misc_feature (693)..(693): n is a, c, t, g, unknown, or other
  misc_feature (694)..(694): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
ctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgccgagagcgagtgccgcgagcggcaccagcaagctgacgcgggcgaggaacggcgacagcggcgtggacgcctacgtctcccgctccggnaaaggnngcgagtgccggcgccagtgcctgcgcccgccacgagggccaggccgtgggagnacccaggagtggcattgaggcggtgccgccgccgcgggactggccgtcgacatgggagccaagagtacggtcgcggcagcgagagcgcgggcagtggcccgggagaagtgcgagcgccacaccgcgnngaacttggtgggagaggcagcgctgctgtgatgnnnannanncnncgggggggggnnnnnnnnnnnngnnnn

SEQ ID NO: 18729 - protein, 74 aa, Zea mays
  misc_feature: Ceres CLONE 1385239-F
MGKGSVGASWWAFLLLAGVLLVVAATAGAEDGVVERDRKEDLRWCKQACEWQYGKDTPRKRECRERVPRAAPAS

SEQ ID NO: 18730 - DNA, 662 bp, Zea mays
  misc_feature: Ceres CLONE 1385246-F
  misc_feature: Translation starting site: 289
  misc_feature (390)..(390): n is a, c, t, g, unknown, or other
  misc_feature (403)..(403): n is a, c, t, g, unknown, or other
  misc_feature (458)..(458): n is a, c, t, g, unknown, or other
  misc_feature (481)..(481): n is a, c, t, g, unknown, or other
  misc_feature (626)..(626): n is a, c, t, g, unknown, or other
ggcggccgctctagaactagtggatcccccgggctgcaggaattcgcacgagaccattacctagaacatcctaatcgaaaaacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggcaatgggaccgccctggtgctcttcctctccgcgggtgctacgttcatccgcatctgnaagaaggggtcgntggagcagtactcgccgatcccgtacgtggcgacgctgctgaactgcatgatgtnggtgttgtacgggctgccgctgntgcacccgacagcatgctggtgatcaccatcaacggcaccgggatgctcatccagctgacctacgtgggggctcttcctccgttactccggggggggcggcgcgccggaaggtgtcccttctgctggccgccgaggtccgctttnttcggggccgtcccccgggctggggctccgcctggg

SEQ ID NO: 18731 - DNA, 738 bp, Zea mays
  misc_feature: Ceres CLONE 1385247-F
  misc_feature: Encodes the peptide sequence at SEQ ID NO. 18732
  misc_feature (481)..(481): n is a, c, t, g, unknown, or other
  misc_feature (545)..(545): n is a, c, t, g, unknown, or other
  misc_feature (569)..(569): n is a, c, t, g, unknown, or other
  misc_feature (610)..(610): n is a, c, t, g, unknown, or other
  misc_feature (626)..(626): n is a, c, t, g, unknown, or other
  misc_feature (629)..(629): n is a, c, t, g, unknown, or other
  misc_feature (630)..(630): n is a, c, t, g, unknown, or other
  misc_feature (673)..(673): n is a, c, t, g, unknown, or other
ccccgcggtggcggccgctctagaactagtggatcccccgggctgcaggaattcgcaagagaccattacctagaacatcctaatcgaaaaaccacagttagcttcctttcaattattgtatttcagtcgagttgctaaacaacacgaactcctcagtcgtttgagttttgaggaggcaagcaagaggacccatcgatggcctccttgaaggaccactgtgccgtggtggcagttgtagtggcgatctgcttcgtcgtcctcgccgccgccctcccttcgcacgcgtcgacggcggtggacgagccggcgaagtataagcccagcagagcgccagcgccgtcccctgcatctgcatcatcctacgtcccgccgccggtccagcccgtgatcgtcgtccagggcgtcatctactgcaagtcctgcaagctcaggggctacaacagcggcatggacgcgtcccctctccccaatgcgacggcgnagcctggtgtgctacggcgacgcggagagcaaagtaccggggtgctgaaccagacgagcacggncaccgacacgaacgctacttcatncgtgagggtggacgaacgtggggcatgttcgaccgccgagnctgcaggctgactcgnttnnttccccgggaaggggggtctgcgccgcgccccttctccccgcnaaaccccaagctgggctcacccccttctgaggggacgggcgcggcaacggggccccgggggcggg

SEQ ID NO: 18732 - protein, 141 aa, Zea mays
  misc_feature: Ceres CLONE 1385247-F
  misc_feature (96)..(96): Xaa is any aa, unknown, or other
  misc_feature (117)..(117): Xaa is any aa, unknown, or other
  misc_feature (125)..(125): Xaa is any aa, unknown, or other
  misc_feature (139)..(139): Xaa is any aa, unknown, or other
MASLKDHCAVVAVVVAICFVVLAAALPSHASTAVDEPAKYKPSRAPAPSPASASSYVPPPVQPVIVVQGVIYCKSCKLRGYNSGMDASPLPNATAXPGVLRRRGEQSTGVLNQTSTXTDTNATSXVRVDERGACSTAEXAG

SEQ ID NO: 18733 - DNA, 702 bp, Zea mays
  misc_feature: Ceres CLONE 1385249-F
  misc_feature: Encodes the peptide sequence at SEQ ID NO. 18734
  misc_feature (281)..(281): n is a, c, t, g, unknown, or other
  misc_feature (342)..(342): n is a, c, t, g, unknown, or other
tccccgcggtggcggccgctctagaactagtggatcccccgggctgcaggaattcgcacgagaccattacctagaacatcctaatcgaaaaatatttcagtcgtcgctcgcggagccgtggcgcatcgcgactcaggcactcaccgaccgcggatatggccccgccgccatggcctctccttgcgacttccctcctcctcatcctattccaccactcgcctcgcgccgcggtggcgtttccgccgtctctgggcgacagcctcctggggcgcgcccgcgcngcgggtttcgcggcttggctgcgcggcttgcggcgccgcatccacgagcgccccgagctcngctttcaggagcaccgcaccagcgagctcgtccggacgagctcgacgcgatcggggtggccgtacgcgtggcccgtccggaaaagggcgtcgtggcgaccatcccggggaaaggatggcccctgttcggttcccagccaaatggacgcctacccttggagaattggaaaatgggaacccaaaacagggaaagggaaaaattctggttgggaactaggcccccccccaggttttgggggaaaaaaatttctttttcctcaaagaatctttaggggcccggaatttttttccccccaagaaaaaaattaggggggtttatattgttaaaaaagggccccggaaaaaccctcgtttttttggg

SEQ ID NO: 18734 - protein, 164 aa, Zea mays
  misc_feature: Ceres CLONE 1385249-F
  misc_feature (63)..(63): Xaa is any aa, unknown, or other
MAPPPWPLLATSLLLILFHHSPRAAVAFPPSLGDSLLGRARAAGFAAWLRGLRRRIHERPELXFQEHRTSELVRTSSTRSGWPYAWPVRKRASWRPSRGKDGPCSVPSQMDAYPWRIGKWEPKTGKGKNSGWELGPPPGFGGKKFLFPQRIFRGPEFFSPQEKN

SEQ ID NO: 18735 - DNA, 714 bp, Zea mays
  misc_feature: Ceres CLONE 1385255-F
  misc_feature: Translation starting site: 123
gctctagaactagtggatcccccgggctgcaggaattcgcacgagaccattacctagaacatcctaatcgaaaaactgccgcgccgccaccctctacagataaggaagaggaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacgaggctggcatgactcacattgtccgtgaggttgagaagccaggatccaaactccataagaaggaaacttgtgaggctgttaccatcagtgaaacccctcctcttgtcattgttgggctcgtggcatatgtgaagactccccgtggcctccgcacactcaactctgtttggggcccaacatcttagcgaagaagggaggagaaggttctaccagaactggtgcaagagcaagaagaaggctttcccaaagtatgctctcaaatatgaaaatgatgctggcaagaaggaaattcagctgcagcttgaaaagatgaaaaaatatgcttcctggtatcccggggctttgctcctacccagaataggaaaaaatgaaagggtttgaaacaagaaaaggctcacctgaggggagattcaggggcaagggggggtacctttgggtggacag

SEQ ID NO: 18736 - DNA, 696 bp, Zea mays
  misc_feature: Ceres CLONE 1385257-F
  misc_feature: Encodes the peptide sequence at SEQ ID NO. 18737
  misc_feature (405)..(405): n is a, c, t, g, unknown, or other
  misc_feature (421)..(421): n is a, c, t, g, unknown, or other
  misc_feature (422)..(422): n is a, c, t, g, unknown, or other
  misc_feature (471)..(471): n is a, c, t, g, unknown, or other
  misc_feature (503)..(503): n is a, c, t, g, unknown, or other
  misc_feature (543)..(543): n is a, c, t, g, unknown, or other
ggcggccgctctagaactagtggatcccccgggctgcaggaattcgcacgagaccattacctagaacatcctaatcgaaaaaaattgtgcgagtacttgggaaggcaccaacaatagcagctgctgcctacttgagattagcaggaagacctcccgtccttcctttaaatactctatcttattcagagaacttcttgtacatgctggactctttgggtgacagaacatataaaccaaatcctcgacttgctcgagctctagatattctttttattctgcatgctgaacatgaaatgaactgctccactgctgctgttaggcaccttgcttcaagtggtgtggatgtatttactgctctttctggtggtgttggagctctatatggtcctctgcatggcggcgcanacgaggcagtacttannatggtaaatgagattggaagcatggaaaatattcccagattcattgtangagtgaagaacaggaagaggaagatgtccggnttttgggcaccgtgtgtataaaaactatgaccctcgtgcntaagtcataaggaattgggcagatggagtggtctcaattgttggacgggatccacttattgaggtggccattgccctaaaaaagcagggctggcaaacaaatatttatcaagaggagctggatcaaatggggttcctacccgggctaattaaa

SEQ ID NO: 18737 - protein, 107 aa, Zea mays
  misc_feature: Ceres CLONE 1385257-F
  misc_feature: SWISSPROT Homolog: EC 2.3.3.1 Citrate (Si)-synthase
  misc_feature (69)..(69): Xaa is any aa, unknown, or other
  misc_feature (74)..(74): Xaa is any aa, unknown, or other
  misc_feature (91)..(91): Xaa is any aa, unknown, or other
MLDSLGDRTYKPNPRLARALDILFILHAEHEMNCSTAAVRHLASSGVDVFTALSGGVGALYGPLHGGAXEAVLXMVNEIGSMENIPRFIVXVKNRKRKMSGFWAPCV

SEQ ID NO: 18738 - DNA, 718 bp, Zea mays
  misc_feature: Ceres CLONE 1385261-F
  misc_feature: Encodes the peptide sequence at SEQ ID NO. 18739
  misc_feature (279)..(279): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (492)..(492): n is a, c, t, g, unknown, or other
  misc_feature (561)..(561): n is a, c, t, g, unknown, or other
gctctagaactagtggatcccccgggctgcaggaattcgcacgagaccattacctagaacatcctaatcgaaaagaaaatatacgtcagaataaaccgcagcaaatcttctccggcaccggcagcgcccaaatccggcaatccgctgctccgaatggactcaggttacaatccccggacggtggaggaggtgttccgggacttcaagggccgtcgtgccgggataatccgcgcgctcaccactgatgcggaggatttcttcaagcaatgcgacccgganaaagaaaacttgtgcctgtatgggtttcctaatgagagctgggaagtaaatttgcctgctgaagaggtgccacctgacctcccagaaccagcattaggcataaactttgcaagagatggaatgcaggannnaagagtggttgtccatggttgctgcacacagtgatgcatgggtactttctgttgcattttacttcggggctcgatttcgttncaataaaaatgacagagagcggctctacagtttgattgatgatcttcccatggcttttgaaattggtanggggaaaaagtggaccccggggcccgccccccccggcggtattacccccggaatttccaaccggattctaacaaaaaaaaaaacccccggggctaggggaaaaaccaaaacccgtgccccttaaaaaaagggggagaaaaatgcctgcccaccgggc

SEQ ID NO: 18739 - protein, 96 aa, Zea mays
  misc_feature: Ceres CLONE 1385261-F
  misc_feature (42)..(42): Xaa is any aa, unknown, or other
  misc_feature (85)..(85): Xaa is any aa, unknown, or other
  misc_feature (86)..(86): Xaa is any aa, unknown, or other
MDSGYNPRTVEEVFRDFKGRRAGIIRALTTDAEDFFKQCDPXKENLCLYGFPNESWEVNLPAEEVPPDLPEPALGINFARDGMQXXRVVVHGCCTQ

SEQ ID NO: 18740 - DNA, 706 bp, Zea mays
  misc_feature: Ceres CLONE 1385263-F
  misc_feature: Encodes the peptide sequence at SEQ ID NO. 18741
  misc_feature (397)..(397): n is a, c, t, g, unknown, or other
  misc_feature (473)..(473): n is a, c, t, g, unknown, or other
gctctagaactagtggatcccccgggctgcaggaattcgcacgagaccattacctagaacatcctaatcgaaaaagtcgagctctttcccttctcgcttcaaaccaaaccaaatcggagtggtggagcaaaacgatccgtagcctcgcttgccttcgattcggctcgaccagggcactaaccggtaaggcaatgccgcgcaagtcgcgagatctgtagcgtcaatcggcttcaccggcgtcgtcgcggtcatggaagcgcagaacggctcctgcggaggcacgcccgtggaccgtgctgctcagcgtgtacgacctgacgtccatgaacaactacctctactggctctgcctcggtatcctccactctggaatcgaagttcatgacatggagcacgnatttggagcacacgagttacagtcatgtggaatattttcgagtggaccccgaaaagctgtcctggcttcatctacngaagaatcggggtggatgatccacaactgacttggctagaagcacacttccgttccgtcaattgaaaatctggaaggaaagaccaccgccccgcgctttgctttggatccccaaaaatggaaactttttttggggttttggcccggaaagctttaccaggaatcccaccccggggctggggaaccggtaaaaaaaaagggggccctattttaagggggtttaaaaaaaagata

SEQ ID NO: 18741 - protein, 59 aa, Zea mays
  misc_feature: Ceres CLONE 1385263-F
  misc_feature (25)..(25): Xaa is any aa, unknown, or other
MNNYLYWLCLGILHSGIEVHDMEHXFGAHELQSCGIFSSGPRKAVLASSTEESGWMIHN

SEQ ID NO: 18742 - DNA, 660 bp, Zea mays
  misc_feature: Ceres CLONE 1385263-R
caattgggtaccgggccccccctcgaggtcgacggtatcgataagcttttttttttttttttttaattagaaagcacgtcatttcatgtcgagagatatgtgtgcgtatgcaacaaattcagtggcaaagaatcaatacaatcagcagcattcatctacactcctgcattcctgtgccacctggagaggcactaagtggacatcaactgtagcaattgaagctatcctgctatgtggaatccaaagggttggataattcagagaagatccttggctagctttggtggcacgtctatagaatggacgtcagcagttgaccatggcaaaaggtgttggtctaactctcccagatccctgtctccaagaaacgatgaaggtactgaatccgtatcatcatcagaaaatgcacgatgagtaggaacgtgtcttactgtggaaacttggatgctttctgggagaagacaattgaaaaatgaacccactcttgctagccgattcaccgacccaaggattgatttcctggtcaagctcttacagacatcatctgtaaaatggttgcagttcttcacaaatcaaatgatatggggttggcgttgtactttcctggcaaatttgcaatgaatcgagcggaactctgtccgtgggcaagcagatgatgcc

SEQ ID NO: 18743 - DNA, 688 bp, Zea mays
  misc_feature: Ceres CLONE 1385265-F
  misc_feature: Encodes the peptide sequence at SEQ ID NO. 18744
  misc_feature (363)..(363): n is a, c, t, g, unknown, or other
aagctggagctccccgcggtggcggccgctctagaactagtggatcccccgggctgcaggaattcgcacgagaccattacctagaacatcctaatcgaaaactcttccagagtaccgcggtctcatctcctcccgggacgggcatgcagagcacggctgccatcggtctcgttcggccatgcgccgcgcggccactccccacctaccctagcccacggcgcggcgccggcgcgtgcagcggcgccgcacagccgatcctcgcgccccgcggcctctgcctctccgccccgcgcagcctactgccggactcgccgctggaggaggagtaccggagatgcagggccggccggcacgtggccgcgnccggaaaggtgccggcgcctgatggggcctaaaagaaaccggggggagggctcgccagaccctgcaactggggcccctcctcgggttcgggacccttttaaattttacttaaaatttaaaaaaagcaggttctgaagggtctgccttacccaaaaacactccccccgggggattttcccgttggaagcgccattgtttttgtttgggggaccccggttcccttaaaagccaaaaaatttgggggcccacttttttgaaaccccccccaaaacacggaaaaacagggggaaattttttaaaaaaaaaaccttagaaaggggggggg

SEQ ID NO: 18744 - protein, 83 aa, Zea mays
  misc_feature: Ceres CLONE 1385265-F
  misc_feature (74)..(74): Xaa is any aa, unknown, or other
MQSTAAIGLVRPCAARPLPTYPSPRRGAGACSGAAQPILAPRGLCLSAPRSLLPDSPLEEEYRRCRAGRHVAAXGKVPAPDGA

SEQ ID NO: 18745 - DNA, 686 bp, Zea mays
  misc_feature: Ceres CLONE 1385267-F
  misc_feature: Encodes the peptide sequence at SEQ ID NO. 18746
  misc_feature (396)..(396): n is a, c, t, g, unknown, or other
agagctggagctccccgcggtggcggccgctctagaactagtggatcccccgggctgcaggaattcgcacgagaccattacctagaacatcctaatcgaaaaagtactttcgctagctcccttccgttcccttcccacgaaaaccggagagggagtgagaagaagcaacaagaagcggagagccaacgcgcaacgcaacgccctgagatggcggcgccggcgccggcgccgaagcaggaggagctgcagccgcacgccgtcagggaccagctgccctccgtctcctactgcctgacaagcccgcccccatggccggaggccgtcctcctcggcttccagcactacctcgtcatgctcgggaccaccgtcatcatccccagcgggggcgtgccccanattgggcgcggcaatgaggaaaaggcgcgggtggtgcaaacgctgctggtcgggggcgggatcaacaccctggcccagagtttcctggaacgcggctcccccgcgtcatgggggcctctaaaacctttggggggcccaacatcttcattgtccctcgcgcgccggtacggggggatccccggacccccccaaaaaatccggggcataaggggggggaaccaaagggggcgttactgtgggcccccccggcccaaaataataagggggtttcaggggccctttgggcaatg

SEQ ID NO: 18746 - protein, 159 aa, Zea mays
  misc_feature: Ceres CLONE 1385267-F
  misc_feature (63)..(63): Xaa is any aa, unknown, or other
MAAPAPAPKQEELQPHAVRDQLPSVSYCLTSPPPWPEAVLLGFQHYLVMLGTTVIIPSGGVPXIGRGNEEKARVVQTLLVGGGINTLAQSFLERGSPASWGPLKPLGGPTSSLSLARRYGGIPGPPQKIRGIRGGNQRGRYCGPPRPKIIRGFQGPFGQ

SEQ ID NO: 18747 - DNA, 709 bp, Zea mays
  misc_feature: Ceres CLONE 1385268-F
  misc_feature: Encodes the peptide sequence at SEQ ID NO. 18748
  misc_feature (438)..(438): n is a, c, t, g, unknown, or other
  misc_feature (468)..(468): n is a, c, t, g, unknown, or other
  misc_feature (475)..(475): n is a, c, t, g, unknown, or other
  misc_feature (496)..(496): n is a, c, t, g, unknown, or other
  misc_feature (511)..(511): n is a, c, t, g, unknown, or other
  misc_feature (548)..(548): n is a, c, t, g, unknown, or other
  misc_feature (613)..(613): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
tccccgcggtggcggccgctctagaactagtggatcccccgggctgcaggaattcgcacgagaccattacctagaacatcctaatcgaaaaattttccactttccactctgcctccgctgccgatcgccgtccccgaccgcagcgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaaagaaactggactgattaaggttgatcgagtcctttactcatcagttgtataccctcacaattatggtttcattccnaggactctttgtgaagacatgacccatggnatgtgtnggtcctgatgcaggagctggnttggtcctggttcgntcctgagagctagagcattggccttattgccatgatngaccagggtgaaaagatgacagataatagcaggatggtgctgacgatcctgaataccgtcactancacgacttcagcgagctgtctcctcacgcctgcaagagatcagcgcttccttgaagattacagaaacggggacnnnggaaggcgcagttgatgcat

SEQ ID NO: 18748 - protein, 108 aa, Zea mays
  misc_feature: Ceres CLONE 1385268-F
  misc_feature: SWISSPROT Homolog: EC 3.6.1.1 Inorganic diphosphatase
  misc_feature (107)..(107): Xaa is any aa, unknown, or other
MSEEDKAAASAEQPKRAPKLNERILSSLSRRSVAAHPWHDLEIGPGAPAVFNVVVEITKGSKVKYELDKETGLIKVDRVLYSSVVYPHNYGFIPRTLCEDMTHGMCXS

SEQ ID NO: 18749 - DNA, 744 bp, Zea mays
  misc_feature: Ceres CLONE 1385270-F
  misc_feature: Translation starting site: 222
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
nnnnnnnnnnnnnnnnnnnnnnnnnnggggggggtttgggggnnnncaaagctggagctccccgcggtggcggccgctctagaatagtggatcccccgggctgcaggaattcgcacgagaccattacctagaacatcctaatcgaaaaagctagctacatccactgatccacgcgcattccccgtaccaccgccaccgcgccgcgtcacggaaggaggaggatgtcgtcgtctccctcgccggcggccacccgcctggatctggatggcaaccccatcgctcccctcaccatctgcatgatcggcgccggcggcttcatcggctcccacctctgcgagaagctaatggccgagacgcaccacaccgtcctcgctgttgacgtctactgcgacaagatccgccaccttgtcgaccccgggggggcgcacctcgccgggcgcatctcattccaccgccttaacataaaaaacgactccaggctagaggggctcatcaagatggccgatctgacccataaaacctggccgcgatctgcacgccggccgactacaacactcgcccacttgacaccatctacagcaacttcatcgacgcactcccaggggtcaaggactgctcccgagaacagcaaggggctcttccacttttcccccctggggagggtctacgggaaagaccattcgggggggcttccctccccccaaaagaccaccccggttccccgaaaggggaaccctggaaatt

SEQ ID NO: 18750 - DNA, 750 bp, Zea mays
  misc_feature: Ceres CLONE 1385274-F
  misc_feature: Encodes the peptide sequence at SEQ ID NO. 18751
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (429)..(429): n is a, c, t, g, unknown, or other
  misc_feature (750)..(750): n is a, c, t, g, unknown, or other
nnnnnnnnnnttttnnnnnnnnntattttnnntttccgagggnnnnnaaaagctggggctccccgcggtggcggccgctctagaatagtggatcccccgggctgcaggaattcgcacgagaccattacctagaacatcctaatcaaaaattgttcgcgtcgtccgccttctctctctctctaacccactgccagccacctcttcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcaacccggcgtggcggcngcgtccacggagagggaggcgcccgccgcggcgttgcaggggttcctgtgcctggaggaggtggacgggaggcagtgaaactacgtggtggacggtggggccgcgaaaggggaggaccaggggcggggccggccccgctggggtcgcccgtcagggccggggccgatggaggcgccgctttccggcctgccgaggaaaataatggccattcataagaatcatatgggggggccctggaagggttttccaagacaggggttacctcccctccataatggaacctttacaatgaaccttggaaggggcttctggaaaaccatn

SEQ ID NO: 18751 - protein, 67 aa, Zea mays
  misc_feature: Ceres CLONE 1385274-F
MAPAVGLKRSATQTITLPPPDTRLAVRDVMRSTIPSQPGVAAASTEREAPAAALQGFLCLEEVDGRQ

SEQ ID NO: 18752 - DNA, 680 bp, Zea mays
  misc_feature: Ceres CLONE 1385275-F
  misc_feature: Encodes the peptide sequence at SEQ ID NO. 18753
aagctggagctccccgcggtggcggccgctctagaactagtggatcccccgggctgcaggaattcgcacgagaccattacctagaacatcctaatcgaaaaatgcagcagtagccgtctgcctcctcgctttccctttcgtccgtacgccgccgcctcgcaccgccgacagtcctcagtccagaactccagatcgagcctccctctccccagatcgggtcctaggctacagcagccgccgcatccgtcaccttcacaccgcgtgcgtgctctctctccccctccccctctccgtgcgacgactgggtgggctaccgccgccctacgcaaggtgccgagaacttcgccgatatctgcgccggagaagagcgcccaccagatcaggcgcttagaaggcgcgctggccggtggatgacgatggcgggtggcgggggactggaacggtcttcatcgagggggcagctgccgccgcaagagctgcttgacgatctctgcaggcggttccttctgaatgtgcccaaggaggagctggagtcgttcgagcggatcctgttcctgctggagcaggggcactggttctatgaggaccactccgttgaggaaaaccccaacctcaaggccctctcctccaggacttcacttccctcatggtcaagagctgcactggctctccgggcctac

SEQ ID NO: 18753 - protein, 88 aa, Zea mays
  misc_feature: Ceres CLONE 1385275-F
  misc_feature (19)..(82): Pfam Name: DCP2 Pfam Description: Dcp2, box A domain
MAGGGGLERSSSRGQLPPQELLDDLCRRFLLNVPKEELESFERILFLLEQGHWFYEDHSVEENPNLKALSSRTSLPSWSRAALALRAY

SEQ ID NO: 18754 - DNA, 772 bp, Zea mays
  misc_feature: Ceres CLONE 1385277-F
  misc_feature: Translation starting site: 222
  misc_feature: SWISSPROT Homolog: EC 1.6.5.3 NADH dehydrogenase (ubiquinone)
  misc_feature (18)..(18): n is a, c, t, g, unknown, or other
  misc_feature (20)..(20): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ggtttttttgtgtttttntnttattgcgtggttggcccccccacnnnttaaagctggagctccccgcggtggcggccgctctagaactagtggatcccccgggctgcaggaattcgcacgagaccattacctagaacatccaatcgaaaaatccccaaatcggcctacgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggggatggtcgaagacggccgagttcgtggtctctaaggtggacgacctgatgaactggccgcgtaagggctcgatctggggcatgaccttcgggcctcgcctgctgcgccggtggaaatggattgcacggccggggcggtcccgctacgactttccaacgggtttcgggggcatctttccgtcccgtcgccggtgccggtccgattggcatgatccgtccccggccacgctccaccaaaaaagaaggcttcccaccccctcccgcaaagggttaatggaccaaaggggctgaagccgagggggggatgttttccaatgcgcaaacatggcccccacgggcggtggggaacactcaccccttacccccccacccccgtggggaaccatcggacttgtgacccgtgatagcaccgccggggaaaaaactt

SEQ ID NO: 18755 - DNA, 740 bp, Zea mays
  misc_feature: Ceres CLONE 1385280-F
  misc_feature: Translation starting site: 243
  misc_feature (500)..(500): n is a, c, t, g, unknown, or other
ccccggcggtggcggccgctctagaactagtggatcccccgggctgcaggaattcgcacgagaccattacctagaacatcctaatcgaaaaaaggctcatgaaactttcgacccattggaggcccacgacctctccgtccgatccctaggcggcggatccttcctccaccaaacccgcacctgccgcaactgaatcgggtcagatcgggccatcggggaggcgagggagctcacgcggcgccatggacgaggaggagcacgaggtttacggccaggaaatcccggaggacggcgacatggacggcgctgacgttgatatggctgcctccggggatgacgcggcgaagctgcaggagctcgacgagatgaagcgcaggctgaaggagatggaggaggaagccgccgccctccgcgatatgcaggccaaggtcgccaaggagatgcaaggaggtgaccctagtgcatctacagctgaggcaaaggagcaggtggatgcccgnttctgtgtatgttggaaatgtggattatgcttgcaccccagaagaagtgcaacagcattttccaagcttgtggaactgtcaacagggtgacaatcttgacttgacaagttgaccaggcccaaaaggttttgctttatgtttgatttctggaaaaacggaaaagggtgttcaggaagctccttaacttgattggaatctgaaatttgcatggttgggcccaaaattaaggtcggcccaaag

SEQ ID NO: 18756 - DNA, 793 bp, Zea mays
  misc_feature: Ceres CLONE 1385281-F
  misc_feature (11)..(11): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
ggggggggggnttttnnnnnccgggtgtgggggggtgcggggggggggcgggtctggtgctccccgcggtggcggccgctctagactagtggatcccccgggctgcaggaattcgcacgagaccattacctagagacagcctaatcgaaaatcctcccccctcaacaaccgcgagatcttcagctaccgctctctccggtcgcgtttgcatccgcattcctcagatccagattcgagccccagccccgcttcgagatccagctagctctctatcaagcatccgttgtagcgagcagcggaagggtcgttaagagacaagatgaagggcaagacgcgggaacaagatcatcggatggaggctggccctggctgcagtggcgattcctggtgcggccggcacgattgcgctggcgctcacggcggggggacgtggcaaggccaacataaattaagctcgcacggacaagatctgtaacagggacgcggagagtgcctccggcgagccaagcgactgctggaagcggaacgatcagcgcgactgtcttaaagggcgtaccacgggtaaagaagccgtctttccgcgcgaggcgggagagacccccccggtcgccgcgacagcggccgggtttccgggaactaacaaggcctttacatcacccgccgctggccccccattcaagcccccagggggctcctgacccacccgcgaggtaaaccgagaagggccgatgagtgagagtatctgggaccttttccttgagagagacggtgggcggcccaagaactgtcatgg

SEQ ID NO: 18757 - DNA, 736 bp, Zea mays
  misc_feature: Ceres CLONE 1385282-F
  misc_feature: Encodes the peptide sequence at SEQ ID NO. 18758
agtggatcccccgggctgcaggaattcgcacgagaccattacctagaacatcctaatcgaaaaattcccaagcaaacagccaaacacacgcgaagaaaaggagatagagtacaggttacagacaggcagagagcaaagatgtgtggtggtgcgatcctcgccgagctcatcccgaccacgccggcgcgccgcggcggcgcggcgtggcccgccggcaagtgcaagcggcggaaggcgaacgacttcgaggccgcgttccgggagttcgacgaggactccgaggaggaggaggaggacgacgagggggtggtggagagcaagcccgccttcgtcgtcgtcgcctcgtccgcggcgacgcagcccagggcgcgccaggagccatcggaggccggcgccggtcgcccgaccagcagcatatacagggtcgtcccggcgccgtccgtggggccaggtgggccgccgaaatcccctaccccggcaaggccgtccccgttgggcttggaacccttccccttccgccgagggcttccgcccgggacttataaacacgccgggggggcataatccacgggaccccggggcaaagttaaattgttccttcctccaatacgatctgggcggttggggccccctccccttccctaaaaacccccccgcccctttaaatgcacaaattcttttttttagccaaaaagaaaaaatactttccccctggtccggaagttcttctttattt

SEQ ID NO: 18758 - protein, 141 aa, Zea mays
  misc_feature: Ceres CLONE 1385282-F
MCGGAILAELIPTTPARRGGAAWPAGKCKRRKANDFEAAFREFDEDSEEEEEDDEGVVESKPAFVVVASSAATQPRARQEPSEAGAGRPTSSIYRVVPAPSVGPGGPPKSPTPARPSPLGLEPFPFRRGLPPGTYKHAGGA

SEQ ID NO: 18759 - DNA, 680 bp, Zea mays
  misc_feature: Ceres CLONE 1385284-F
  misc_feature (680)..(680): n is a, c, t, g, unknown, or other
tggagctcaccgcggtggcggccgctctagaatagtggatcccccgggctgcaggaattcgcacgagaccattacctagaacatcctaatcgaaaaacgcagcagcgacgcgacgcccccgccccgcgtcttctactcttcttcatcttcactgctcaccaacccatccatcccccagtcctcctcactgctcacccgtctcccatccccacaccaccaccacctacatcttccggtcttcccctccccacacccggggggatccccaccatccccgccccccgatggagctgttcccgcccgccaaaggtgttgcggggtcaaaacccaccccgaacaatttcctggtaccccgaaaaaagaaaaagccccccttgaacccaataacggggaagggttcgttcggaaaaattcccccagggcccctgggaacccggggccaaaaaaaacccgggggccccttcccccttggggagaaaaggaatggccaataaacccccccccttccccgggaaacccccctcccttttggaaaaagacccccccccaaaagggaaaacaaaaatgggcgccgccgcggggccccaaccccccaaaagtgttcgggggggttcgagaaaccgcgttgggcaatctgttttttattggggggccacactccaaaaaaggaagaggtttcn

SEQ ID NO: 18760 - DNA, 753 bp, Zea mays
  misc_feature: Ceres CLONE 1385285-F
  misc_feature: Translation starting site: 195
  misc_feature (494)..(494): n is a, c, t, g, unknown, or other
  misc_feature (497)..(497): n is a, c, t, g, unknown, or other
  misc_feature (666)..(666): n is a, c, t, g, unknown, or other
  misc_feature (703)..(703): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
tccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtgggtggggctggccgtggccacgccggtgttcctgatcttcagccccgtgctggtccccgccgcgctgctcatcgggacggncgntcatggggtccctcacgtcgggcgcgctggggggcttccgggggcctgtccctcgctcacgtgcctcgccaacacggcggcggcaggcgttccagcgcaccccgggactaacgtgggaggaggcgcaccgcagggaatggcgggaggccgcgggcgcacgcgggccacnagaccgcgcaggcaggcaggccatccagggcagggcngcaggaagccgnnnncccgggggaaggtgcaaggtgccggcgctggcgct

SEQ ID NO: 18761 - DNA, 696 bp, Zea mays
  misc_feature: Ceres CLONE 1385290-F
  misc_feature: Encodes the peptide sequence at SEQ ID NO. 18762
  misc_feature (346)..(346): n is a, c, t, g, unknown, or other
  misc_feature (347)..(347): n is a, c, t, g, unknown, or other
  misc_feature (352)..(352): n is a, c, t, g, unknown, or other
  misc_feature (354)..(354): n is a, c, t, g, unknown, or other
  misc_feature (355)..(355): n is a, c, t, g, unknown, or other
  misc_feature (371)..(371): n is a, c, t, g, unknown, or other
  misc_feature (372)..(372): n is a, c, t, g, unknown, or other
  misc_feature (389)..(389): n is a, c, t, g, unknown, or other
  misc_feature (428)..(428): n is a, c, t, g, unknown, or other
cgctctagaactagtggatcccccgggctgcaggaattcgcacgagaccattacctagaacatcctaatcgaaaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctccccacgccgggtccactggccgccgcggggtcactgnncacgncnngtcatggtgccgccgnncgttcattctgccgcgncaccatgccactaccttactcaaccgccccgggctcagnctcatccccagccaaacccatgcccggtggcaaaagcggattccaagccggtggcaagtggagggaaccttgcggggttgcagcacccccatcctggggccagggcgccaaatttcttggggattaaggggaccccgaagggaacccctaatgtccccccaatggccaatgtttggggaaaagggtttcccccatctccggggggggggcccaacaccgtaccaggggtttttttgttgggcccccccccctcggggagggggcggag

SEQ ID NO: 18762 - protein, 135 aa, Zea mays
  misc_feature: Ceres CLONE 1385290-F
  misc_feature (67)..(67): Xaa is any aa, unknown, or other
  misc_feature (69)..(69): Xaa is any aa, unknown, or other
  misc_feature (70)..(70): Xaa is any aa, unknown, or other
  misc_feature (75)..(75): Xaa is any aa, unknown, or other
  misc_feature (81)..(81): Xaa is any aa, unknown, or other
  misc_feature (94)..(94): Xaa is any aa, unknown, or other
MRVLLVALALLALAASATSTHTSGGCGCQPPPPVHLPPPVHLPPPVHLPPPVHLPTPGPLAAAGSLXTXXHGAAXRSFCRXTMPLPYSTAPGSXSSPAKPMPGGKSGFQAGGKWREPCGVAAPPSWGQGAKFLGD

SEQ ID NO: 18763 - DNA, 678 bp, Zea mays
  misc_feature: Ceres CLONE 1385299-F
gctctagaactagtggatcccccgggctgcaggaattcgcacgagaccattacctagaacatcctaatcgaaaacccccttccctctcttccgcctccgattgagtggctcaccttctttcccagccagcacgagcttgcaagcaagcgagctcctgagatttcagctcgcttctcctccagaggtcgagcagaccagactcctccgaccgaagctctaccacttcccagttagcctgtccaggaactgcttggccggagatccaaacaaacctctgtgttggggttctccggggttccttgcgctgggaggggaggtttcgttctcgctggccatggtttggctgagaaggggaggggcagcatcttgatgccaaatctctgagctttatgagatcggcactcacctgggccggtcctgcttcctccactccttctcggttgtcttcctctactgggtttatgtgatctcataacttgccctcccccgggatccggcatttcccccggggccctcttctccgtccccttcaacccttcctccctcccgttgcttggtttcccttcaacaatccggcaaaataacaggcacctaagcggaaggggggaagaaggatcttttttcgagggaaagtttagggccgggccgggtttcccttggcgggagaaaaaaggaaaa

SEQ ID NO: 18764 - DNA, 701 bp, Zea mays
  misc_feature: Ceres CLONE 1385301-F
  misc_feature: Encodes the peptide sequence at SEQ ID NO. 18765
  misc_feature (530)..(530): n is a, c, t, g, unknown, or other
  misc_feature (701)..(701): n is a, c, t, g, unknown, or other
tggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcagcggcggcgtcgccgtgcgggcgtcgctgttctcgcccaagcccgcggcgtgcaaggacgcgcggccgaccaaggtgcaggagctgtacgtgtacgagatcaacgagcgggaccgcgagagccccgcgtacctgcgcctcagcgccaagcagacggagaacgcgctgggcgatcttgtccccttncacaacaaggtgtacaacggcagcctgaacaggcggctgggcgtcaccgcgggcatctgcgtgctcatccagcacgtccccgaccggacgggggaccgctacgagggcatctacagcttctacttcaaagactacggccaactctcggtgcagggcccgtacctgaactan

SEQ ID NO: 18765 - protein, 158 aa, Zea mays
  misc_feature: Ceres CLONE 1385301-F
  misc_feature (59)..(158): Pfam Name: Allene_ox_cyc Pfam Description: Allene oxide cyclase
  misc_feature: SWISSPROT Homolog: EC 5.3.99.6 Allene-oxide cyclase
  misc_feature (102)..(102): Xaa is any aa, unknown, or other
MAAALRCPASVRVSGPAAAGLAKVRQASRVVAVSGARQSRSGGVAVRASLFSPKPAACKDARPTKVQELYVYEINERDRESPAYLRLSAKQTENALGDLVPXHNKVYNGSLNRRLGVTAGICVLIQHVPDRTGDRYEGIYSFYFKDYGQLSVQGPYLN

SEQ ID NO: 18766 - DNA, 693 bp, Zea mays
  misc_feature: Ceres CLONE 1385302-F
  misc_feature: Encodes the peptide sequence at SEQ ID NO. 18767
tcaaaactagtggatcccccgggctgcaggaattcgcacgagaccattacctagaacatcctaatcgaaaaaccgccaccgggatggccggagttcccgccaccttctcctcagccaccgctcagatcgggggcttcctctcgaagaagccttacgcgccgccgttgtgggccacgcacctctcccccatgccttgccataccttctcgctcggccatttcccaacaccgattcacaagtggaatctgcccaatttgccggaaggaacggaagtgtggatcaagcgagacgatttatcaggcatgcagttgagtggaaacaaggtccggaagctggagttcttgatggcagatgccgtagcacaaggcgcggactgcgttattactgttgggggtatacagagtaaccactgccgtgccacagccgtggctgctaagtatctcaatcttgattgctacctgatactacgtacctccaagcttcttgtggataaggaccctggatttggttggcaatcttcttgtcgagagactagttggggcacacgcttgatcttgtgccaaaagaagaatatggacaaaattggcagtgtggctttagctgacctgctgaaaaaaaggcttctggaaagaggcaggaagccgtatgtgattcccccgctggtggatccaactcattgcgaacttggggaat

SEQ ID NO: 18767 - protein, 203 aa, Zea mays
  misc_feature: Ceres CLONE 1385302-F
  misc_feature: SWISSPROT Homolog: EC 4.4.1.15 D-cysteine desulfhydrase
MAGVPATFSSATAQIGGFLSKKPYAPPLWATHLSPMPCHTFSLGHFPTPIHKWNLPNLPEGTEVWIKRDDLSGMQLSGNKVRKLEFLMADAVAQGADCVITVGGIQSNHCRATAVAAKYLNLDCYLILRTSKLLVDKDPGFGWQSSCRETSWGTRLILCQKKNMDKIGSVALADLLKKRLLERGRKPYVIPPLVDPTHCELGE

SEQ ID NO: 18768 - DNA, 710 bp, Zea mays
  misc_feature: Ceres CLONE 1385303-F
  misc_feature: Encodes the peptide sequence at SEQ ID NO. 18769
tccccgcggtggcggccgctctagaactagtggatcccccgggctgcaggaattcgcacgagaccattacctagaacatcctaatcgaaaactcgcgggctttcccgcagcaagatcaacgtcgtcgttcaagccagcggtagtagagactacgaccgaggctagctaagctaagagatggcggatcaccagtactcggcgtggacgacttccgctgctcgtcatcgggtcttctcctgtgcgctcatggctcttgttagttttgtggctgcaggacgacccatggtgctcgccgacgccatcgtctttcacgtggcgaacaggtgcccgttcccggtgtggccggcgtccgcccctaacaccggccacccagtgctcgccggcggcggcttctacgtcccgcagggcaagtcgaggcgcgtcgtcgcgccggccaactggaacgggcgcttctgggcccgcaccggttgcaacttcaccgcgaacggcatgggcgtagcgggctgcctcaccggcgactgcgagggccggctcgcctggtacggggtccgtgggcgccccgcccgccacgctagtcgaggtgagcctgcacgaggacgccccgaaaggagctcctacgagtggagccctgggtggacgggtacaactcccccgtcgccgtctccgcaagcccgcacggggcgggcgcggacccgaacagtgcgccattg

SEQ ID NO: 18769 - protein, 177 aa, Zea mays
  misc_feature: Ceres CLONE 1385303-F
  misc_feature (48)..(161): Pfam Name: Thaumatin Pfam Description: Thaumatin family
MADHQYSAWTTSAARHRVFSCALMALVSFVAAGRPMVLADAIVFHVANRCPFPVWPASAPNTGHPVLAGGGFYVPQGKSRRVVAPANWNGRFWARTGCNFTANGMGVAGCLTGDCEGRLAWYGVRGRPARHASRGEPARGRPERSSYEWSPGWTGTTPPSPSPQARTGRARTRTVRH

SEQ ID NO: 18770 - DNA, 724 bp, Zea mays
  misc_feature: Ceres CLONE 1385304-F
  misc_feature: SWISSPROT Homolog: EC 2.7.11.24 Mitogen-activated protein kinase
  misc_feature (267)..(267): n is a, c, t, g, unknown, or other
  misc_feature (339)..(339): n is a, c, t, g, unknown, or other
  misc_feature (403)..(403): n is a, c, t, g, unknown, or other
gctctagaactagtggatcccccgggctgcaggaattcgcacgagaccattacctagatcatcctaatcgaaaacccggcccgcgcctcgctctctcttgtctcgcccgctagctcccatcccagcctcccaccgcgcccgcctgccccaacatcccccctccccgctccgctccacgcacggctccagatctgctacggcggcggccggtggacgccgcgccgcgcgtgccggaggcggtgacgtgagcggcggatcctgcccggncgtgccatcctgacgacgatgacagcgtaagcggacggcggacgaacgctgcccaccggcccctactcccgnagtcattggcgtgtgctccttggcagaatatggcgatgatggtggatcccccccatggcatggncagtcagggaaagcatactatactatgtggcagaccctggttgaaatcaacaccaagtacgtgccgatcaagcccatcggaaaaagaacttaacggaaacgttggctcatcggttacccggaagaacaaggaaaagcccccaaaaaaaaaataaacaaaggtcttttaaaaacggggggggaggccctaagggacccttaaaaaattgaaaacccccttcggccccggggggcaccaaaatgtgtttggcccccaaggacaaaaaggggcccggcctaaaaaagaggctctcaagggctttttattgggttaataagccct

SEQ ID NO: 18771 - DNA, 690 bp, Zea mays
  misc_feature: Ceres CLONE 1385305-F
  misc_feature (454)..(454): n is a, c, t, g, unknown, or other
  misc_feature (471)..(471): n is a, c, t, g, unknown, or other
cccccgggctgcaggaattcgcacgagaccattacctagaacatcctaatcgaaaaacaaacccaacttccaccagacccctaaccttttcgcagctccagcgcacagccgccgccgtttcttcatcttcttcgcagagccggcgctccatcttcggctccctcccttacttgcgctcggcacgcaggcggcgctgtggctcgggatctcagtgacggcatcaagggcttcccctcccgcctctcgccagtcgcctccggtcctccgcacaccggccggtgatctctctcctcccgcctccggtggatcgtcaacggcgcccggccccggcggctgcgtcgcgcgcgtcctgagggcagctgcaggcgctgctcgactaaggcggtcgcgccgctttgggagcggttatggcccaaggtgagcgtggctctaggccgctctttgaacccctggnatggctactgctgtaantggctcaccttcaatcattctagcaactgcaggtatgatcccccatcaaatttttggaggccagaggggccccggtaccggactattcagtatccaaactctcaggtatcgccttggaataacccgggaaaggggttctaagtgggggtggaaacccctattccgctttttggggacacccaaaacccccgccggggattttcttggtcccaacaaggg

SEQ ID NO: 18772 - DNA, 716 bp, Zea mays
  misc_feature: Ceres CLONE 1385312-F
  misc_feature: Encodes the peptide sequence at SEQ ID NO. 18773
  misc_feature (380)..(380): n is a, c, t, g, unknown, or other
  misc_feature (392)..(392): n is a, c, t, g, unknown, or other
  misc_feature (452)..(452): n is a, c, t, g, unknown, or other
  misc_feature (473)..(473): n is a, c, t, g, unknown, or other
  misc_feature (478)..(478): n is a, c, t, g, unknown, or other
  misc_feature (479)..(479): n is a, c, t, g, unknown, or other
  misc_feature (497)..(497): n is a, c, t, g, unknown, or other
  misc_feature (714)..(714): n is a, c, t, g, unknown, or other
  misc_feature (715)..(715): n is a, c, t, g, unknown, or other
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcgnaagagggatgcnaagagcgagtgccgcgagcggcacagcaagctgacgcgggcgaggacggcgacaagcggngtggacgcctacgtctccggntcggnnaagggggcgagtgcccgngccagtgcctgcgcccgcacgaggggcaagccgtggaagacccagaatggcatggaggcggtgccgccgcccgggactggccgtcaaatggaacaaaaaataacgtcggggcagcaagaggcggggcaggggccgggaaaagggggcaacgcccccacggggggaaattgggggaaaaggaacccctctgaggtgaaaaaaacaggggggggggggnna

SEQ ID NO: 18773 - protein, 170 aa, Zea mays
  misc_feature: Ceres CLONE 1385312-F
  misc_feature (92)..(92): Xaa is any aa, unknown, or other
MGKGSVGASWWAFLLLAGVLLVVAATAGAEDGVVERDRKEDLRWCKQACEWQYGKDTPRKRDAKSECRERHSKLTRARTATSGVDAYVSGSXKGASARASACARTRGKPWKTQNGMEAVPPPGTGRQMEQKITSGQQEAGQGPGKGGNAPTGGNWGKRNPSEVKKTGGGG

SEQ ID NO: 18774 - DNA, 660 bp, Zea mays
  misc_feature: Ceres CLONE 1385318-F
  misc_feature: Encodes the peptide sequence at SEQ ID NO. 18775
  misc_feature (293)..(293): n is a, c, t, g, unknown, or other
gctctagaactagtggatcccccgggctgcaggaattcgcacgagaccattacctagaacatcctaatcgaaaaagatcagatccccctttcgctggtttctttccccttggccaagcccaaaccgtctttaaatacacccgtcgtcgtccgcatcccccgcctgccttaaccattcctcccaacaccacctcgcctgcgatcttcgtagcctccgtcgcgtcgagcatcgatcatgtcggcctactgcggaaagtacaaggatgagctcatcaagaatgctgcctacattgncacccccggcaagggtatccttgctgctgatgagtccactggcaccattggcaagcgcctttccagcatcaatgtcgagaacgttgaggagaaccgccgtgccctccgtgagctcctattctgctggcctggtgctctccagtacatcagcggggtgatcctcttcgaggagaccctgtaccagaagaccagggatggcaagccttttgttgatgtcctcaaggagggaggcgtcctccctggaatcaagggtgacaagggcaccattgaaggtgttgggactgaataggagaccaccccccagggccatgacgaacttgggaaagcgttggcgccaagtactaccaggcagggggcccgctttgcg

SEQ ID NO: 18775 - protein, 115 aa, Zea mays
  misc_feature: Ceres CLONE 1385318-F
  misc_feature (11)..(116): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (20)..(20): Xaa is any aa, unknown, or other
MSAYCGKYKDELIKNAAYIXTPGKGILAADESTGTIGKRLSSINVENVEENRRALRELLFCWPGALQYISGVILFEETLYQKTRDGKPFVDVLKEGGVLPGIKGDKGTIEGVGTE

SEQ ID NO: 18776 - DNA, 637 bp, Zea mays
  misc_feature: Ceres CLONE 1385320-F
  misc_feature: Encodes the peptide sequence at SEQ ID NO. 18777
  misc_feature (33)..(33): n is a, c, t, g, unknown, or other
gcccgcgtttacgggaccccccgccgagaacancctaatcgagaaaaaaggcgaaacgaggctcaatctcagggccgagcggaagcggcgccgagcaaccaacccctctcctcggccgccgccgtctccccggaccatgggcatggccgccgcctcctcccggctgctctgggcgtcccgcgccgccgcctacctcaggatctccaccttccccagggccttctccaccgtgctgaaggatctgaagtatgctgacactcatgaatgggtgaaagttgagggtgattcagcaaccgtggttattactgaccatgcccaggagggggtgggtgatgttgtttttgtggagctaccagaagttggcatcagtgtatcccagggaaagaactttggtgctgttgagagtgtgaaggcaaccagcgatatcaattcaccagtgtctggagaggtggttgaagtgaacgagaaactaagtgaggagcctggattggtgaatgcaagtccatatgagaagggatgggattatcaaggtcaaggctcagcaattcaggggacctcaattccgctcatgggaggatgataagtactcgaaaattctgccgaagaagaagacaaccattgagaaaaatcagacggg

SEQ ID NO: 18777 - protein, 147 aa, Zea mays
  misc_feature: Ceres CLONE 1385320-F
  misc_feature (36)..(144): Pfam Name: GCV_H Pfam Description: Glycine cleavage H-protein
MGMAAASSRLLWASRAAAYLRISTFPRAFSTVLKDLKYADTHEWVKVEGDSATVVITDHAQEGVGDVVFVELPEVGISVSQGKNFGAVESVKATSDINSPVSGEVVEVNEKLSEEPGLVNASPYEKGWDYQGQGSAIQGTSIPLMGG

SEQ ID NO: 18778 - DNA, 652 bp, Zea mays
  misc_feature: Ceres CLONE 1385321-F
  misc_feature: Encodes the peptide sequence at SEQ ID NO. 18779
agagctggagctccccgcggtggcggccgctctagaactagtggatcccccgggctgcaggaattcgcacgagaccattacctagaacatcctaatcgaaaaaccgcaaggatccaccacaacagcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctcccgcggctacacaccggggctccgctccgacgctacgagggggccgagtcggaagacgatagcgtccgcgagtacgatgggcggcacggcggccgggactacgctgtgcccagcctggtctcagatatttttcgtgatcggcttagtgcgccgcacagcattggccggctgctggaaccttggggacgacttggcggtggggggcgccagggtcctggggggggcccgtggggttggaacccaaaggaagaacaagggagcccctgcaccctgaggggggacatgcccggccctggggaaaggacacctcaaggggggggggggagaaaaaa

SEQ ID NO: 18779 - protein, 152 aa, Zea mays
  misc_feature: Ceres CLONE 1385321-F
MASIVASRRAVPLVRALEKLIAASSAPGTGSALRPVAVAGGLPRLHTGAPLRRYEGAESEDDSVREYDGRHGGRDYAVPSLVSDIFRDRLSAPHSIGRLLEPWGRLGGGGRQGPGGGPWGWNPKEEQGSPCTLRGDMPGPGERTPQGGGGRK

SEQ ID NO: 18780 - DNA, 666 bp, Zea mays
  misc_feature: Ceres CLONE 1385322-F
  misc_feature: Encodes the peptide sequence at SEQ ID NO. 18781
ggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactcctcctcctcctcctcctcctcgccggcggcggcgccgctgtcctccatcggccgctccatccgctcgctccgccgtgaccagaaccagatccactccttcccgccgccgccagacgccacagacgccttccagcgccgcgccgcccaactcctggccgacctcccggcagccgacgacgtcctctccctcgcctggacgcgccgcctcctcgaatccttcctcctctgcctcgaggagttccgcgccctgctcttcggctccggggactcgcccgctgctcgggccccgctcgaccgcctcgtcgccgacttctccgaccgcgccgtcaaggcgctcgacctctgcaacgccgtccgcgacggcctcgacctcggc

SEQ ID NO: 18781 - protein, 131 aa, Zea mays
  misc_feature: Ceres CLONE 1385322-F
MPATDSSSSSSSSPAAAPLSSIGRSIRSLRRDQNQIHSFPPPPDATDAFQRRAAQLLADLPAADDVLSLAWTRRLLESFLLCLEEFRALLFGSGDSPAARAPLDRLVADFSDRAVKALDLCNAVRDGLDLG

SEQ ID NO: 18782 - DNA, 675 bp, Zea mays
  misc_feature: Ceres CLONE 1385323-F
  misc_feature: Encodes the peptide sequence at SEQ ID NO. 18783
  misc_feature (318)..(318): n is a, c, t, g, unknown, or other
  misc_feature (347)..(347): n is a, c, t, g, unknown, or other
  misc_feature (352)..(352): n is a, c, t, g, unknown, or other
tggagctccccgcggtggcggccgctctagaactagtggatcccccgggctgcaggaattcgcacgagaccattacctagaacatcctaatcaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcggaacatccgtctgccagcgatgtcggaagcgttgctgcagaccttgtcacggcgatgncgagggcgagggcaagggcaaagcatcancttcnccacaaggaaaggccgtggggggaatgctgcaactgggccgtatgcgtcaagacgtacccgctaacttgctcgtgctttgatcgggttgagcgctgctcccacgcctgaaaggagtgcgtggaaacggaggactcgcgcccactctgcgtccacagggaacgggggcaacccccgggccaaggtgcccaccacgaggacgggaggaagcggggaacccgctgacgaccaacgctgtggggcaagccacccccaaccgcaggggatggaaaattaacaaaaaagcagggggggggcaacaaccacaaaaaaagagaggccctgg

SEQ ID NO: 18783 - protein, 83 aa, Zea mays
  misc_feature: Ceres CLONE 1385323-F
  misc_feature (46)..(46): Xaa is any aa, unknown, or other
  misc_feature (56)..(56): Xaa is any aa, unknown, or other
MAMGAASILLMMVSLEALLLAAAAGGGTSVCQRCRKRCCRPCHGDXEGEGKGKASXSPQGKAVGGMLQLGRMRQDVPANLLVL

SEQ ID NO: 18784 - DNA, 663 bp, Zea mays
  misc_feature: Ceres CLONE 1385326-F
  misc_feature: Translation starting site: 137
  misc_feature (567)..(567): n is a, c, t, g, unknown, or other
  misc_feature (598)..(598): n is a, c, t, g, unknown, or other
tccccgcggtggcggccgctctagaactagtggatcccccgggctgcaggaattcgcacgagaccattacctagaacatcctaatcgaaaactatataaaaggtcagaaccgaaaccttaaccttattcggcgactatggcggcggcaccggcaggcggcggccctcgggcattgtcccagcgggagcaggacatccagatgatgctcgccgccgatgtccacctcggcaccaagaactgcgacttccaggtggagcgctacgtgtacaagcgccgcactgatggtatctacattattaaccttggaaagacctgggacaagcttcagttggccgccagggtcatcgttgccattgagaatccgcaggacattatcgtgcagtcctaggccctatggccagagggctgtccctcagtttgctcagtacactggtgcccatgccattgctggcaggcacactcctggtacattcaccaaccaggtgcaaacctccttcagtgaggcacgccttcttatcctgactgacccgagactgatcatcagcccattagggagtctgccctggnaaacatcccaccatcgccttctgggaactgnatcccctatgcgctatggtgaatcggcatccccgcaataacaaggggaacaggagcatggttggc

SEQ ID NO: 18785 - DNA, 728 bp, Zea mays
  misc_feature: Ceres CLONE 1385327-F
  misc_feature: Encodes the peptide sequence at SEQ ID NO. 18786
  misc_feature (447)..(447): n is a, c, t, g, unknown, or other
  misc_feature (679)..(679): n is a, c, t, g, unknown, or other
  misc_feature (681)..(681): n is a, c, t, g, unknown, or other
  misc_feature (682)..(682): n is a, c, t, g, unknown, or other
ggagctcaccgcggtggcggccgctctagaactagtggatcccccgggctgcaggaattcgcacgagaccattacctagaacatcctaatcgaaaaatcacactcgccaaccccgtcatcgatctcgtttcaaatccatccatcctcgtttcctccgtcccgcagcatctcaaccccatggccaagatcaagatcgggatcaatgggttcggcaggatcggaaggctggtggccagggtggctctgcagagtgacgatgtcgagctcgtcgccgtgaacgaccccttcatcagcaccgactacatgacctacatgttcaagtacgacactgtacacggacagtggaagcaccatgaagtcaaggtgaaggactccaaaacccttctctttggtgagaaggaggttgctgtgtttggctgcaggaaccctgaggagatcccgtggggntcggttggtgctgaaatatgttgtgagtctactggtggtttcactgaccaggagaaggctgcagctcacttgaaagggtgtgccaagaagttgtcatctctgctcctagcaggatgccccatgtttttgtcgtgtgtcaacgagaaaggagtacagtctgacattaacattgtctccaatgctagctgcacaacaactgccttgctcctcttgctaagtcatcaatgacagntnncgtatcgtgaggtctgatgacactgtcatgcatcactgcaaccaaa

SEQ ID NO: 18786 - protein, 165 aa, Zea mays
  misc_feature: Ceres CLONE 1385327-F
  misc_feature (4)..(153): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEICCESTGGFTDQEKAAAHLKGCAKKLSSLLLAGCPMFLSCVNEKGVQSDINIVSNASCTTTALLLLLSHQ

SEQ ID NO: 18787 - DNA, 710 bp, Zea mays
  misc_feature: Ceres CLONE 1385331-F
  misc_feature: Encodes the peptide sequence at SEQ ID NO. 18788
  misc_feature (342)..(342): n is a, c, t, g, unknown, or other
  misc_feature (383)..(383): n is a, c, t, g, unknown, or other
  misc_feature (395)..(395): n is a, c, t, g, unknown, or other
tggagctccccgcggtggcggccgctctagaactagtggatcccccgggctgcaggaattcgcacgagaccattacctagaacatcctaatcgaaaagtcaaagcagagtctgcccctccccgcgccgttctttttggttccccagtccccgccgccgccgaaacccgcagatggaggtcgtcgtcgccgcgaagcagaaggcgaagaaacacatacacctcttctactgctcagaatgcgaggagctcgccctcaagatcgccgccagctccgacgccatcgagctccaatccatcaactggcggagcttcgacgacgggttcccgaacctgttcatcaancaggcgcacgacatccgtgggcagcacgtggcggtcctggncctcttcagctncgcgtcggtcatattcgagcagatctccgtcatcttcgcgctgcccaagtatttcatcgctcattcacgctcgtgctgccatcctcccccagggctcaatcgaggcggtttgaggaaggagaggcgattgtcccaccggggtccccccttcggggatttcttcaatgtccccaaggtggggggggggcctaacaggggggtatattaaaaattcccgggttccaggaaaggtttactctgggaaaatttcctgccttgtttaaaaaaggatccctttggtggggggcccccccatttccggaagaaaaatatcct

SEQ ID NO: 18788 - protein, 143 aa, Zea mays
  misc_feature: Ceres CLONE 1385331-F
  misc_feature: SWISSPROT Homolog: EC 2.7.6.1 Ribose-phosphate diphosphokinase
  misc_feature (57)..(57): Xaa is any aa, unknown, or other
  misc_feature (71)..(71): Xaa is any aa, unknown, or other
  misc_feature (75)..(75): Xaa is any aa, unknown, or other
MEVVVAAKQKAKKHIHLFYCSECEELALKIAASSDAIELQSINWRSFDDGFPNLFIXQAHDIRGQHVAVLXLFSXASVIFEQISVIFALPKYFIAHSRSCCHPPPGLNRGGLRKERRLSHRGPPFGDFFNVPKVGGGPNRGVY

SEQ ID NO: 18789 - DNA, 673 bp, Zea mays
  misc_feature: Ceres CLONE 1385332-F
  misc_feature: Encodes the peptide sequence at SEQ ID NO. 18790
ggagctccccgcggtggcggccgctctagaactagtggatcccccgggctgcaggaattcgcacgagaccattacctagaacatcctaatcgaaaaaataaaagtgaaattccattaccttgctgtctcggtctgtcggccatcgccggttgcgcagcgggcagcggctcacgtcgacggggaagactccggaggccacgggcgttacattctcctgccgtatttttgcgggattgaagtgacagccagggatccactcatcccctgggtggaaaaattcaggttgtggattggattgctagctaccgaacaagccctcagcgtgctaatttcagtggaatcttggtagacaccactgaacttcttggtttccaattaagttcgagcatagagatcgtcttctctcacactgagttgccagtttattccgaaggtcccttcagctaagttctgatgatggctaaggccaatggagcagtccatgcatccacgaaggaacccttgttttctttttgtgtcatagctgatggtcagtatgctgatatcccagatggtcgctcattcctcgggggtcccagatactaccggcatagcatcacgggtctcccaaggggccgtcaacagggtgaaacgaacagggcaacatcaagttctccaatcatttttggtgact

SEQ ID NO: 18790 - protein, 73 aa, Zea mays
  misc_feature: Ceres CLONE 1385332-F
MMAKANGAVHASTKEPLFSFCVIADGQYADIPDGRSFLGGPRYYRHSITGLPRGRQQGETNRATSSSPIIFGD

SEQ ID NO: 18791 - DNA, 719 bp, Zea mays
  misc_feature: Ceres CLONE 1385333-F
  misc_feature: Encodes the peptide sequence at SEQ ID NO. 18792
  misc_feature (297)..(297): n is a, c, t, g, unknown, or other
cgcggtggcggccgctctagaactagtggatcccccgggctgcaggaattcgcacgagaccattacctagaacatcctaatcgaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgancgcgctcaaggccgcgacggccgcgaccttcggcgggtcgatgctggtgctgtccgggctgatcctggccggcaccgtgatcgcgctcacggtggccacccccgtgctggtgactcagcggggtttttggggggccggccgccaatcgggctgcgcttatgggcggcccggtttcgtcaccttccggggggctccgggtccctgcgcttgtccgtgtccctccgggatggacaggtacctggcgggaaaggacccggccgggggccgaccaggtggaccacgccaagggggagggtgggggccaagggccccgaaattcaaggatggaacaaagcaccggatcgaccaggggggaagggggtttttgaaaaaagaacccacctccaaggggaccgggggcgggaacctccttagacccgggg

SEQ ID NO: 18792 - protein, 179 aa, Zea mays
  misc_feature: Ceres CLONE 1385333-F
  misc_feature (36)..(130): Pfam Name: Oleosin Pfam Description: Oleosin
  misc_feature (39)..(39): Xaa is any aa, unknown, or other
MADHHRGATGGGGGYGDLQRGGGMHGEAQQQQKQGAMMXALKAATAATFGGSMLVLSGLILAGTVIALTVATPVLVTQRGFWGAGRQSGCAYGRPGFVTFRGAPGPCACPCPSGMDRYLAGKDPAGGRPGGPRQGGGWGPRAPKFKDGTKHRIDQGGRGFLKKEPTSKGTGGGNLLRPG

SEQ ID NO: 18793 - DNA, 683 bp, Zea mays
  misc_feature: Ceres CLONE 1385342-F
  misc_feature: Encodes the peptide sequence at SEQ ID NO. 18794
  misc_feature (580)..(580): n is a, c, t, g, unknown, or other
tggagctccccgcggtggcggccgctctagaactagtggatcccccgggctgcaggaattcgcacgagaccattacctagaacatcctaatcgaaaaaaaaaaaaaaattatcacggcggcggtggcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttcaagctttgcaaggttaggntctgtcagtttgggcagaagggcatcccttatctgaacacgtatgacggccgcaccatccgctaccctgaccccctcatcagggcaacgacaccatcgagatg

SEQ ID NO: 18794 - protein, 161 aa, Zea mays
  misc_feature: Ceres CLONE 1385342-F
  misc_feature (94)..(157): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
  misc_feature (128)..(128): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRXCQFGQKGIPYLNTYDGRTIRYPDPLIRATTPSR

SEQ ID NO: 18795 - DNA, 742 bp, Zea mays
  misc_feature: Ceres CLONE 1385344-F
  misc_feature: Encodes the peptide sequence at SEQ ID NO. 18796
  misc_feature (538)..(538): n is a, c, t, g, unknown, or other
  misc_feature (552)..(552): n is a, c, t, g, unknown, or other
  misc_feature (553)..(553): n is a, c, t, g, unknown, or other
  misc_feature (624)..(624): n is a, c, t, g, unknown, or other
  misc_feature (658)..(658): n is a, c, t, g, unknown, or other
  misc_feature (659)..(659): n is a, c, t, g, unknown, or other
  misc_feature (720)..(720): n is a, c, t, g, unknown, or other
  misc_feature (722)..(722): n is a, c, t, g, unknown, or other
aagctggagctccccgcggtggcggccgctctagaactagtggatcccccgggctgcaggaattcgcacgagaccattacctagaacatcctaatcgaaaaattatcacggcggcggtggcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgcctttcacccatcaggnatgaggatgctaanngtcagctttgcaaggttagggtctgtcagtttgggcagaagggcatcccttatctgaacacgtatgacggncgcaccatccgctaccctgaccccctcatcaggnncacgacacccatcagatcgatctggagaccaaacagatgtggactttcatcagtttgatgntnggcacgtcgtcatggtgact

SEQ ID NO: 18796 - protein, 174 aa, Zea mays
  misc_feature: Ceres CLONE 1385344-F
  misc_feature (3)..(40): Pfam Name: RS4NT Pfam Description: RS4NT (NUC023) domain
  misc_feature (94)..(164): Pfam Name: Ribosomal_S4e Pfam Description: Ribosomal family S4e
  misc_feature (42)..(90): Pfam Name: S4 Pfam Description: S4 domain
  misc_feature (116)..(116): Xaa is any aa, unknown, or other
  misc_feature (120)..(120): Xaa is any aa, unknown, or other
  misc_feature (121)..(121): Xaa is any aa, unknown, or other
  misc_feature (156)..(156): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLSPIRXEDAXXQLCKVRVCQFGQKGIPYLNTYDGRTIRYPDPLIRXTTPIRSIWRPNRCGLSSV

SEQ ID NO: 18797 - DNA, 684 bp, Zea mays
  misc_feature: Ceres CLONE 1385345-F
  misc_feature: Encodes the peptide sequence at SEQ ID NO. 18798
tggagctccccgcggtggcggccgctctagaactagtggatcccccgggctgcaggaattcgcacgagaccattacctagaacatcctaatcgaaaacggaaccccattccccgccgcctcgcgcccccgctcgcttcacttctctaggtgcgcaccgatcagaagagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctggagttgctcatgatgcacaacaggacctactgcgctgaaatggctcacaacgtgtccaccaagaagcgcaaggagatcgtggagcgtgctgcacagctcgacatggtggtcaccaaacagcttgctaggctccgcagccaggaggacgagtagtctggttttctggtcttaacgacgaactggatggtgcatttcctttctggagggaactacttttgcttggggcctggttagacggaaaccagaggcactcctacccttttggca

SEQ ID NO: 18798 - protein, 133 aa, Zea mays
  misc_feature: Ceres CLONE 1385345-F
  misc_feature (14)..(123): Pfam Name: Ribosomal_L32e Pfam Description: Ribosomal protein L32
MAVPLLTKKIVKKRVKQFKRPHLDRYKCLKPSWRRPKGIDSRVRRKFKGCTLMPNIGYGSDKSTRHYLPSKFKKFVVHNVSELELLMMHNRTYCAEMAHNVSTKKRKEIVERAAQLDMVVTKQLARLRSQEDE

SEQ ID NO: 18799 - DNA, 696 bp, Zea mays
  misc_feature: Ceres CLONE 1385349-F
  misc_feature: Encodes the peptide sequence at SEQ ID NO. 18800
  misc_feature (470)..(470): n is a, c, t, g, unknown, or other
  misc_feature (489)..(489): n is a, c, t, g, unknown, or other
  misc_feature (490)..(490): n is a, c, t, g, unknown, or other
  misc_feature (605)..(605): n is a, c, t, g, unknown, or other
  misc_feature (606)..(606): n is a, c, t, g, unknown, or other
ggagctccccgcggtggcggccgctctagaactagtggatcccccgggctgcaggaattcgcacgagaccattacctagaacatcctaatcgaaaactttcctctccgatccggatctccccacccgctccggcgagccatcgccgcgtcgcctccacgcgaccgactacttctcatatcaatctatctatccggcttacccgccgccgcacgcaccaaggttgcgttcaccatattacctgtttgcttatcttctcccgagcccagcaaaccctagccgccgccacccatggacatagaggccgacggacgattcggcaacaaacgagtgcacaatcgcctaggcccgggctccggcggcgctccaccatctaccaacggaaaggtctgcaactactggcgtgccggtcggtgcaaccgctttccgtgccccttcctccacagcgagctccccgaggctgcgccgcccnagcgccccactggacccgnngggaacgtatggcgcaaccccaacaccggaggacgaggaggtggcatcacaatagatgggggaagggcccaggagggggcagcgggatggcgagccacagcccgctgagaggccnntgcagtactttctcgccggtaccgatgtagctatggcgagaggtgcgctatccgcacagctactgcataggcgatagtatcgcgatgctt

SEQ ID NO: 18800 - protein, 102 aa, Zea mays
  misc_feature: Ceres CLONE 1385349-F
  misc_feature (61)..(61): Xaa is any aa, unknown, or other
  misc_feature (67)..(67): Xaa is any aa, unknown, or other
MDIEADGRFGNKRVHNRLGPGSGGAPPSTNGKVCNYWRAGRCNRFPCPFLHSELPEAAPPXRPTGPXGNVWRNPNTGGRGGGITIDGGRAQEGAAGWRATAR

SEQ ID NO: 18801 - DNA, 712 bp, Zea mays
  misc_feature: Ceres CLONE 1385350-F
  misc_feature: Encodes the peptide sequence at SEQ ID NO. 18802
aaagctggagctccccgcggtggcggccgctctagaactagtggatcccccgggctgcaggaattcgcacgagaccattacctagaacatcctaatcgaaaaggtgaggaatctaccaattgcttttcgtctcctgtccatcccttgtgcgctaccgctcctctcccttggcaacgacgactggcgccgccgctgccagacttcgctgggcatctcgccggcgacgagctcccaccaggattagagaaggtgatggcgaggagtgacagctgcctggcgcgcgtgggtgccggagttgcgatcggtggcgcggtcggcggagccgtcggtgcttgttatggaacttttgaggcattcagatacaagatccctgcattgctaaagatcagacatatcgggcaaactactgttggcagcgctgcaattttttggcttttcttgggggctgggagcttgattcactgcggaaaatcctactagtttgtttccctcctttttctgaacacgactttgtcgatgtgcttcagaggaggattctagattttgagcgctaccctgagtgccttcagtggaaactatttcacgcctgtaccatttaacagctaaatacctcaggggttgaaagagcaatcaagttatgtcctgggtttggtgggggatggaaaatacctcccctccatttcaaataaaaataaaattcccttttaacaaa

SEQ ID NO: 18802 - protein, 75 aa, Zea mays
  misc_feature: Ceres CLONE 1385350-F
MARSDSCLARVGAGVAIGGAVGGAVGACYGTFEAFRYKIPALLKIRHIGQTTVGSAAIFWLFLGAGSLIHCGKSY

SEQ ID NO: 18803 - DNA, 674 bp, Zea mays
  misc_feature: Ceres CLONE 1385353-F
  misc_feature: Encodes the peptide sequence at SEQ ID NO. 18804
  misc_feature (568)..(568): n is a, c, t, g, unknown, or other
  misc_feature (569)..(569): n is a, c, t, g, unknown, or other
  misc_feature (579)..(579): n is a, c, t, g, unknown, or other
  misc_feature (585)..(585): n is a, c, t, g, unknown, or other
  misc_feature (589)..(589): n is a, c, t, g, unknown, or other
  misc_feature (597)..(597): n is a, c, t, g, unknown, or other
  misc_feature (617)..(617): n is a, c, t, g, unknown, or other
  misc_feature (619)..(619): n is a, c, t, g, unknown, or other
  misc_feature (621)..(621): n is a, c, t, g, unknown, or other
ctccccgcggtggcggccgctctagaactagtggatcccccgggctgcaggaattcgcacgagaccattacctagaacatcctaatcgaaaaccaccacctcggctcctcccccgcggccatggccaccaccactctggggcaaggcgacgacggctgcaaaggccgcagcgccaacgggaatgacaatgccgtcgccttccatttggaggatgccaacatccaagatactcctaccaagatgaacagtaacagccttgcaatgagtggtgggcctgcagccggtgcaggaggcgagcacgaagagcagcagcaggatgggggaacgggatggcagtccccagcaggcaggtcaaccctgggaaaaaaggaaaagaaggaatctggtcctggtacagccaacgcccattggttgcctggggaattccaaaaaagggggggggggggggaaaaaaaattttgggggggaaaagaccccctttttggggcccccccccaagaaggcgccccccccccccaaaagggggggggggggggcctttccctctccggggggggggggggggggnnttttgttttntttttntttnttcccgcncccccccccccccccccccnantnttaaataataaaagaaaagggggggggcccccccccccccccccttctttttt

SEQ ID NO: 18804 - protein, 184 aa, Zea mays
  misc_feature: Ceres CLONE 1385353-F
  misc_feature (150)..(150): Xaa is any aa, unknown, or other
  misc_feature (153)..(153): Xaa is any aa, unknown, or other
  misc_feature (155)..(155): Xaa is any aa, unknown, or other
  misc_feature (157)..(157): Xaa is any aa, unknown, or other
  misc_feature (166)..(166): Xaa is any aa, unknown, or other
  misc_feature (167)..(167): Xaa is any aa, unknown, or other
MATTTLGQGDDGCKGRSANGNDNAVAFHLEDANIQDTPTKMNSNSLAMSGGPAAGAGGEHEEQQQDGGTGWQSPAGRSTLGKKEKKESGPGTANAHWLPGEFQKRGGGGEKKFWGGKDPLFGAPPQEGAPPPQKGGGGGLSLSGGGGGGXFVXFXFXPAPPPPPPXXLNNKRKGGGPPPPPPSF

SEQ ID NO: 18805 - DNA, 718 bp, Zea mays
  misc_feature: Ceres CLONE 1385354-F
  misc_feature: Encodes the peptide sequence at SEQ ID NO. 18806
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (627)..(627): n is a, c, t, g, unknown, or other
  misc_feature (628)..(628): n is a, c, t, g, unknown, or other
  misc_feature (638)..(638): n is a, c, t, g, unknown, or other
tggagctccccgcggtggcggccgctctagaactagtggatcccccgggctgcaggaattcgcacgagaccattacctagaacatcctaatcgaaaaaaaagtttcgtccaccatttcgctctcgcaagtcgcaagccaccgatttgtttacaggcgccggagctcccgacgacgactgagccatgtgcggcggcgcgatccttgccgagctccgcgagccggcgccgcgccggctcacggagcgggacatctggcagcagaagaagaagcccaagaggggcggcgccggcgggaggcgctcgttcgcggcggaagacgatgaggacttcgaggccgacttcgaggactttgaagccgactccggtgattcggatttggagctcggggaaggggctgacgacgacgtcatcgagatcaagcccttcgccgccaagagtactttctccagagatggcttaagcaccatgactactgctggttatgatgcccctgcagcaaggttggcccaaagggagaggaagaatcaatacgggggtatccgccagcgcccttgnnngtaagtggctgctgagatcagagatccccagaagggcgttcgtggttggcttggtacttttcatagtccnngagaagctgncagagcttatgatgctgaagcgcgcaggattcgtgcaagaaggccaaggtacttttctgatgcacagcagttggtcagaa

SEQ ID NO: 18806 - protein, 123 aa, Zea mays
  misc_feature: Ceres CLONE 1385354-F
MCGGAILAELREPAPRRLTERDIWQQKKKPKRGGAGGRRSFAAEDDEDFEADFEDFEADSGDSDLELGEGADDDVIEIKPFAAKSTFSRDGLSTMTTAGYDAPAARLAQRERKNQYGGIRQRP

SEQ ID NO: 18807 - DNA, 688 bp, Zea mays
  misc_feature: Ceres CLONE 1385356-F
  misc_feature: Encodes the peptide sequence at SEQ ID NO. 18808
  misc_feature (345)..(345): n is a, c, t, g, unknown, or other
  misc_feature (417)..(417): n is a, c, t, g, unknown, or other
  misc_feature (456)..(456): n is a, c, t, g, unknown, or other
  misc_feature (505)..(505): n is a, c, t, g, unknown, or other
aagctggagctccccgcggtggcggccgctctagaactagtggatcccccgggctgcaggaattcgcacgagaccattacctagagcatcctaatcgaaaaaacaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcggcggctgcgcggngcgggaccgactatgggacggacgacagcaagatctcccccgacgagatcctcttcgagggctgcgactacnaccactggctcatcaccatggacttccccgacccccagncgtcgcgcgaagagatgatcgagacatacctccagactcttcgcaaggncgtccggagttatgaggagggcaagaaaaggattgatgcttttaacacgacacttatggtggttttccgggttgaaaggcccaagaaatgccaaaaaaattttcgggtttgccggagaaaattttccttttggcggggtccaattttaatccccaaaacaagggggggcggggggaaccaaat

SEQ ID NO: 18808 - protein, 181 aa, Zea mays
  misc_feature: Ceres CLONE 1385356-F
  misc_feature (68)..(68): Xaa is any aa, unknown, or other
  misc_feature (92)..(92): Xaa is any aa, unknown, or other
  misc_feature (105)..(105): Xaa is any aa, unknown, or other
  misc_feature (121)..(121): Xaa is any aa, unknown, or other
MALALRLRRVLAAASTAAPLLRPSTSVARPCPLVPLASPVAPLPLPPWRFLPGGGAGFRSTAAAAARXGTDYGTDDSKISPDEILFEGCDYXHWLITMDFPDPQXSREEMIETYLQTLRKXVRSYEEGKKRIDAFNTTLMVVFRVERPKKCQKNFRVCRRKFSFWRGPILIPKTRGGGGNQ

SEQ ID NO: 18809 - DNA, 731 bp, Zea mays
  misc_feature: Ceres CLONE 1385360-F
  misc_feature: Encodes the peptide sequence at SEQ ID NO. 18810
  misc_feature (473)..(473): n is a, c, t, g, unknown, or other
ggagctccccgcggtggcggccgctctagaactagtggatcccccgggctgcaggaattcgcacgagaccattacctagaacatcctaatcgaaaaaaaaaaaactccaaaaacgcaacacatcgcgtcgcgattcgcgagggctccccccaaccccatcaagtctggccaggtctctcccatatcgggttctcccttcctcttcctgtttccgcgcgcgagatcgccgccccgggtgggctctagatcccgatggcctcgcgccgccgcaccctgctcaaggtcatcatcctcggcgacagcggggttgggaagacgtctttgatgaaccaatatgtgaacaagaagttcagcaaccagtacaaggctacgattggggcggatttcctcaccaagggagtgcagttcgaggacaggctcttcactctgcaaatatgggacactgctggtcaggaaaggttcagagtcttggncgtgcattctaccggggagcagattggtgggccctagctatgatggtaatctatgaaatcgtttgatatccttcccactggcgggaaaagtttctaatccagggagcccatcaagatctgaaaaattccctttttgtctgtgggaaacaaagttgatgaaatgtgggaaacgccgggggggggccaaaaaaaaggaaagggtgggggccccttaaagggaaatccccaaatttaaaaacttgtaaggtggaaacaacg

SEQ ID NO: 18810 - protein, 85 aa, Zea mays
  misc_feature: Ceres CLONE 1385360-F
  misc_feature (10)..(83): Pfam Name: Ras Pfam Description: Ras family
  misc_feature: SWISSPROT Homolog: EC 2.7.11.1 Non-specific serine/threonine protein kinase
  misc_feature (74)..(74): Xaa is any aa, unknown, or other
MASRRRTLLKVIILGDSGVGKTSLMNQYVNKKFSNQYKATIGADFLTKGVQFEDRLFTLQIWDTAGQERFRVLXVHSTGEQIGGP

SEQ ID NO: 18811 - DNA, 723 bp, Zea mays
  misc_feature: Ceres CLONE 1385363-F
aagctggagctccccgcggtggcggccgctctataactagtggatcccccgggctgcaggaattcgcacgagaccattacctagaacatcctaatcgaaaagaacaaacatgatccgtttccttatccccttggagcagaggaggagcagcatagcataacccgggagctcgctctcgctcccacctccccctccctccccttttgaccctccctcaccagctgcaaaaccgcgggccgcatcccgcccgcgccgcccaccggcggccacagccgcctacataaaccactaatcgaccactcgccgaaccaaaccacccacccacccaaacccaatggcggccaacctcctctccgccccgtcccggaaccctagctccggcgccggggccggcccccccgggggcctcccccggtcgggggccccggggaggggaaaccccccgggggggggggactcgtgcttgccccccccgccccattagcccgccccccccgggtgcccccccacggggggattgaaaaaagaaaaccccggaaaagaaccgctcccccggagttccctcccccaagggaggggacacgcccccaaggtccggtggggagcgggcctttccgagacccatttactccccgggtggaacaagggaacgatgttggcctgccgaccacaccaagagagggggacaaagcggggcaggctcgtcttatctttcttctcata

SEQ ID NO: 18812 - DNA, 725 bp, Zea mays
  misc_feature: Ceres CLONE 1385365-F
  misc_feature: Translation starting site: 208
  misc_feature (508)..(508): n is a, c, t, g, unknown, or other
  misc_feature (518)..(518): n is a, c, t, g, unknown, or other
  misc_feature (519)..(519): n is a, c, t, g, unknown, or other
  misc_feature (525)..(525): n is a, c, t, g, unknown, or other
  misc_feature (541)..(541): n is a, c, t, g, unknown, or other
  misc_feature (560)..(560): n is a, c, t, g, unknown, or other
aaagctggagctccccgcggtggcggccgctctagaactagtggatcccccgggctgcaggaattcgcacgagaccattacctagaacatcctaatcggaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctgacgagcatggacaggaagtgcctcgtggacctcggccacccgctgctcaaccgcgtcgccgacagcttcatccgcgccgctggggtcggggcggccagggccgtctccagggagcctacgtcgtcaccgtcgaagggctttcaggagactcgtccgggctagacgccgacgggcggcagcggagccatttctccagcatcagaggtgacgacggccagaggtcgctcgacgcagtggtaaaaacggccggcaaggagccttnccagtggggnntgcagncggagtctactcaggnctcacgtacgcgctgcggnaggccaggggatgccacgactgggtcagtgccttttcctagcttttaaccagacggcggtttttgggttggtctgcggtggaactttgctgtcctcgtgcagagaacagcggcatcgcagggggcatcgctggggcggcggtggcgctcacgggtgaccccggcg

SEQ ID NO: 18813 - DNA, 697 bp, Zea mays
  misc_feature: Ceres CLONE 1385375-F
  misc_feature: Encodes the peptide sequence at SEQ ID NO. 18814
  misc_feature (476)..(476): n is a, c, t, g, unknown, or other
  misc_feature (603)..(603): n is a, c, t, g, unknown, or other
  misc_feature (626)..(626): n is a, c, t, g, unknown, or other
  misc_feature (627)..(627): n is a, c, t, g, unknown, or other
tggagctccccgcggtggcggccgctctagaactagtggatcccccgggctgcaggaattcgcacgagaccattacctagaacatcctaatcgaaaaagtttcccggctccctcgctcacgcgccgcggcatcactccggccggctggccagtcgcccactcttcccacccacaccgccgctgcctttccttccacggcgaactctccgcgggcgacgtccagactggcaacggcattccaataaaagaatgcgcccctgctctggccaactctctccacctgcattccccgttccgctaaaccctagccgcctccggcgcgtagtagattcgccatcagagacgacgctcggcggccctgaggagggatgacctacgtcaacccagacccccagccgctcgccgccgctacggcggatgattccgcaacccagcatcaagctgcggtgaccgccgcgccgcagtcgacgcgaggncgctctcgggtttttttgcgacggcggaaccgaagcagggcgcgaccatggtggcgccatcgtccccgcagggcgttcccggggtttcgcggtcgtgcccaggggcccagggggtcgagaacatagncgccccccgcgtccccgcaggcnncctcccgggggttttggcgtgacgccccgggctcgcgccacagcaaggggcctccgggtgatggcgcccc

SEQ ID NO: 18814 - protein, 41 aa, Zea mays
  misc_feature: Ceres CLONE 1385375-F
  misc_feature (27)..(27): Xaa is any aa, unknown, or other
  misc_feature (35)..(35): Xaa is any aa, unknown, or other
MVAPSSPQGVPGVSRSCPGAQGVENIXAPRVPAGXLPGVLA

SEQ ID NO: 18815 - DNA, 737 bp, Zea mays
  misc_feature: Ceres CLONE 1385382-F
  misc_feature: Encodes the peptide sequence at SEQ ID NO. 18816
  misc_feature (501)..(501): n is a, c, t, g, unknown, or other
  misc_feature (534)..(534): n is a, c, t, g, unknown, or other
ggagctccccgcggtggcggccgctctagaactagtggatcccccgggctgcaggaattcgcacgagaccattacctagaacatcctaatcgaaaagtccacctcagctcccatatccgctcccctacctctccagcatctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcgccctcaaggactcgaagacgcttctcttcggcgagaagccggtcaccgtctttggcatcaggaaccccgaggagatcccgtggggtgaggctggtgctgagtatgtcgtggagtccaccggtgtcttcactgancagggacaggctgctgcacatctgaagggtggntgccagaaaggttgtatctctgcccccagcaaagatgcacccatggtttgtgtttgtgtcaatgaggacaagtacacctccgatgttaacattggttccaatggtagctgcacacaaactgccttgctccccttgctaggtcattcatgacactttggcattatggagggcttgatgacactgttcatggcatcactggcacc

SEQ ID NO: 18816 - protein, 166 aa, Zea mays
  misc_feature: Ceres CLONE 1385382-F
  misc_feature (4)..(154): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (106)..(106): Xaa is any aa, unknown, or other
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTXQGQAAAHLKGGCQKGCISAPSKDAPMVCVCVNEDKYTSDVNIGSNGSCTQTALLPLLGHS

SEQ ID NO: 18817 - DNA, 656 bp, Zea mays
  misc_feature: Ceres CLONE 1385383-F
  misc_feature: Translation starting site: 255
ctagaactaggtggatcccccgggctgcaggaattcgcacgagaccattacctagaacatcctaatcgaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggggctggacatgggcgcggcggcgaatgcagtcgttgcgccccgtgaagcaggcgaagcagcacatgtgcacgttcgcgctgtacgcgcacgacccgaagcggcaggtggagacgcaccactacgtctcccgcctcaaccaggacttccctccagggcgccgtctatgactccgaccaaggcgacgcgcgtctcatcggcgtggagtacatcgtgtccaagaaagacttcgactcgctgccgggggaggaacaggggctggggcactcgcacgggcacgagatcaggtcaggtcctgggacgagcccgcacggggcgggggtgggtggagaaaggggagcttgaccacatgggcgccgggttcgggaaaggtctgggggcacctgggaggtgggacggcggggacccgcctggccggtgggcgcccc

SEQ ID NO: 18818 - DNA, 722 bp, Zea mays
  misc_feature: Ceres CLONE 1385384-F
tcaccgcggtggcggccgctctagaactagtggatcccccgggctgcaggaattcgcacgagaccattacctagaacatcctaatcgaaaaatacttttcctccttcagtttttatcacacgtcaatggagtggggctagcaatggcatggtaacttttccaatctttttgcattaaaaaagaaatcctaaagaaaaaggattactaaacgagcacgctcgccggcgctgggaccaggctctgggtctcgcatcacgatcagatccaatccaaggccgcgccccagcccggcggatggattccgccgccgtggccatcgtgacggtgccgttcccggcgcagggccacctgaaccagctgctgcacctgtccctgctcctggcatcgcggggggtttcctgtccacttcgccgcgccggaaccgcacctcccgggaggcccggcgcgcgcctgcaacgggtgggtggcccgacccccccgttcggaggtgctcccgcggcgttggaatgggcccgggaaaaaactcccccttccccggacccattcctccccgtttcccgggggcactttgcagccccctggttcagaggccctccggcaccaggggcgccgggcccctccctacccccgccattcctgagagaaaattggcccaggatttaagcccccgtggcttccctctctctaaaaacgcccattggggactttccgcgggctgccga

SEQ ID NO: 18819 - DNA, 739 bp, Zea mays
  misc_feature: Ceres CLONE 1385390-F
  misc_feature: Encodes the peptide sequence at SEQ ID NO. 18820
  misc_feature (432)..(432): n is a, c, t, g, unknown, or other
  misc_feature (537)..(537): n is a, c, t, g, unknown, or other
  misc_feature (551)..(551): n is a, c, t, g, unknown, or other
  misc_feature (723)..(723): n is a, c, t, g, unknown, or other
aaactggagctccccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgacttcaccgggnttttgggggccccggccgcccatcgcgctggcgctcatggccggcccgggttcgtcaccctcggcgggcctcggcgtcgctgccgctggtcgtgttcctcctggnatgtacaggtaccntggacgggcaagcacccgccggggcgccgaccagctggaccacgccaagggcgaagctgggcgtccaaggcccgcgacatcaaggatgcagcacagcaccgctcgacaaggggggcagggggtcctttgagagaagaaccacactcggagcggaccgcgcgcgcgacctccnttgaccacggccgggg

SEQ ID NO: 18820 - protein, 162 aa, Zea mays
  misc_feature: Ceres CLONE 1385390-F
  misc_feature (36)..(156): Pfam Name: Oleosin Pfam Description: Oleosin
  misc_feature (120)..(120): Xaa is any aa, unknown, or other
MADHHRGATGGGGGYGDLQRGGGMHGEAQQQQKQGAMMTALKAATAATFGGSMLVLSGLILAGTVIALTVATPVLVTSPGFWGPRPPIALALMAGPGSSPSAGLGVAAAGRVPPGMYRYXGRASTRRGADQLDHAKGEAGRPRPATSRMQHSTARQGGQGVL

SEQ ID NO: 18821 - DNA, 657 bp, Zea mays
  misc_feature: Ceres CLONE 1385392-F
  misc_feature: Encodes the peptide sequence at SEQ ID NO. 18822
  misc_feature (428)..(428): n is a, c, t, g, unknown, or other
ggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgacccttcgcgggtcgatgctggtgctgtccgggctgatcctggccggcacgtgatcgcgctcacggtggcacccccgtgctgtgatctcgcggggntgtgggggcgcggcccccatcgggctggggtcatggggggccgggttcgtcccctccggggggcctgggggcccttgcgttggcccgggtccccctgggaggcaaagaacctggaggggaaagcccccggccggggggccgacccagttgggcccccccaagggggggggggggggggtcaagggcccgcggaaaattaggggggggggacaagggcccccgatcaacc

SEQ ID NO: 18822 - protein, 64 aa, Zea mays
  misc_feature: Ceres CLONE 1385392-F
MADHHRGATGGGGGYGDLQRGGGMHGEAQQQQKQGAMMTALKAATAATLRGSMLVLSGLILAGT

SEQ ID NO: 18823 - DNA, 691 bp, Zea mays
  misc_feature: Ceres CLONE 1385402-F
  misc_feature: Encodes the peptide sequence at SEQ ID NO. 18824
  misc_feature (303)..(303): n is a, c, t, g, unknown, or other
tccccgcggtggcggccgctctagaactagtggatcccccgggctgcaggaattcgcacgagaccattacctagaacatcctaatcgaaaaccgtgctttctcagaggtgggttggcttctcctcccccaccggttcgtgttcaggttctggttcgtgggcgagagggaagagatggcggcgtcggacgttgagtaccgttgcttcgttggcggcctcgcctgggggcacgacgaccactcccttcacaacgccttcagcacctacggcgaggtcctcgagtcgaagatcatcctggatcggnagacgcagaggtcccgcggcttcggcttcgtcaccttctccacggaggacgcgatgcgcagcgccatcgagggcatgaacggcaaggagctcgacgggcgcaacatcaccgttaacgaggcccagtcccggcggcggccggggaaggccgcccggttgccgaataccggggggggggcccccctgggtggggggggtttccgggggggggggggggggtttaacgggggggggcggggagggttctccggggggggggggaaaaaagggggggaaaaacccgggggggggggttttccgcaccacacccgggaaaattggggggaaattgtgggggggggggccccccctcgaagaacaaaaaaatatttgtgggcgccccccgggcc

SEQ ID NO: 18824 - protein, 172 aa, Zea mays
  misc_feature: Ceres CLONE 1385402-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (44)..(44): Xaa is any aa, unknown, or other
MAASDVEYRCFVGGLAWGHDDHSLHNAFSTYGEVLESKIILDRXTQRSRGFGFVTFSTEDAMRSAIEGMNGKELDGRNITVNEAQSRRRPGKAARLPNTGGGAPLGGGGFRGGGGGFNGGGRGGFSGGGGKKGGEKPGGGGFPHHTRENWGEIVGGGAPPRRTKKYLWAPPG

SEQ ID NO: 18825 - DNA, 683 bp, Zea mays
  misc_feature: Ceres CLONE 1385406-F
  misc_feature: Encodes the peptide sequence at SEQ ID NO. 18826
  misc_feature (389)..(389): n is a, c, t, g, unknown, or other
  misc_feature (396)..(396): n is a, c, t, g, unknown, or other
  misc_feature (457)..(457): n is a, c, t, g, unknown, or other
  misc_feature (510)..(510): n is a, c, t, g, unknown, or other
acccgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgncgctacnagaactcgccgtggatgggcgtctacaacatcgaccccaagcgcgccatggagcttccggncaagtgcggcctcgccacgccgcccgactgctagcagtgtgctagccaagccnagccaagcaggaaggccccggcattgctagctgtacgtgtctgtgtgtgcatctgcagcagggtgcaggcaggggccccgtacgtacgtgtctctttctctctctcatcttgccacgtacctatctagagggggtggtgttcgactaataaaattggtcttggcgtcgtcgcc

SEQ ID NO: 18826 - protein, 115 aa, Zea mays
  misc_feature: Ceres CLONE 1385406-F
  misc_feature (41)..(115): Pfam Name: Tryp_alpha_amyl Pfam Description: Protease inhibitor/seed storage/LTP family
  misc_feature (82)..(82): Xaa is any aa, unknown, or other
  misc_feature (85)..(85): Xaa is any aa, unknown, or other
  misc_feature (105)..(105): Xaa is any aa, unknown, or other
MAATSSKSSSSSSSAQRAAAALLVAAAVAVSVLVVGAAAVCDMSNEQFMSCQPAAAKTTDPPAAPSQACCDALAGADLKCLXRYXNSPWMGVYNIDPKRAMELPXKCGLATPPDC

SEQ ID NO: 18827 - DNA, 658 bp, Zea mays
  misc_feature: Ceres CLONE 1385407-F
  misc_feature: Encodes the peptide sequence at SEQ ID NO. 18828
cgctctagaactagtggatcccccgggctgcaggaattcgcacgagaccattacctagaacatcctaatcgaaaactctgctaacgccgctcgcgcatcctattgccctcgcgccaccgtcgccgccgctgcagcgagccaccgccctgccgtcgcctgaggtagacaccaagccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggtgttctgctccgtgaccagcacggcatcccgcttgtcaagagcgtgactggtagcaagatcctccgcatcctcaaggcccatgggttggcgccggagatcccggaggatctctacttcctcattaagaaggggggggcgattaggaagcatttggagaggaacaggaaggacaaggactccaaattcagactcattctttgtgaagagcaagatcccccggccttgcccgttactacaagggtaaccaagaagctcccacccccccctggaagtaacgagtcaaactacgggggaggacttctgggggccctagggggatatccc

SEQ ID NO: 18828 - protein, 159 aa, Zea mays
  misc_feature: Ceres CLONE 1385407-F
  misc_feature (1)..(60): Pfam Name: Ribosomal_S13_N Pfam Description: Ribosomal S13/S15 N-terminal domain
  misc_feature (65)..(129): Pfam Name: Ribosomal_S15 Pfam Description: Ribosomal protein S15
MGRMHSRGKGISSSALPYKRTPPIWLKTATTEVEEMITKAAKKGQMPSQIGVLLRDQHGIPLVKSVTGSKILRILKAHGLAPEIPEDLYFLIKKGGAIRKHLERNRKDKDSKFRLILCEEQDPPALPVTTRVTKKLPPPPGSNESNYGGGLLGALGGYP

SEQ ID NO: 18829 - DNA, 730 bp, Zea mays
  misc_feature: Ceres CLONE 1385411-F
  misc_feature: Encodes the peptide sequence at SEQ ID NO. 18830
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (13)..(13): n is a, c, t, g, unknown, or other
  misc_feature (18)..(18): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
nnnnccccccccnccccnccccaccggcggannnnnnnnnaaannnnnnnnaaaaatggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcggcagccctatctttggtgcagtcatgggtacaaccatcagggcacagcagctgcagcaactcgtgctacctgtgatcacccaagtagctctggcaaaccctttctccctactctcaggaacaaccattttcttcatttcaaccaactggctaacactgaaccggggtggttatttggcgggaaccaactattaaccattccggccagttaaggtactggcctacttcccaaaaaaaaaaaatttctttccattttaaaccaattggggccggaccgtg

SEQ ID NO: 18830 - protein, 101 aa, Zea mays
  misc_feature: Ceres CLONE 1385411-F
MATKIFSLLMLLALSACVANATIFPQCSQAPIASLLPPYLPSMIASVCENPALQPYRLQQAIAASNIPLSPLLFQQSAALSLVQSWVQPSGHSSCSNSCYL

SEQ ID NO: 18831 - DNA, 647 bp, Zea mays
  misc_feature: Ceres CLONE 1385415-F
  misc_feature: Encodes the peptide sequence at SEQ ID NO. 18832
  misc_feature (354)..(354): n is a, c, t, g, unknown, or other
  misc_feature (376)..(376): n is a, c, t, g, unknown, or other
  misc_feature (425)..(425): n is a, c, t, g, unknown, or other
  misc_feature (470)..(470): n is a, c, t, g, unknown, or other
ggagctccccgcggtggcggccgctctagaactagtggatcccccgggctgcaggaattcgcacgagaccattacctagaacatcctaatcgaaaagccgcacccccaagacttccgtccgagtctgagctcatctccgcgcgctgccgccgccgccgccgccgctcgacgcccaccgcgcagccatggcggaacagactgagaaggctttcctcaagcagcctaaggtgttcctcagctcaaagaaatctggcaagggaaagaagccaggcaagggtggcaatcgattttggaagagcattggccttggtttcaagactcccagggaagcaattgaagggacctacattgacnagaaatgtccattcactggaanccgttttctatcagaaggcagaattattgctggaacatgccacagtgcntagatgacagaaccatcatgtcgcagaactatctcccacttgtangaatacccggagtatggaaagagcactccacattcagctcaatctcccatgcttcgggtgaggaaggcgacatgtcatcatggcaggggagccctaatcaaaacggggaggtcaatgccgtaaaggcttccagtggatctggtgtggtggaaaaaagcttccccccaccggatttaa

SEQ ID NO: 18832 - protein, 80 aa, Zea mays
  misc_feature: Ceres CLONE 1385415-F
  misc_feature (57)..(57): Xaa is any aa, unknown, or other
  misc_feature (64)..(64): Xaa is any aa, unknown, or other
MAEQTEKAFLKQPKVFLSSKKSGKGKKPGKGGNRFWKSIGLGFKTPREAIEGTYIDXKCPFTGXRFLSEGRIIAGTCHSA

SEQ ID NO: 18833 - DNA, 628 bp, Zea mays
  misc_feature: Ceres CLONE 1385416-F
aagctggagctccccgcggtggcggccgctctagaactagtggatcccccgggctgcaggaattcgcacgagaccattacctagaacatcctgatcggaaaactcttctcccctctctctcttccccgccccctctgtctcgacatcggtgccgtcatcttctcggcctctcgccggttggatccatcgggcgctggtcggatctgcctttcggtcgccgttgcccctccgccacgcctcgcgccagccgggtctggctgaacggccggcctggatcccccctcccccccaaaacccagaattttggttttggggtttggccttttccgcgcgtaataagggccccccaacccgggggttccccccaaatgaaaaattctggacccccccccccggggggtgacccgtccctttgggggggggaaaaaaggggtggtcccctttgaaaggaacaccaaaagggggggtccccttttaggggggtttttttttttcccggggggggaggtccccccccccggggggggcgcccccccccccccccgcggggttttttttttgggggaagaaaagacctctccttttttttttttggggaaaaaaaaaaaaaccccccccccccccccct

SEQ ID NO: 18834 - DNA, 820 bp, Zea mays
  misc_feature: Ceres CLONE 1385419-F
  misc_feature: Encodes the peptide sequence at SEQ ID NO. 18835
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (400)..(400): n is a, c, t, g, unknown, or other
nnnnnnnnnnnnnnnnnnnaaacccaacagggccgggccggccccccaaacttttagctccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcactttccagtctccgagactccgagtctcgctcgcaccccgtcccctgcagcctgtgctctgggttggagggaggtgagctgcgagggagcgcggagggggcgaggagatggaggcagatttcggcgaggaagagacttgcattgctggccctgcttctcctggcggcgcccgtccgcccggcctcggcggctccggngaaggatggcctgcctcaacaggggggagtttgaaacagcaccaaagtggtggttttggtaaaatctggcttctgttggctgaagggggcatccgtcaatcccctgggttggaacgattcaaccgggaacggttttgaacctcattttccagcagggcccaacccccaaggggggggaatggatccctggaattggtccccacaggggggaacccatggcaataaagggctaggggaaatggatgccttagcggtgggggcaagggggggggaaccgtttgaagaaagggtttccggaggaatggcttatccacatttccaggggggtggccccggaacctgtggcaccaacttgggagggcacttggaaagggtttcccgtggctaagggggggcggggcccctccaaaacagtaacaa

SEQ ID NO: 18835 - protein, 137 aa, Zea mays
  misc_feature: Ceres CLONE 1385419-F
  misc_feature (127)..(127): Xaa is any aa, unknown, or other
NPTGPGRPPKLLAPRGGGRSRTSGSPGLQEFARDHYLEHPNRKSALLSPISPESPLPSPVSLSSLRDSESRSHPVPCSLCSGLEGGELRGSAEGARRWRQISARKRLALLALLLLAAPVRPASAAPXKDGLPQQGGV

SEQ ID NO: 18836 - DNA, 654 bp, Zea mays
  misc_feature: Ceres CLONE 1385421-F
  misc_feature: Encodes the peptide sequence at SEQ ID NO. 18837
tcagaactagtggatcccccgggctgcaggaattcgcacgagaccattacctagaacatcctaatcgaaaagttccgcaccccacggcaggcgcttgagagtacttgactactaccctcccacctgcgagactgcaacgccgttgcttcaactcgactccagcatccctcgtccccgcatcaccgcgccgccgacactccgctcgctttcgctcccgagacccgggcctgccgagccgccgccatggacgaggagtacgacgtgatcgttctgggcacggggctcaaggagtgcatcctcagcggtctcctctctgtcgacggcctcaaggttctacacatggatagaaatgattactacggaggagattccacctccctaaacctgaaccagctctggaagaggtttaggggggaagacaagccaccggcacatctaggtggcagcagagattacaatgtagacatggttccaaaggttaggatggaaaaggggactttggttcgcactctcattcacactgatgggacaaaatatttggcattcaaagctgttggatggaaactatgtctttcagcaaacggaggattcacaagggttcctgccaccgatatggagggtctaaaatctccctttggaggggtctattttgag

SEQ ID NO: 18837 - protein, 137 aa, Zea mays
  misc_feature: Ceres CLONE 1385421-F
  misc_feature (1)..(137): Pfam Name: GDI Pfam Description: GDP dissociation inhibitor
MDEEYDVIVLGTGLKECILSGLLSVDGLKVLHMDRNDYYGGDSTSLNLNQLWKRFRGEDKPPAHLGGSRDYNVDMVPKVRMEKGTLVRTLIHTDGTKYLAFKAVGWKLCLSANGGFTRVPATDMEGLKSPFGGVYFE

SEQ ID NO: 18838 - DNA, 678 bp, Zea mays
  misc_feature: Ceres CLONE 1385423-F
  misc_feature: Translation starting site: 281
  misc_feature: SWISSPROT Homolog: EC 3.1.3.16 Phosphoprotein phosphatase
tccccgcggtggcggccgctctagaactagtggatcccccgggctgcaggaattcgcacgagaccattacctagaacatcctaatcgaaaaagacaaaacagcgtccccctccctctactaaaaaaaaaatggaggcatgagctccgcctcctcctcgtctctcgccgatctccccaaaccctagccccgacctgaccgccggcgggcccgccggccggagaaggagtcgctcccacccacccaacttctgcggcggaaggggagcgggcggcggacgagatgccgtcgcacggggatctggaccggcagatcgcgcagctgcgcgactgcaagtacctgcccgaggcggaggtcaaggcgctctgcgagcaggccaaggccatccttatggaggagtggaacgtgcagcccgtgcgctgtcctgtcaccgtctgtggcgacatccacggccagttctatggactcatcgagctcttccgcatcggggggggacgctcccgacaccaactacctcttcatgggcgactacgtcgatcgtgggtactattcaggcaaaacagttcctctgttagtggcttttgaaagtccggtacggagattggaattccaatacttagaggaaattatggaggagcagacaaatcactccaggtatatggctttcaatggatgaatgg

SEQ ID NO: 18839 - DNA, 610 bp, Zea mays
  misc_feature: Ceres CLONE 1385426-F
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
ggagctccccgcggtggcggccgctctagaatagtggatcccccgggctgcaggaattcgcacgagaccattacctagaacatcctaatcgaaaagtccacctcagctcccatatccgctcccctacctctccagcatctcccgtctccgtcgtctcgtctccgctcctcacctcgccagccatgggcaagatcaagatcgggaatcaacgggtttcggaaagggatcggcaggggttcttgggcccaggggcccccccccggnnnaaaaaccagaggatgtgtaaagtttgttgcggtaaagacccttttttcccccgggttaatggccccacgttttaagaacaaccccgggccgggcaaggggaaaccacccaaccccccccggggaataaaaaaactttcttttggggaaaaccccccccccccctttttgtttcaaaacccccccggagaacccccccgggggggggggggggtgtttaaaaaatttttggggggaacccccccccgggtttttttcttttaaaaaaaaaaaaaaaaaagttgtgtcttccccccactataaaaagggggggggggggggggccccaaaagaaggtggttttctt

SEQ ID NO: 18840 - DNA, 703 bp, Zea mays
  misc_feature: Ceres CLONE 1385428-F
  misc_feature: Encodes the peptide sequence at SEQ ID NO. 18841
  misc_feature (388)..(388): n is a, c, t, g, unknown, or other
  misc_feature (583)..(583): n is a, c, t, g, unknown, or other
tggagctccccgcggtggcggccgctctagaactagtggatcccccgggctgcaggaattcgcacgagaccattacctagaacatcctaatcgaaaaatcaaatcgccaccgaaaattccccccaaaaaacaataagcaattgttcatcatcgtcagagtaaacacagcagaaccctagcgcgccgttcctccgacgactcacatcccacccactcacccaccccatggcggccaagctctccaccagcgccgacgtcccggcctcggtgcggctctccgcagcagcgcaggcggctgcgatccagccctcctccccgcgcttcttcttctcctcgctggccgggaccaacccggcctccccgcatcgccgcatcgccattgccgtcnatctctccgacgagtccgccttcgccgtcaagtgggccgtgcagaactacctccgccccggggacgccgtcgtgctgctccacgtgcgccccacctccgttctctacggggccgactgggggtcccatcccggtctccgtcgctgacgaggccgacgctgccgaggacgccgccgccgccgccgagggcggcccntcccgaggagagctgcaaaagaagcgggagaagaatacgacgccttcacctctaccaggggcaggacctcgccagccgttggcgatgccaaatcccctcaagatccttgtggtcaaggcc

SEQ ID NO: 18841 - protein, 102 aa, Zea mays
  misc_feature: Ceres CLONE 1385428-F
  misc_feature (55)..(55): Xaa is any aa, unknown, or other
MAAKLSTSADVPASVRLSAAAQAAAIQPSSPRFFFSSLAGTNPASPHRRIAIAVXLSDESAFAVKWAVQNYLRPGDAVVLLHVRPTSVLYGADWGSHPGLRR

SEQ ID NO: 18842 - DNA, 728 bp, Zea mays
  misc_feature: Ceres CLONE 1385432-F
  misc_feature: Encodes the peptide sequence at SEQ ID NO. 18843
  misc_feature (406)..(406): n is a, c, t, g, unknown, or other
  misc_feature (423)..(423): n is a, c, t, g, unknown, or other
  misc_feature (424)..(424): n is a, c, t, g, unknown, or other
  misc_feature (458)..(458): n is a, c, t, g, unknown, or other
  misc_feature (482)..(482): n is a, c, t, g, unknown, or other
  misc_feature (534)..(534): n is a, c, t, g, unknown, or other
  misc_feature (591)..(591): n is a, c, t, g, unknown, or other
  misc_feature (597)..(597): n is a, c, t, g, unknown, or other
  misc_feature (630)..(630): n is a, c, t, g, unknown, or other
aagctggagctccccgcggtggcggccgctctagaactagtggatcccccgggctgcaggaattcgcacgagaccattacctagaacatcctaatcaaaaaaaatcctccgaaccccgccgccgacgagcgagctatggcgctggcgcggcggctgctccgccttactccctacctcggcacgctctcgctcccaccccccaactcgcatctcctccggaatcgcacctatatctctgacatgcgccgctctgccttcgtcgaccgcttgctccgttccgtacgctccgagatctccttcctcgataactccgccccgccaccgccaccaccgcctcctaagccattcaccattgaggaccgcccgggcgagcagtgggcccgcctgcgccgcgtgttctgcgggnccgaggggggaagaaannagaggccagggtggacgccacgttggtcgacggngcgctccctccctcccgctcgggngcggacacgggcggcccgcccagaatgcatatcagtgttaaggttgaggtcntcaaggccgcgcggcctggagtggcgctcaccttcgagtgctccgcgtggcctgacnagatgnaggtgcggagggtctttcccgtccggccgcggngggcctgccccagtgcagcagtacgtcggccgccaaattcgggctccaaaagtcactgctccccttcagactccaatccagcacgtggggatcccatc

SEQ ID NO: 18843 - protein, 74 aa, Zea mays
  misc_feature: Ceres CLONE 1385432-F
  misc_feature (10)..(10): Xaa is any aa, unknown, or other
  misc_feature (29)..(29): Xaa is any aa, unknown, or other
  misc_feature (31)..(31): Xaa is any aa, unknown, or other
  misc_feature (42)..(42): Xaa is any aa, unknown, or other
MHISVKVEVXKAARPGVALTFECSAWPDXMXVRRVFPVRPRXACPSAAVRRPPNSGSKSHCSPSDSNPARGDPI

SEQ ID NO: 18844 - DNA, 717 bp, Zea mays
  misc_feature: Ceres CLONE 1385435-F
  misc_feature: Encodes the peptide sequence at SEQ ID NO. 18845
  misc_feature (358)..(358): n is a, c, t, g, unknown, or other
  misc_feature (453)..(453): n is a, c, t, g, unknown, or other
  misc_feature (489)..(489): n is a, c, t, g, unknown, or other
  misc_feature (504)..(504): n is a, c, t, g, unknown, or other
  misc_feature (579)..(579): n is a, c, t, g, unknown, or other
ggagctccccgcggtggcggccgctctagaactagtggatcccccgggctgcaggaattcgcacgagaccattacctagaacatcctaatcgaaaagaatgttgtggtgtctagcagtgtgcgtgaacttctggaatgtccagtctgtttgagtgccatgtatcctcctattcatcagtgctctaatggtcatacattgtgttccggatgcaaaccaagggttcataaccgttgtccaacttgtaggcatgaactgggtaacataaggtgtcttgctcttgagaaggtggctgcatctcttgaacttccatgcaagtaccagtgctttgggtgcccaggcatttatccttactacagncagctgaagcatgagtcgcagtgccaatatagaccttatagttgtccatatgctggatctgaatgcacagttgctggtgacatcccatattttgntgatcacttgaaagatgaccacaaagtgacatgcancatggctgtaccttncatcatcgctatgtaaagccaaccctcatgaagttgagaatgcacatggatgcttacggtattcagctgctttgncagtacttctgcctacacttcgaggccttcagctgggcatgtcacccgtctacatcgcctttctgaggttcatgaaagacgacccggaaccgaaaactacagctacagcctggaggtagggggcacgggcgcaaaatg

SEQ ID NO: 18845 - protein, 120 aa, Zea mays
  misc_feature: Ceres CLONE 1385435-F
  misc_feature (36)..(121): Pfam Name: Sina Pfam Description: Seven in absentia protein family
  misc_feature (67)..(67): Xaa is any aa, unknown, or other
  misc_feature (99)..(99): Xaa is any aa, unknown, or other
  misc_feature (111)..(111): Xaa is any aa, unknown, or other
  misc_feature (116)..(116): Xaa is any aa, unknown, or other
MYPPIHQCSNGHTLCSGCKPRVHNRCPTCRHELGNIRCLALEKVAASLELPCKYQCFGCPGIYPYYXQLKHESQCQYRPYSCPYAGSECTVAGDIPYFXDHLKDDHKVTCXMAVPXIIAM

SEQ ID NO: 18846 - DNA, 677 bp, Zea mays
  misc_feature: Ceres CLONE 1385436-F
  misc_feature: Encodes the peptide sequence at SEQ ID NO. 18847
  misc_feature (385)..(385): n is a, c, t, g, unknown, or other
  misc_feature (388)..(388): n is a, c, t, g, unknown, or other
  misc_feature (575)..(575): n is a, c, t, g, unknown, or other
ggagctccccgcggtggcggccgctctagaactagtggatcccccgggctgcaggaattcgcacgagaccattacctagaacatcctaatcgaaaaacggttcttgttcttcttcccacccagcgtgcgctccctcttcctcttccccttctctctcggcgacgactgggtggccgtagctgcctccatacgcctggtgccctggtcttcttcgggccattcgccggccgcgagcaccaccaaaagggagagcttcccaggtagagctgtttctccgtactctagcagatggcaaggataaagcctaagcaattgctaaatccaagcaaaacaaagaaggctccatctcgaatcagctactctactatcatcacatggaacttgnatngtcatattggttgtgctatctctctatgctacctacagccattggcatcaaaggtctgcccaagacttcgaaatggagcttcatgaagctgagcttgctgtgagaccggagggatcaaaaatggatagtagaccaagatatgcggtaatgaacaccggcaaaggcccaattactatagaaatatacnaggatgcttctgctgacgtgggggaagatttatcaactggtgcaagagtaatcattttcaagggatgggcatttcggcatatcataaaaaattttggtagtg

SEQ ID NO: 18847 - protein, 72 aa, Zea mays
  misc_feature: Ceres CLONE 1385436-F
  misc_feature: SWISSPROT Homolog: EC 5.2.1.8 Peptidylprolyl isomerase
  misc_feature (39)..(39): Xaa is any aa, unknown, or other
MELHEAELAVRPEGSKMDSRPRYAVMNTGKGPITIEIYXDASADVGEDLSTGARVIIFKGWAFRHIIKNFGS

SEQ ID NO: 18848 - DNA, 666 bp, Zea mays
  misc_feature: Ceres CLONE 1385437-F
  misc_feature: SWISSPROT Homolog: EC 3.6.3.14 H(+)-transporting two-sector ATPase
  misc_feature (198)..(198): n is a, c, t, g, unknown, or other
gctctagaactagtggatcccccgggctgcaggaattcgcacgagaccattacctagaacatcctaatcgaaaatcggtgctcttcaagagcgaatcacaaccaccaagaaaggttccatcacctcagtgcaagccatctatgtccctgctgatgatttgacagatcctgctcctgccacaacctttgcccacttggnatgcacaaccgtgctttccagacagattcccgagcttggtatctatcctgctgtggatcctctggattcacatcccgtatgctctcacctcacattctgggtgaggagcactaccacacggctcgtggtgggcagaaagtgctacagaattacaggaatttgcaagataatattgcccattttgggaagggatgacctaagtgaaaatgacaagctgactggtgcccgggcccgtaagatccagagattcttgagtcacccattccacgttggtgaaatcttccctgggggcccctggaaaataccttgaccttaaaggaaaacttccaccgtttcaagggtctgctccatggaaagtccaatgatcttccctgaacaatcgttttacatggggtgggggcatccaaccaggggggttgcaaaagcaaaaaaaaatcccccaggggaggccccagctttaagggcttt

SEQ ID NO: 18849 - DNA, 656 bp, Zea mays
  misc_feature: Ceres CLONE 1385439-F
  misc_feature: Encodes the peptide sequence at SEQ ID NO. 18850
  misc_feature (296)..(296): n is a, c, t, g, unknown, or other
  misc_feature (319)..(319): n is a, c, t, g, unknown, or other
  misc_feature (358)..(358): n is a, c, t, g, unknown, or other
tccccgcggtggcggccgctctagaactagtggatcccccgggctgcaggaattcgcacgagaccattacctagaacatcctaatcgaaaaatggaatcctgtagcttccgtgccgcaaccgcgccttctccctttccctccgctccttcttcatcttcatccccgcgcgccccatgccccatactccgatttcccaggccaagaaaagggaggcagattggggtgcggaggagggcgtccggatttgatgccttcgcgtctttcgccggcaggtcttcgtggatgaggcgattgnagcggaatatggggagggcttcnaaacatttcgaatggatggaccactcagggttgatgtgnattatctggatgaaaaattggcagagtgcttccttcaaaggatagggcatgctatgaagccggatgaggcgtttggtctaattttttcgggggacaatggtatggctgatacagactcgctaaagttgaatgcttggagacaacttgctttggaggaaggtaggatatcccagtggtgctcatggccggaagacattattcatggggctgctgacatggtcttaaaaaggtttgtactgggcaaagaggaagataaatggaaaattgaaggacgccttataggagtggactaccagac

SEQ ID NO: 18850 - protein, 108 aa, Zea mays
  misc_feature: Ceres CLONE 1385439-F
  misc_feature (10)..(10): Xaa is any aa, unknown, or other
MDGPLRVDVXYLDEKLAECFLQRIGHAMKPDEAFGLIFSGDNGMADTDSLKLNAWRQLALEEGRISQWCSWPEDIIHGAADMVLKRFVLGKEEDKWKIEGRLIGVDYQ

SEQ ID NO: 18851 - DNA, 660 bp, Zea mays
  misc_feature: Ceres CLONE 1385444-F
  misc_feature: Encodes the peptide sequence at SEQ ID NO. 18852
gctctagaactagtggatcccccgggctgcaggaattcgcacgagaccattacctagaacatcctaatcgaaaacaaacaaaaaccctagccgccgcgccgccccgctccctagtggtcctccctcccccaccactgcagctccgtcccggcggccccaagagttgcggcgaggatgaacgtgaagggcggcagccggattccggtaccccctccgggggccagcgcgctggtcaaggtggccgtgttcggcggcgccgccgtgtacgctggcgtgaacagcctctacaacgtcgagggtgggcaccgcgccatcgtcttcaaccgcatccaggggatcaaggacaagggataccccggagggactcactttatgattccatggtttgaacgaccaatcatttatgatgtccgggctccaccgaatcttggtgagaggacttctggggagtcgggatcttcagatggtggaaatttggcctccgtggtcctaccaaggcctatggcagagagggtaccacatatctacggaactctgggagagaacttcaatgagaggggttttgccttcaatcatccatgaaaacctggaaggctgttggtgctccatataaagggtagcgcagtgatcccaccaaagagaaacttgggagtagggaaa

SEQ ID NO: 18852 - protein, 135 aa, Zea mays
  misc_feature: Ceres CLONE 1385444-F
MNVKGGSRIPVPPPGASALVKVAVFGGAAVYAGVNSLYNVEGGHRAIVFNRIQGIKDKGYPGGTHFMIPWFERPIIYDVRAPPNLGERTSGESGSSDGGNLASVVLPRPMAERVPHIYGTLGENFNERGFAFNHP

SEQ ID NO: 18853 - DNA, 692 bp, Zea mays
  misc_feature: Ceres CLONE 1385446-F
  misc_feature: Encodes the peptide sequence at SEQ ID NO. 18854
  misc_feature (367)..(367): n is a, c, t, g, unknown, or other
aaagctggagctccccgcggtggcggccgctctagaactagtggatcccccgggctgcaggaattcgcacgagaccattacctagaacatcctaatcgaaaaaacctctgacgatcaccatcgccgctagcctccaccaccaacttcccatcgcctccccctcatctccccacactcctgacctcacctctccgaactgcagcacctcccctcccgccacccacacgtgctcccatggccgccaccgcgatctcagtccgcctccacccaaaccgccgggcgccatgtgggctccgcccgccgcgccccgctcggggccgtccgcgcgcaatccgccccgccggcggcggccgcggccctaacccangaccacctccagcgtgtggggccggtgcccgcccccaagaaagggaaaaggggatggtgtccggtttggaaaggttccacgggcgcctttccgtacccaaaaatggccggccctggcccggggaaaatcaaaaaaacgggggggggccccaatccaagggccctcttgaagaaggggagcctctgggatcccccctccccccccggaaaaaaacaccggtttgaaacctcccccttagagggggcagaaagaggggcccccgccccccccggggaaagggggggggggggcctcctttctggaaaaaggaggcgcagcccccccg

SEQ ID NO: 18854 - protein, 74 aa, Zea mays
  misc_feature: Ceres CLONE 1385446-F
MAGPGPGKIKKTGGGPNPRALLKKGSLWDPPSPPGKKHRFETSPLEGAERGAPAPPGERGGGGLLSGKRRRSPP

SEQ ID NO: 18855 - DNA, 862 bp, Zea mays
  misc_feature: Ceres CLONE 1385448-F
  misc_feature: Encodes the peptide sequence at SEQ ID NO. 18856
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (36)..(36): n is a, c, t, g, unknown, or other
  misc_feature (44)..(44): n is a, c, t, g, unknown, or other
  misc_feature (725)..(725): n is a, c, t, g, unknown, or other
nnnnnnccccccccnnnnnnnnnggcggcggggganaatgaganataaaaaaaactggcgctccccgcggtggcggccgctctagaactagtggatcccccgggctgcaggaattcgcacgagacccattacctagaacatcctaatcgaaaaaaaaatccccacgcagaaaacctagcagctcggcgctccctcttctggactccttcgagggtactcccatcggctatcgaccgggccctcgagggcgggagagggggggacaggagaccccagttggaggtgaggcccctaccccgggcctgggggagccgatggaatggaggactgctctgcagcttggcctggaagaaaggcgggggctcatgaatggccttgggtaaggggccttcgggggggggtgggcaaagggaattggagaaagggcggcggcgtcacccttttggggggggggggggggggggaatgggggaaccccgccctggattaatggggcacgggttgggggggaaggggggtgttttggggtctggggagggacaaaaaggggtggccccccggggggggtgagggggggggggggcggaaggggggcgcaaaaaaagaggcctcttggggggggcaaagaagggagggctcgcggggggggttcgggtgcgctcggccaggggccgggggcctgcgcgggtcgggggcggggggggcggggggggggggggcggggngggcggggcggtcgcggggggtggaggggggccggggggggtgcggggcgggccgccggggggggggggggggcgagcgctggagcggggagccgggacggcccccggcgcggggccctcgcccggcggggggcggg

SEQ ID NO: 18856 - protein, 66 aa, Zea mays
  misc_feature: Ceres CLONE 1385448-F
MALGKGPSGGGGQRELEKGRRRHPFGGGGGGGMGEPRPGLMGHGLGGKGGVLGSGEGQKGVAPRGG

SEQ ID NO: 18857 - DNA, 675 bp, Zea mays
  misc_feature: Ceres CLONE 1385449-F
  misc_feature: Encodes the peptide sequence at SEQ ID NO. 18858
gctctagaactagtggatcccccgggctgcaggaattcgcacgagaccattacctagaacatcctaatcgaaaactttcgtcaactccacttctcttctccgcgtcacctcctcttcgccgccgccgacgcttcaccggccagccagccatggatgaggagtacgacgtgatcgtactaggcacggggctcaaggagtgcatcctcagcggtctcctctctgtggacggcctcaaggttttgcatatggacagagatgactactatgggaggagattccacctcgctcaaccttaatcagctctggaagaggtttagagggggaagacaaggcccccagcacatctaggtggaaggagagactacaatgtgggacatgggtgccaaagttttatgatgggcaaatgggacattgggttcaaaccctcatcccacaccgacgtgacaaagtacttgtcattcaaaggtggtgaggggaactattgtttcagaaagaggaagatttacaaggtccctgccactgatatggaggctcctgaagccccctttggaggggccttattcaagaagcgcagagcgagggaacttctttcttttatggccaagattacaatggaagctggtcccagggacacatcaggggtgtggcccttactaggggggacaactaagagag

SEQ ID NO: 18858 - protein, 48 aa, Zea mays
  misc_feature: Ceres CLONE 1385449-F
MDEEYDVIVLGTGLKECILSGLLSVDGLKVLHMDRDDYYGRRFHLAQP

SEQ ID NO: 18859 - DNA, 662 bp, Zea mays
  misc_feature: Ceres CLONE 1385451-F
  misc_feature: Encodes the peptide sequence at SEQ ID NO. 18860
  misc_feature (285)..(285): n is a, c, t, g, unknown, or other
  misc_feature (341)..(341): n is a, c, t, g, unknown, or other
  misc_feature (355)..(355): n is a, c, t, g, unknown, or other
  misc_feature (377)..(377): n is a, c, t, g, unknown, or other
  misc_feature (432)..(432): n is a, c, t, g, unknown, or other
  misc_feature (463)..(463): n is a, c, t, g, unknown, or other
tccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcangagagagatagcaggggggctagctagctgagctcgtgcgacgaagatggccgaantgccaggaacatgntcgcgccgctcctggtgctcancctcatcatgtacatcatcgtcatcggcttcgcgagctgaaacctggaacacttncatcacgggcagaacaactaccccggcgtgnccgcaacgccgcgacgttctacttccctggtgtcccatcctggccgggcgtgtgggcgcggcgtcaagctgggcgggcgtgcaccacgtgcgcgcctggggccacgacagcctggccaccaacgccgggtcgtcgctcatcgcctggggcatcacggggctccgctttcggtttggctggaaggaaaccacatcggggg

SEQ ID NO: 18860 - protein, 110 aa, Zea mays
  misc_feature: Ceres CLONE 1385451-F
  misc_feature (4)..(4): Xaa is any aa, unknown, or other
  misc_feature (8)..(8): Xaa is any aa, unknown, or other
  misc_feature (16)..(16): Xaa is any aa, unknown, or other
  misc_feature (34)..(34): Xaa is any aa, unknown, or other
  misc_feature (44)..(44): Xaa is any aa, unknown, or other
MAEXPGTXSRRSWCSXSSCTSSSSASRAETWNTXITGRTTTPAXPQRRDVLLPWCPILAGRVGAASSWAGVHHVRAWGHDSLATNAGSSLIAWGITGLRFRFGWKETTSG

SEQ ID NO: 18861 - DNA, 671 bp, Zea mays
  misc_feature: Ceres CLONE 1385452-F
  misc_feature (393)..(393): n is a, c, t, g, unknown, or other
  misc_feature (641)..(641): n is a, c, t, g, unknown, or other
aagctggagctccccgcggtggcggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtagagtttcgtttctgttagtactctaatcaacggacaacggtttctgttagtattctttgggtcatggctgtctgcagattgtcgcccttgctctggctgctctattcggcctcagntcattctgtcgtaaacctcacctcgtaactgaaataaccatatgcgccgcgcgtcgaagcttagtgtctgatcgatacgctatccctacaattttctgagctgttgaactcctgggcccgtctcctcgtcgaggacaggagatgagctcgctacacgcacacgagcggagcttggcctggttgtcctgtacctgaacaaagcggaggcccgggacagatctgcagggcgatccagtacgggctccagntcgaaagcaacgggcagcctggcactggga

SEQ ID NO: 18862 - DNA, 676 bp, Zea mays
  misc_feature: Ceres CLONE 1385456-F
  misc_feature: Encodes the peptide sequence at SEQ ID NO. 18863
  misc_feature (335)..(335): n is a, c, t, g, unknown, or other
  misc_feature (353)..(353): n is a, c, t, g, unknown, or other
  misc_feature (358)..(358): n is a, c, t, g, unknown, or other
  misc_feature (381)..(381): n is a, c, t, g, unknown, or other
  misc_feature (438)..(438): n is a, c, t, g, unknown, or other
  misc_feature (439)..(439): n is a, c, t, g, unknown, or other
  misc_feature (581)..(581): n is a, c, t, g, unknown, or other
tccccgcggtggcggccgctctagaactagtggatcccccgggctgcaggaattcgcacgagaccattacctagaacatcctaatcgaaaacacatagtactagaaaaatggccatggcagccgccaccgcgaatgccatcttgctcttggctctcttcttcgccggcgctcacgcgaatgtcccatgcatactccccgtatgcaagacggtgggtggcggaagccggttcttcgacgtgcagttctgcctggcggcactcggctccgatggccggagcgtcgaccactgcctcgactaacaggtctactccgccagttgcgctgacctcctcgncggcaacctcaccgctancgcgnccaagatcaacggcctgctccgnaaaagagcgcgctcccccgacgagggcacgacgcgctgtctccggtcctgtcaggcnngtgtacgcgacatgaaacggaggcagactggctgcgcggctgccgtccggggcgtcaggaagggtgaggccaccaggtgcttgggaggaagtcgcgtcagctgctgaggagtgcgaggaccggttccagaggagcaaggtgncgtccccggtgatgggcgagaaaccagcaggtggtcaagctcgccaagctccctggtcgcgctggttgcgcaacggtgtatgctagatgaaatag

SEQ ID NO: 18863 - protein, 63 aa, Zea mays
  misc_feature: Ceres CLONE 1385456-F
MAMAAATANAILLLALFFAGAHANVPCILPVCKTVGGGSRFFDVQFCLAALGSDGRSVDHCLD

SEQ ID NO: 18864 - DNA, 692 bp, Zea mays
  misc_feature: Ceres CLONE 1385459-F
  misc_feature: Encodes the peptide sequence at SEQ ID NO. 18865
  misc_feature (254)..(254): n is a, c, t, g, unknown, or other
  misc_feature (338)..(338): n is a, c, t, g, unknown, or other
  misc_feature (692)..(692): n is a, c, t, g, unknown, or other
tccccgcggtggcggccgctctagaactagtggatcccccgggctgcaggaattcgcacgagaccattacctagaacatcctaatcgaaaaaccaccaaaccaatcgctggatttgtccagagtatttccggtttcaccgccctagatctgacccgagacgccgcgtcttcgctgagatggcgattactgtgaggcggtcgacgatggtgcgcccggcgcgggagacgccgcggcagcggctgtggaactcccnacctcgacctcggtggtgccgcgcttccacacgcccagtgtctacttctaccgccgcgacggccccgtgccggatgcggagggnttcttcgacggcgaggggatgcggcgcgcgctggcagaggccctcgtgcccgtctatccaatggcgggcccgctcccgcgggacgaggaccgaaggttccagatcgactgcaatggggagggattgttcttcctccaggcccacgcgcccgatgcctctggcgatgactacgggggacttcccgcccaccatgggagtcaaggggcctcatccccgaccgtcgaataacccggacgaacttctcggccttcttccttactcggggctccaggggggacttattttccaagtgggggggggccccccccccttgggggttgggcattgcaaacccccttgggcgggggagtgggn

SEQ ID NO: 18865 - protein, 69 aa, Zea mays
  misc_feature: Ceres CLONE 1385459-F
  misc_feature: SWISSPROT Homolog: EC 2.3.1.144 Anthranilate N-benzoyltransferase
MRRALAEALVPVYPMAGPLPRDEDRRFQIDCNGEGLFFLQAHAPDASGDDYGGLPAHHGSQGASSPTVE

SEQ ID NO: 18866 - DNA, 779 bp, Zea mays
  misc_feature: Ceres CLONE 1385460-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (571)..(571): n is a, c, t, g, unknown, or other
nnnnnnnnnnnnnnnnnnnnccactttcatnnnnaaatgtgcgctccccctgcccaagctggagctccccgcggtggcggccgctctagaactagtggatcccccgggctgcaggaattcgcacgagaccattacctagaacatcctaatcgaaaaagtccaaacctttcgatccgtggtgtgttggatctgaacccaagctccgagtcgctttcggggtgggcattctcctcttcgtcttcggttgcaagaaagaaaaagcatcatggacggcttccccaagagcgtcggcggtgacggccctaacattccggcgggatcccaccccggcaggcggaagccaggcggcggcaggaggaggcgcgaacgcagcggacgcactatcccgtatggtgactggtaattcagtcattgccttgaaatacaaaggatggtggtgatcatgggcatgtgacactggaagccctcctttatggatccaactttgaagaaaacaagagggggggaaccgccattaaaggcagttggcaaaggcataaccatccttttgaagcaaagcggagaagttcangtggacttttcccaggaagatttttgcgcctattttggatgaaactaaccccctggcctgaaccatatgggggggatggatgggagaactccgtctgggccccccaaaggaagaacccccaagttattttggagcaagaaggggtgtttaaaaccccgggggaaaaaaaaggtttgtaatccctccctccgggaaacttccctttggg

SEQ ID NO: 18867 - DNA, 671 bp, Zea mays
  misc_feature: Ceres CLONE 1385461-F
  misc_feature: Translation starting site: 183
  misc_feature (269)..(269): n is a, c, t, g, unknown, or other
  misc_feature (421)..(421): n is a, c, t, g, unknown, or other
  misc_feature (437)..(437): n is a, c, t, g, unknown, or other
  misc_feature (438)..(438): n is a, c, t, g, unknown, or other
  misc_feature (492)..(492): n is a, c, t, g, unknown, or other
tcaccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccacccgggtgcgaacggaagggtgcggggctaccgcgacctcccagcgcggggcggcatgcacggcgaggcgcancaacagcagaagcagggcgccatgatgacggcgctcaaggccgcgacggccgcgaccttcggcgggtcgatgctggtgctgtcccggctgatcctggccggcacgtgatcgcgctcacggtggccacccccgtgctgtgatctcagcggggntttggggggccggccnncatcccgctgggctcatggggggccgggttcctcacctcggggggcctcggggncctggggctgtccggttcctctgggatggacaagaacctggagggaaaggaaccgccgggggccgaacagttggaccaggcaaaggggagggttgggtccaagggccgcgaaattcagggtggcgccccggcaccgatcgaccaggggggaggggtttttgaaaaaaaaccccccctcg

SEQ ID NO: 18868 - DNA, 672 bp, Zea mays
  misc_feature: Ceres CLONE 1385462-F
  misc_feature: Encodes the peptide sequence at SEQ ID NO. 18869
  misc_feature (263)..(263): n is a, c, t, g, unknown, or other
  misc_feature (468)..(468): n is a, c, t, g, unknown, or other
tccccgcggtggcggccgctctagaactagtggatcccccgggctgcaggaattcgcacgagaccattacctagaacatcctaatcgaaaaactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggncgcccgatgggtgagcaggtgaagggcatgctccacgacaaggggccgacggcgtcgcaggcgctgacggtggtgacgctgttccccgctgggcggctgctgctggtgctgtcggggctggcgctgacggcctccgtggtggggctggccgtggccacgccggtgttcctgatcttcagccccgtgctcgtccccgccgcgctgntcatcgggacggccgtcatggggttcctcacgtcgggcgcgctggggctcgggggcctgtcctccctcacgtgcctcgccaaaagggggggggaggggttccagcgcaccccggactacggggaggaggcccaccgcaggatgggggaggccggcgccccacccggcccacaaaccgcggaggcaggccagcccttcagggggg

SEQ ID NO: 18869 - protein, 163 aa, Zea mays
  misc_feature: Ceres CLONE 1385462-F
  misc_feature (44)..(161): Pfam Name: Oleosin Pfam Description: Oleosin
  misc_feature (96)..(96): Xaa is any aa, unknown, or other
MADRDRSGIYGGAHATYGQQQQQGGGGRPMGEQVKGMLHDKGPTASQALTVVTLFPAGRLLLVLSGLALTASVVGLAVATPVFLIFSPVLVPAALXIGTAVMGFLTSGALGLGGLSSLTCLAKRGGEGFQRTPDYGEEAHRRMGEAGAPPGPQTAEAGQPFRG

SEQ ID NO: 18870 - DNA, 667 bp, Zea mays
  misc_feature: Ceres CLONE 1385463-F
  misc_feature (261)..(261): n is a, c, t, g, unknown, or other
gctcaaaactagtggatcccccgggctgcaggaattcgcacgagaccattacctagaacatcctaatcgaaaaagcgacagatatcttcgactcctcgttcgtggttccccatcgtcatcgccatggatttctcttaggctcacccgtccgctcggctcgcttccttccccactctctctgatcccgtcgcacttccctcctcgctgcagcccctctactattgcgattaccgtttcctcgctgccctttcctttttcggncgggagaaatcaccgggggcaagcgaaccctcgatttgcgtccccgctctctgctagcgcccctaaaagagaagcgaaacgatgtctatggcgaagaccgttcagggcgcggaagaaggatgaccaacaacagcccccgaggaatagcactgatggagggcatctggcccggggggaaccgcaaggccaaaaaacacgccctggcccctcaaggagggtcctctacttggggatcgggtggaggaagcattcaaaaaggacccctcccaagagtttggaacatccccctatattttggatcggtgcgaagagcacgggaacccaagtattttcccgggtgaatttaataacaaaaaaaagacgaaggttctttgtaattccccgaaaacttggttttggtataaaa

SEQ ID NO: 18871 - DNA, 660 bp, Zea mays
  misc_feature: Ceres CLONE 1385468-F
  misc_feature: Translation starting site: 280
  misc_feature: SWISSPROT Homolog: EC 1.1.1.1 Alcohol dehydrogenase
  misc_feature (158)..(158): n is a, c, t, g, unknown, or other
  misc_feature (201)..(201): n is a, c, t, g, unknown, or other
  misc_feature (202)..(202): n is a, c, t, g, unknown, or other
  misc_feature (226)..(226): n is a, c, t, g, unknown, or other
  misc_feature (227)..(227): n is a, c, t, g, unknown, or other
  misc_feature (401)..(401): n is a, c, t, g, unknown, or other
  misc_feature (409)..(409): n is a, c, t, g, unknown, or other
  misc_feature (428)..(428): n is a, c, t, g, unknown, or other
  misc_feature (431)..(431): n is a, c, t, g, unknown, or other
gctcaaaactagtggatcccccgggctgcaggaattcgcacgagaccttacctagaacatcctaatcgaaaacaggctcatctcgctttggatcgattggtttcgtaactggtgagggactgagggtctcggagtggattgatttgggattctgttcnaaagattgcggaggggggcaatggcgaccgcggggaagtgatnncagtgcaagcttgcgtggcatggnnaggcggcaagccactgtcgatcgaggaggtggaggtagcgccctcgcaggccatgggaggtgcgcgtcaagatcctctttcactcgttctgccacaccgacgtctacttctgggaggccaggggcagactcccgtgttccctcggatcttggccacgaggctggagtatcatanagagtgtnggagagggtgtgactgacntanctcccggcgacatgtccttcctgtgtcactggggagggcaggagtgggccactgcaagtcggaaaagagcacatgtgtgatctgctcaggatcaacaccgaccgggggtgtgatgattgcccatggcaaagtcccggttttccatcaaggggacccctatctaccccgtttggtggaacttccaccttcaacgagtaaccgtcatgggattggggggttgtggttccaa

SEQ ID NO: 18872 - DNA, 651 bp, Zea mays
  misc_feature: Ceres CLONE 1385471-F
  misc_feature: Encodes the peptide sequence at SEQ ID NO. 18873
  misc_feature (360)..(360): n is a, c, t, g, unknown, or other
  misc_feature (421)..(421): n is a, c, t, g, unknown, or other
  misc_feature (483)..(483): n is a, c, t, g, unknown, or other
  misc_feature (484)..(484): n is a, c, t, g, unknown, or other
aaagctggagctccccgcggtggcggccgctctagaactagtggatcccccgggctgcaggaattcgcacgagaccattacctagaacatcctaatcgaaaaccctcacactcccatccagccgccaccaggtgcagagtctttcgtcatctcttctccggcgaagaacccccagtcgcccaccagatcacttgttaaactttgttgaggggtgatggcggtttctttcgcaaacctcaactccgaggcagggcttaaaaagcttgatgagtaccttctcactcgcagctacatcactggctaccaagcttccaaggatgacttggctgtctacacttcgttttcggctgctccctcgtncaagtatatcaacgtagcaggggtggtttaaccacatggatgcgctcgtgaggctgagcgnaattactgcagaggggccagggtgtgaaggttgaaatcctcagcagttctttcagccccaannctcagatgtgctgaagcacagggcccagttgctgaggaggacgacgacgatgatgttgacctttttggtgaggagacgaaaatgaaaagaaggctgctgaagagcgtgctgcagctgccaaggtttctggcaagaaaaagaatctgggaagtcatcagttttacttg

SEQ ID NO: 18873 - protein, 58 aa, Zea mays
  misc_feature: Ceres CLONE 1385471-F
  misc_feature (49)..(49): Xaa is any aa, unknown, or other
MAVSFANLNSEAGLKKLDEYLLTRSYITGYQASKDDLAVYTSFSAAPSXKYINVAGVV

SEQ ID NO: 18874 - DNA, 685 bp, Zea mays
  misc_feature: Ceres CLONE 1385472-F
  misc_feature: Encodes the peptide sequence at SEQ ID NO. 18875
  misc_feature (353)..(353): n is a, c, t, g, unknown, or other
  misc_feature (428)..(428): n is a, c, t, g, unknown, or other
  misc_feature (685)..(685): n is a, c, t, g, unknown, or other
tccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgcntgtccggctgatcctggccggcaccgtgatcgcgctcacggtggccacccccgtgctggtgatctcagccggggnttgggggggccggccgccatcgcgctggggctcatggggggccgggtttctcaccctccgggggcctcggcgtcgctgcgcctgtccgtgttctcctgggatggacaagtacctggacgggcaagcccccgccggggggccgaccaggtgggaccccccaaggggaaggttggcgtcccaagggcccccgacatccagggaggcagcacagccccgcatcgaacaagggggagggggtccttgaaaaaaaaaccccn

SEQ ID NO: 18875 - protein, 161 aa, Zea mays
  misc_feature: Ceres CLONE 1385472-F
  misc_feature (56)..(56): Xaa is any aa, unknown, or other
  misc_feature (81)..(81): Xaa is any aa, unknown, or other
MADHHRGATGGGGGYGDLQRGGGMHGEAQQQQKQGAMMTALKAATAATFGGSMLVXVRLILAGTVIALTVATPVLVISAGXWGGRPPSRWGSWGAGFLTLRGPRRRCACPCSPGMDKYLDGQAPAGGPTRWDPPRGRLASQGPPTSREAAQPRIEQGGGGP

SEQ ID NO: 18876 - DNA, 672 bp, Zea mays
  misc_feature: Ceres CLONE 1385477-F
  misc_feature: Encodes the peptide sequence at SEQ ID NO. 18877
  misc_feature (672)..(672): n is a, c, t, g, unknown, or other
cgctctagaactagtggatcccccgggctgcaggaattcgcacgagaccattacctagaacatcctaatcgaaaactgctccatttgtcctccaactatttcgccgcaaaggcctctagaagcaatcaggcgagcggcggctgcggcgcgatgggagagcaggtcgtgacggagcgtatccagcggaagctggaggaggccaacgctaccgtccaacagcacctcgccggcatccaggaccacgtcaacttcaccatgcagcaggcatacttcaagtgcgcatatgattgcttcgatcggcggcgtactcaggaagcgatcaacaattgggtggagaatggtggtatgcctgtccttgctgcaacaatgtttttgagagggagatggccagtttcaggacgggtgaaccggtcattgatgggctggcagataagttttgagctgccaagctccagaagatgaaacagatgcgactcagggagctgggatcctgtgtcaacggatctatcgaggacggcatcggggccctcccctatgggggggcaaaagatgaaccccccctcaatatcaattagagggcaaatttacctttagcatatggaacccgatatgggttgaggaatgtttcaaaattcccattccaggcataaggctcaccttttccggggaaan

SEQ ID NO: 18877 - protein, 103 aa, Zea mays
  misc_feature: Ceres CLONE 1385477-F
  misc_feature (10)..(102): Pfam Name: DUF842 Pfam Description: Eukaryotic protein of unknown function (DUF842)
MGEQVVTERIQRKLEEANATVQQHLAGIQDHVNFTMQQAYFKCAYDCFDRRRTQEAINNWVENGGMPVLAATMFLRGRWPVSGRVNRSLMGWQISFELPSSRR

SEQ ID NO: 18878 - DNA, 709 bp, Zea mays
  misc_feature: Ceres CLONE 1385479-F
  misc_feature (271)..(271): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (286)..(286): n is a, c, t, g, unknown, or other
  misc_feature (424)..(424): n is a, c, t, g, unknown, or other
  misc_feature (494)..(494): n is a, c, t, g, unknown, or other
ggagctccccgcggtggcggccgctctagaactagtggatcccccgggctgcaggaattcgcacgagaccattacctagaacatcctaatcgaaaaacaaacccaacttccaccagacccctaaccttttcgcagctccagcgcacagccgccgccgtttcttcatcttcttcgcagagccggcgctccatcttcggctccctcccttacttgcgctcggcacgcaggcggcgctgtgggctcggatctcagtgacgggatcaggggcttnccnnntccgctctcngcagtcgcctccggtcctccgcacaccggccggtgatctctctcctcccgcctccggtggatcgtcaacggcgcccgggcccggcggctgcgtcgcgcgcgtcctgagggcagctgcaggcgctgctcgactaaggcngtcgcggcgctttgggagcggttatgccccaaagtgagcgtgctcttagtgcggctctttggaccctggnaatgctactgctggtaatggctcaaccttcagcatctagcaactgcagttatgatcacacatcagatttgggaagccagacggtcgctgttaccgcactatcagatcagactctcaagtaatcgccttgagaaaaccctgacaagcggtcttactggctgtggaaatctcatatccgctttttgacgcaactcaaaaagccctcagcggtattaa

SEQ ID NO: 18879 - DNA, 755 bp, Zea mays
  misc_feature: Ceres CLONE 1385483-F
  misc_feature: Encodes the peptide sequence at SEQ ID NO. 18880
  misc_feature (344)..(344): n is a, c, t, g, unknown, or other
  misc_feature (392)..(392): n is a, c, t, g, unknown, or other
  misc_feature (393)..(393): n is a, c, t, g, unknown, or other
  misc_feature (447)..(447): n is a, c, t, g, unknown, or other
  misc_feature (496)..(496): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (732)..(732): n is a, c, t, g, unknown, or other
  misc_feature (734)..(734): n is a, c, t, g, unknown, or other
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtaacagccacggccggggcggaggacggagtggtcgaacgggaccgcaaggagggactgcggtggtgcaagcangcgtgcgagtggcagtacgaaaaggacaccccgcggaagagggatgcnnagagcgagtgccgcgagcggcaccagcaagctgacgcgggcgaggacggcgacngcggcgtggacgcctacgtctcccgctccggaagggggcaagtgccggngcagtgcctgcgccgccacgaggggcaggccggggaaaacccaggagtgcatgaggcgggtgccccccccggggattgcccgtccactggaaacaaagataagggcccggcaacgaagaggggggcaaatgtgccgggagaaggggcgaaccccccaccccggggggaatgggggggaaagggcacccttcctggaggactgcaaaaaaccgcggggggnnnaaaaaaaaannncncncaccccccccccgaccgcgag

SEQ ID NO: 18880 - protein, 184 aa, Zea mays
  misc_feature: Ceres CLONE 1385483-F
  misc_feature (47)..(47): Xaa is any aa, unknown, or other
  misc_feature (64)..(64): Xaa is any aa, unknown, or other
  misc_feature (82)..(82): Xaa is any aa, unknown, or other
  misc_feature (98)..(98): Xaa is any aa, unknown, or other
  misc_feature (172)..(172): Xaa is any aa, unknown, or other
  misc_feature (175)..(175): Xaa is any aa, unknown, or other
  misc_feature (176)..(176): Xaa is any aa, unknown, or other
  misc_feature (177)..(177): Xaa is any aa, unknown, or other
MGKGSVGASWWAFLLLAGVLLVVTATAGAEDGVVERDRKEGLRWCKXACEWQYEKDTPRKRDAXSECRERHQQADAGEDGDXGVDAYVSRSGRGQVPXQCLRRHEGQAGENPGVHEAGAPPGDCPSTGNKDKGPATKRGANVPGEGANPPPRGEWGGKGTLPGGLQKTAGGXKKXXXHPPPDRE

SEQ ID NO: 18881 - DNA, 757 bp, Zea mays
  misc_feature: Ceres CLONE 1385486-F
  misc_feature: Encodes the peptide sequence at SEQ ID NO. 18882
  misc_feature (603)..(603): n is a, c, t, g, unknown, or other
  misc_feature (607)..(607): n is a, c, t, g, unknown, or other
  misc_feature (631)..(631): n is a, c, t, g, unknown, or other
  misc_feature (636)..(636): n is a, c, t, g, unknown, or other
  misc_feature (655)..(655): n is a, c, t, g, unknown, or other
  misc_feature (700)..(700): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (714)..(714): n is a, c, t, g, unknown, or other
aaagctggagctccccgcggtggcggccgctctagaactagtggatcccccgggctgcaggaattcgcacgagaccattacctagaacatcctaatcgaaaacaactcccccggccgtcctgctcgccggcttctggctggcccctgcatccgcccagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcggggcggcatcaccgtcttcgtgcccaaggactcggcgttcgcggcgctgaagcagaccacgttcgccacctcaccagggaccagctccaggtccgctgctgctgtgccacgcgctgcccagaaactatccccnttgnccgagttccgaccggctgagcggnttctngggcccggtggccacctcngcccgggctcgcaagtacacgctgaacctcacctacgacatgggnacgnnnccgcgtgnaaaaaccccccgtgggggtctggaccccaagatcaggcagcaa

SEQ ID NO: 18882 - protein, 185 aa, Zea mays
  misc_feature: Ceres CLONE 1385486-F
  misc_feature (136)..(136): Xaa is any aa, unknown, or other
  misc_feature (144)..(144): Xaa is any aa, unknown, or other
  misc_feature (152)..(152): Xaa is any aa, unknown, or other
  misc_feature (167)..(167): Xaa is any aa, unknown, or other
  misc_feature (168)..(168): Xaa is any aa, unknown, or other
  misc_feature (169)..(169): Xaa is any aa, unknown, or other
  misc_feature (171)..(171): Xaa is any aa, unknown, or other
MEFKAGVFTVAMLAIVVLSTPAAPQKPKSPPAPRSPVVLAPAPAPAPAAPHHVDLADLLSVAGPFHTFLDYLQKTGVIETFQSQANDTKRGGITVFVPKDSAFAALKQTTFATSPGTSSRSAAAVPRAAQKLSPLXEFRPAERXLGPGGHLXPGSQVHAEPHLRHGXXXAXKNPPWGSGPQDQAA

SEQ ID NO: 18883 - DNA, 713 bp, Zea mays
  misc_feature: Ceres CLONE 1385487-F
  misc_feature: Encodes the peptide sequence at SEQ ID NO. 18884
  misc_feature (384)..(384): n is a, c, t, g, unknown, or other
  misc_feature (501)..(501): n is a, c, t, g, unknown, or other
  misc_feature (519)..(519): n is a, c, t, g, unknown, or other
  misc_feature (524)..(524): n is a, c, t, g, unknown, or other
  misc_feature (533)..(533): n is a, c, t, g, unknown, or other
  misc_feature (535)..(535): n is a, c, t, g, unknown, or other
  misc_feature (627)..(627): n is a, c, t, g, unknown, or other
  misc_feature (641)..(641): n is a, c, t, g, unknown, or other
  misc_feature (643)..(643): n is a, c, t, g, unknown, or other
  misc_feature (708)..(708): n is a, c, t, g, unknown, or other
ggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcancctcatcatgtacatcatcgtcatcggcttcgcgagctggaacctgaaccacttcatcaacgggcagaccaactaccccggcgtgcccggcaacggcgcgacgttctacttcctggntgtcgccatcctggccgncgtgntgggcgcgncntccaagctggcgggcgtgcaccacgtgcgcgcctgggcgcacgacagcctggccaccaacgccgcgtcgtcgctcatcggctggggcatcancgcgctcgccttcngnctgccctgcaaggagatcacattcggcgacaccgcggctggcgcctgcccgtgctggagccctcntcatc

SEQ ID NO: 18884 - protein, 125 aa, Zea mays
  misc_feature: Ceres CLONE 1385487-F
  misc_feature (14)..(124): Pfam Name: AWPM-19 Pfam Description: AWPM-19-like family
  misc_feature (16)..(16): Xaa is any aa, unknown, or other
  misc_feature (55)..(55): Xaa is any aa, unknown, or other
  misc_feature (61)..(61): Xaa is any aa, unknown, or other
  misc_feature (63)..(63): Xaa is any aa, unknown, or other
  misc_feature (66)..(66): Xaa is any aa, unknown, or other
  misc_feature (97)..(97): Xaa is any aa, unknown, or other
  misc_feature (102)..(102): Xaa is any aa, unknown, or other
  misc_feature (124)..(124): Xaa is any aa, unknown, or other
MAGIGRNMVAPLLVLXLIMYIIVIGFASWNLNHFINGQTNYPGVPGNGATFYFLXVAILAXVXGAXSKLAGVHHVRAWAHDSLATNAASSLIGWGIXALAFXLPCKEITFGDTAAGACPCWSPXH

SEQ ID NO: 18885 - DNA, 737 bp, Zea mays
  misc_feature: Ceres CLONE 1385489-F
  misc_feature: Encodes the peptide sequence at SEQ ID NO. 18886
  misc_feature (364)..(364): n is a, c, t, g, unknown, or other
  misc_feature (369)..(369): n is a, c, t, g, unknown, or other
  misc_feature (385)..(385): n is a, c, t, g, unknown, or other
  misc_feature (393)..(393): n is a, c, t, g, unknown, or other
  misc_feature (425)..(425): n is a, c, t, g, unknown, or other
  misc_feature (428)..(428): n is a, c, t, g, unknown, or other
  misc_feature (429)..(429): n is a, c, t, g, unknown, or other
  misc_feature (451)..(451): n is a, c, t, g, unknown, or other
  misc_feature (527)..(527): n is a, c, t, g, unknown, or other
  misc_feature (545)..(545): n is a, c, t, g, unknown, or other
  misc_feature (579)..(579): n is a, c, t, g, unknown, or other
  misc_feature (607)..(607): n is a, c, t, g, unknown, or other
  misc_feature (668)..(668): n is a, c, t, g, unknown, or other
  misc_feature (669)..(669): n is a, c, t, g, unknown, or other
  misc_feature (697)..(697): n is a, c, t, g, unknown, or other
ggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgnacganaagaaggacgacgcgntggtgcanccgcaaaccttcccgccctttcgacgctcggnggnngcgcgtccccgggcgttcgcgncctcccgggcgcagcattcctggcagcagcattccccgggtcagcatgcccggcagcggcagcagcctaccccggntcagcttgccccggagcngcagcatgcccctcctcggggggcggctcccggncttcagcggctttcggggaatgcccggntcgcccaccgccggctccgtcccggagcacgccaacaagccctgaacgccacaagggtggnnaagagaggggtgctactgttaactgaanaacgcctcctctcaatgatggagagggttcgggcttcccc

SEQ ID NO: 18886 - protein, 33 aa, Zea mays
  misc_feature: Ceres CLONE 1385489-F
  misc_feature (10)..(10): Xaa is any aa, unknown, or other
MPLLGGRLPXFSGFRGMPGSPTAGSVPEHANKP

SEQ ID NO: 18887 - DNA, 738 bp, Zea mays
  misc_feature: Ceres CLONE 1385491-F
  misc_feature: Encodes the peptide sequence at SEQ ID NO. 18888
tggagctccccgcggtggcggccgctctagaactagtggatcccccgggctgcaggaattcgcacgagaccattacctagaacatcctaatccaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacactgaaccctgctgcttatttgcagcaacaactattaccatttagccagctagctactggctactctcagcaacacaacttcttccatttaaacaatgggcgcactgaaacccgctgcttattgcagcagcaatactactacccattagccagctagctgcagcaaacgtgcttccttctgacaagcaac

SEQ ID NO: 18888 - protein, 179 aa, Zea mays
  misc_feature: Ceres CLONE 1385491-F
MATKIFSLLMLLALSTCVANATIFPQCSQAPIASLLPPYLPSIIASICENPALQPYRLQQAIAASNIPLSPLLFQQSPALSLVQSLVQTIRAQQLQQLVLPLINQVALANLSPYSQQQQFLPFNQLSTLNPAAYLQQQLLPFSQLATGYSQQHNFFHLNNGRTETRCLLQQQYYYPLAS

SEQ ID NO: 18889 - DNA, 656 bp, Zea mays
  misc_feature: Ceres CLONE 1385492-F
ggagctccccgcggtggcggccgctctagaactagtggatcccccgggctgcaggaattcgcacgagaccattacctagaacatcctaatcgaaaatttttttcgacgcgccgcccccagtccccgatccgaagctgtgcctcgtaccatttcgatccaatggcgccgaccttcaagctgtcgacggggatcaggggggttcccgggtgggaaaggtacactcccccgggggtggggggcatcagggcaaaaaaagggggggccttccccaagcccaaaaggcccccccccccggggaaccccaagtttccccggggaaaaaaataaggccccggttttccggcccccagggttttatcttcaaaggttgggtggggggaaccccccgggggggggggtggtttcccccccccgggggtttttttggaaaaaaaaaggggtttttttaaaaaaaggagggggggggggggcctttatcttggggggttttaaaaaaaggggggggaacacccccgcgggggagaaaaaaatttttttgtgttttctcccacaaaattattttttttttgggggggggggccccccctttagagaaaaaattttcgccggggggaaaaaaaaaaaggggggtaaccaccgcggggggtttttttttt

SEQ ID NO: 18890 - DNA, 724 bp, Zea mays
  misc_feature: Ceres CLONE 1385493-F
  misc_feature: Encodes the peptide sequence at SEQ ID NO. 18891
  misc_feature (565)..(565): n is a, c, t, g, unknown, or other
  misc_feature (612)..(612): n is a, c, t, g, unknown, or other
  misc_feature (613)..(613): n is a, c, t, g, unknown, or other
  misc_feature (708)..(708): n is a, c, t, g, unknown, or other
ggagctccccgcggtggcggccgctctagaactagtggatcccccgggctgcaggaattcgcacgagaccattacctagaacatcctaatcgaaaacccaagcgcccaaggcagcggagagagctagctccctcctcctcctcaggtagcgagcgagcgagctcctctgcccctctgcacacctggcctccccttctccgctgcaggaccgccgttgacgactgctccaccagtactgcgcgcgcccgcgctgcctacccttacctagccagagcgcggcgcgcgagagggagaacgaccaggaggggaggagatcgatcgatcgatcgagatagatggctttcctcaacatggagcagcagacctgggccttcaccttcggtatcctaggtcatatctctgcaatgggtgactacacaatccagattagcaccaagctcattgaccagcttgctcgtgatgacgagaaggtaaaacggaaagccaggaagcccaagcctaagaagaagcccaccgtccagccacatgaagagcccctggaattcccgagagaaccaagacgacnagccttgctactggctcctgggtggcctctgcagcctccccctatgnnttctgcagtgacccctttctccccgcacccccggcacaattggcggagtggaaagcatttctgtccgtctgaaagaaagcgagcgcttctcaggngctggagaaccagaaa

SEQ ID NO: 18891 - protein, 106 aa, Zea mays
  misc_feature: Ceres CLONE 1385493-F
  misc_feature (54)..(54): Xaa is any aa, unknown, or other
  misc_feature (70)..(70): Xaa is any aa, unknown, or other
  misc_feature (102)..(102): Xaa is any aa, unknown, or other
MGDYTIQISTKLIDQLARDDEKVKRKARKPKPKKKPTVQPHEEPLEFPREPRRXALLLAPGWPLQPPPMXSAVTPFSPHPRHNWRSGKHFCPSERKRALLRXWRTR

SEQ ID NO: 18892 - DNA, 730 bp, Zea mays
  misc_feature: Ceres CLONE 1385495-F
  misc_feature: Encodes the peptide sequence at SEQ ID NO. 18893
  misc_feature (319)..(319): n is a, c, t, g, unknown, or other
  misc_feature (338)..(338): n is a, c, t, g, unknown, or other
  misc_feature (350)..(350): n is a, c, t, g, unknown, or other
  misc_feature (365)..(365): n is a, c, t, g, unknown, or other
  misc_feature (379)..(379): n is a, c, t, g, unknown, or other
  misc_feature (462)..(462): n is a, c, t, g, unknown, or other
  misc_feature (493)..(493): n is a, c, t, g, unknown, or other
  misc_feature (524)..(524): n is a, c, t, g, unknown, or other
  misc_feature (527)..(527): n is a, c, t, g, unknown, or other
  misc_feature (538)..(538): n is a, c, t, g, unknown, or other
  misc_feature (540)..(540): n is a, c, t, g, unknown, or other
  misc_feature (560)..(560): n is a, c, t, g, unknown, or other
  misc_feature (569)..(569): n is a, c, t, g, unknown, or other
  misc_feature (574)..(574): n is a, c, t, g, unknown, or other
  misc_feature (580)..(580): n is a, c, t, g, unknown, or other
  misc_feature (581)..(581): n is a, c, t, g, unknown, or other
  misc_feature (707)..(707): n is a, c, t, g, unknown, or other
  misc_feature (708)..(708): n is a, c, t, g, unknown, or other
tggagctccccgcggtggcggccgctctagaactagtggatcccccgggctgcaggaattcgcacgagaccattacctagaacatcctaatcgaaaaacaaacaacaaatcactccgttgagccttcaccatcacctccctctctggctctctctctctctcacgcatacgaacacactctctactagtactaacctctcactaatctatatctagcagcaagcacacaccgtaacatcaaagccaacgacgacgcggggccggccgcccatggccttcacgtccttattgggcagcgacgcgaagcgaaaggtggcgntggcggaggtggcgctgcnggcggtgctgtngcggctaggcgcgcntggcgcggcgctgntggcaacgacacgcagacgcgcaccttcttctccctgcagaagaagcgacctacacggacatgaagggcatggtgctcctggntggccgcgcggccacggcccgccgctacagnctgctgcaggcgccgcgctgctgctgctgcntcnccctgctgcgnangttcatccgcccccgcgccngcctggtgntgggnctgtgnnttcttcgcgtgcgaacaaggcgctggcgaaccccctggttgggccccgtccccccccccttgtaagccccccgtcttcccaagaagggctgccccaagttgggggggatggcatttgggcccctannggcttcggagagagaaaaggcg

SEQ ID NO: 18893 - protein, 153 aa, Zea mays
  misc_feature: Ceres CLONE 1385495-F
  misc_feature (17)..(17): Xaa is any aa, unknown, or other
  misc_feature (23)..(23): Xaa is any aa, unknown, or other
  misc_feature (27)..(27): Xaa is any aa, unknown, or other
  misc_feature (32)..(32): Xaa is any aa, unknown, or other
  misc_feature (37)..(37): Xaa is any aa, unknown, or other
  misc_feature (75)..(75): Xaa is any aa, unknown, or other
  misc_feature (85)..(85): Xaa is any aa, unknown, or other
  misc_feature (86)..(86): Xaa is any aa, unknown, or other
  misc_feature (90)..(90): Xaa is any aa, unknown, or other
  misc_feature (97)..(97): Xaa is any aa, unknown, or other
  misc_feature (100)..(100): Xaa is any aa, unknown, or other
  misc_feature (102)..(102): Xaa is any aa, unknown, or other
  misc_feature (104)..(104): Xaa is any aa, unknown, or other
  misc_feature (146)..(146): Xaa is any aa, unknown, or other
MAFTSLLGSDAKRKVAXAEVALXAVLXRLGAXGAALXATTRRRAPSSPCRRSDLHGHEGHGAPGWPRGHGPPLQXAAGAALLLLXXPAAXVHPPPRXPGXGXVXSSRANKALANPLVGPRPPPLVSPPSSQEGLPQVGGDGIWAPXGFGERKG

SEQ ID NO: 18894 - DNA, 716 bp, Zea mays
  misc_feature: Ceres CLONE 1385504-F
  misc_feature: Translation starting site: 559
  misc_feature (478)..(478): n is a, c, t, g, unknown, or other
  misc_feature (506)..(506): n is a, c, t, g, unknown, or other
ccccgcggtggcggccgctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtncgcctcggcacctgcgtctacctctggntcggtccaatagcaaggtcacaagctctgcgatttgggcctaaggacagcgtatgcgcagtgcattgtcacgggaaggttcttatctttccattggcacggccctggagatgtcagattttgggatagttctcggtggaggggataaaaaaaaatggaggccccaaaaaggaactggggattacaatgaagtccatgatctggcctcggg

SEQ ID NO: 18895 - DNA, 753 bp, Zea mays
  misc_feature: Ceres CLONE 1385507-F
  misc_feature: Encodes the peptide sequence at SEQ ID NO. 18896
  misc_feature (307)..(307): n is a, c, t, g, unknown, or other
  misc_feature (344)..(344): n is a, c, t, g, unknown, or other
  misc_feature (416)..(416): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (447)..(447): n is a, c, t, g, unknown, or other
ggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgancgcgctcaaggccgcgacggccgcgaccttcggcggntcgatgctggtgctgtcccggctgatcctggccggcaccgtgatcgcgctcacggtggccacccccgtgctngtgactcgcgggnnntttnnnnggggcgccncccccttcggggttggggtcatggggggcccgggtttcgtcccctccggggggctcgggggtcgctgggctggcccgtgttcctcctggatgtccaagtacctgacgggcaagcacccgccgggcgccgaacagttgaacccgccaaggcgagggttggcgtccaaggccgcgacatcaaaggatgcagcacagcaccgcatcgaccaggggggaaggggtcttgaaagaaaaaacacacttagaggggccgggggcgcggaacctccttgaaacactggcgggggggggggaaaatgccctttaa

SEQ ID NO: 18896 - protein, 175 aa, Zea mays
  misc_feature: Ceres CLONE 1385507-F
  misc_feature (36)..(149): Pfam Name: Oleosin Pfam Description: Oleosin
  misc_feature (39)..(39): Xaa is any aa, unknown, or other
  misc_feature (80)..(80): Xaa is any aa, unknown, or other
  misc_feature (82)..(82): Xaa is any aa, unknown, or other
  misc_feature (83)..(83): Xaa is any aa, unknown, or other
  misc_feature (86)..(86): Xaa is any aa, unknown, or other
MADHHRGATGGGGGYGDLQRGGGMHGEAQQQQKQGAMMXALKAATAATFGGSMLVLSRLILAGTVIALTVATPVLVTRGXFXXGAXPFGVGVMGGPGFVPSGGLGGRWAGPCSSWMSKYLTGKHPPGAEQLNPPRRGLASKAATSKDAAQHRIDQGGRGLERKNTLRGAGGAEPP

SEQ ID NO: 18897 - DNA, 716 bp, Zea mays
  misc_feature: Ceres CLONE 1385511-F
  misc_feature: Encodes the peptide sequence at SEQ ID NO. 18898
  misc_feature (327)..(327): n is a, c, t, g, unknown, or other
  misc_feature (334)..(334): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (407)..(407): n is a, c, t, g, unknown, or other
  misc_feature (412)..(412): n is a, c, t, g, unknown, or other
tccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggcccgtgatccggctgggcgtgccngccgcgntgtgnnngcggcgcgcccaacgcgccatgtcagcggccgacctcctccccgcgggccaccggacccgtccgtnctggnagcgctgctccgcctgctggcgtccccggggcgttttctccgagtccaccgagtccacgcccaccaggcgggggcgggtattcgggctacccgcgggggccgaaccttggtggcgggggcccgcctcgggggggtcctaagccaataaggggtggaaaacacaagaaacggttgggggggggggggcccccctggacgaggcgggtttgaacccgggggccccgagcgtttccggggcccaaggcgggggccccggttaccctaataggggggggaccagaacccaccggggttatgtcccgct

SEQ ID NO: 18898 - protein, 128 aa, Zea mays
  misc_feature: Ceres CLONE 1385511-F
  misc_feature (52)..(52): Xaa is any aa, unknown, or other
  misc_feature (54)..(54): Xaa is any aa, unknown, or other
  misc_feature (56)..(56): Xaa is any aa, unknown, or other
  misc_feature (80)..(80): Xaa is any aa, unknown, or other
MPPPSANGATAAAAAARDDMSPAEARLAMMELANMVSVPMALAARDPAGRAXRXVXAARPTRHVSGRPPPRGPPDPSVLXALLRLLASPGRFLRVHRVHAHQAGAGIRATRGGRTLVAGARLGGVLSQ

SEQ ID NO: 18899 - DNA, 706 bp, Zea mays
  misc_feature: Ceres CLONE 1385514-F
  misc_feature: Encodes the peptide sequence at SEQ ID NO. 18900
  misc_feature (243)..(243): n is a, c, t, g, unknown, or other
  misc_feature (296)..(296): n is a, c, t, g, unknown, or other
  misc_feature (322)..(322): n is a, c, t, g, unknown, or other
  misc_feature (334)..(334): n is a, c, t, g, unknown, or other
  misc_feature (622)..(622): n is a, c, t, g, unknown, or other
ccccgcggtggcggccgctctagaatagtggatcccccgggctgcaggattcgcacgagacattacctagaacatcctaatcaaaaaaagagagtctgcccctccccgcgccgttctttttggttccccactccccagtccccgcccgcgccgaaacccgcagatggaggtcgtcgtcgccgcgaagcagaaggcgaaagaacacatacacctcttctactgctcagaatgcgaggagctcgnccctcagatcgccgccagctccgacgccatcgagctccaatcccatcactggnggagcttcgacgacgggtccccgaancctgtcatcaancaggcgcacgacatccgtgggcagcacgtggcggtcctgggctccttcagctcgccgtcggtcatattcgagcagatctccgtcatcttcgcgctgccccaagctatcattgcctcattcactctcgggctgcctttcttccacggggtcattcgagcgcggtgaggaggaggcgatgtccccaccgcgttcacctccgcgcgattctctcgatgatcccccaggcggggggggggctaccaggggtgtcattctacgaatccacgggctccaggagaggtctacttncggggacgacctcctgccatgcttcaaaaaagggatcccgttcctggtgaagggcctccgccagttcccggaagaaaaaaaatt

SEQ ID NO: 18900 - protein, 111 aa, Zea mays
  misc_feature: Ceres CLONE 1385514-F
  misc_feature: SWISSPROT Homolog: EC 2.7.6.1 Ribose-phosphate diphosphokinase
  misc_feature (27)..(27): Xaa is any aa, unknown, or other
  misc_feature (45)..(45): Xaa is any aa, unknown, or other
  misc_feature (53)..(53): Xaa is any aa, unknown, or other
  misc_feature (57)..(57): Xaa is any aa, unknown, or other
MEVVVAAKQKAKEHIHLFYCSECEELXPQIAASSDAIELQSHHWXSFDDGSPXPVIXQAHDIRGQHVAVLGSFSSPSVIFEQISVIFALPQAIIASFTLGLPFFHGVIRAR

SEQ ID NO: 18901 - DNA, 727 bp, Zea mays
  misc_feature: Ceres CLONE 1385528-F
  misc_feature: Encodes the peptide sequence at SEQ ID NO. 18902
aaagctggagctccccgcggtggcggccgctctagaactagtggatcccccgggctgcaggaattcgcacgagaccattacctagaacatcctaatcgaaaaataaatccaattgttccttaaaattacgactcgcacccacggacccaccaaccacgccgccgccggccggccacctttctccattctccgtcaatcgtcatcctatccgatccccaactaggcaactactccgtctcacgcctctcctgtcccctctcgccgctctcgccccgcctctgcctccgcctccgcctcctccatcgcacccagctttcctccccaccccaccgccactcctaccccgccacgtcgtgtagtcgcggcggcggatatgcaagccgccgccgccttcaaccaggcagccttcaccgtccgctcgctgcatcgccccccgaggcccctccatctagctgttgcggaggatgcttttgcggggataagaggcgcgccccttacacggccccggtgctgcgggagcctctctgtcggcgtcggcagctacgacagcgagcacactccagtatttccaagacaacaatcatgggatccctacaagcttcttggtgttgatcaagatgcatctgaagaagaggtccggagtgcacggaattttcttctaaacaatacgccggatatgaagaaaggaagaggccattgaaggtgcttatgacaagataataatgaa

SEQ ID NO: 18902 - protein, 108 aa, Zea mays
  misc_feature: Ceres CLONE 1385528-F
MQAAAAFNQAAFTVRSLHRPPRPLHLAVAEDAFAGIRGAPLTRPRCCGSLSVGVGSYDSEHTPVFPRQQSWDPYKLLGVDQDASEEEVRSARNFLLNNTPDMKKGRGH

SEQ ID NO: 18903 - DNA, 690 bp, Zea mays
  misc_feature: Ceres CLONE 1385539-F
  misc_feature: Encodes the peptide sequence at SEQ ID NO. 18904
  misc_feature (262)..(262): n is a, c, t, g, unknown, or other
  misc_feature (332)..(332): n is a, c, t, g, unknown, or other
  misc_feature (333)..(333): n is a, c, t, g, unknown, or other
  misc_feature (349)..(349): n is a, c, t, g, unknown, or other
ggagctccccgcggtggcggccgctctagaactagtggatcccccgggctgcaggaattcgcacgagaccattacctagaacatcctaatcgaaagatctggctgcctcggtcgatttctaattctcctcgcgagcccaaaccctaaacctaaacctttcacccgccgccgccgccaccaccagcactgccactccgccaccaccgtcccgaagccccctcccagcgccatcgacttcatctcggattgaagcaatgtcgtncgacgatgaggtcagggaggagaaggagctcgacctctccctcaacgacgttgtcaccaagtacaaggcnntgcgcgaaatcctcancaacgctctgaagaatgttgtgtctcagggcaaggcaaaagtcaagatgggtgactttggcgaaaaaggcgactccttcatagaaagccaactgggaatgttaccaaaaaccaaaaaggaaaattgaaaggggattgcttttcccaaccggggatccccacaggacacagttggccactttccccccgtggaaccagagagacccttttggaaaaaaaagcacgggaaaaaaggaaagggggggcaaaaggagggggtttttggggggggggggccccacccctgtgaaataaaaaaggggcccctcaacaaaaaaaaaccgggaaaagccctttcccccc

SEQ ID NO: 18904 - protein, 73 aa, Zea mays
  misc_feature: Ceres CLONE 1385539-F
  misc_feature (3)..(3): Xaa is any aa, unknown, or other
  misc_feature (27)..(27): Xaa is any aa, unknown, or other
  misc_feature (32)..(32): Xaa is any aa, unknown, or other
MSXDDEVREEKELDLSLNDVVTKYKAXREILXNALKNVVSQGKAKVKMGDFGEKGDSFIESQLGMLPKTKKEN

SEQ ID NO: 18905 - DNA, 678 bp, Zea mays
  misc_feature: Ceres CLONE 1385541-F
  misc_feature (376)..(376): n is a, c, t, g, unknown, or other
  misc_feature (377)..(377): n is a, c, t, g, unknown, or other
  misc_feature (416)..(416): n is a, c, t, g, unknown, or other
  misc_feature (502)..(502): n is a, c, t, g, unknown, or other
  misc_feature (520)..(520): n is a, c, t, g, unknown, or other
tccccgcggtggcggccgctctagaactagtggatcccccgggctgcaggaattcgcacgagaccattacctagaacatcctaatccaaaaaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttnncacatcgccagccctatctttggtgcagtcattggtacnaaccatcagggcacagcagctgcagcaactcgtgctacctgtgatcaccaaggtagctctggcaaacctttctccctactctcagnaacaacattttccttcantcaacccactggctaccttggaccggggctggtttatttgcagaaacaattattacctttcagccagggtagttactggcctatttccaaaaaaaaaaaattctttccatttaaccaatttggcccaatgaaaccccccttgtttatttggccaaaaa

SEQ ID NO: 18906 - DNA, 623 bp, Zea mays
  misc_feature: Ceres CLONE 1385546-F
  misc_feature: Encodes the peptide sequence at SEQ ID NO. 18907
  misc_feature (402)..(402): n is a, c, t, g, unknown, or other
  misc_feature (440)..(440): n is a, c, t, g, unknown, or other
  misc_feature (471)..(471): n is a, c, t, g, unknown, or other
  misc_feature (494)..(494): n is a, c, t, g, unknown, or other
  misc_feature (516)..(516): n is a, c, t, g, unknown, or other
  misc_feature (623)..(623): n is a, c, t, g, unknown, or other
tccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgncaccatggcactaccctactcaaccgccccgggctcangctcatccccagccacacccatgcccgtggncacaggcgcattcaagcccgtgncagctggcaggaaccttggcgngttggcagcaccccgatctggggcaagggggcccaggtccgggaagattaatgggaaccccgacggggaacccctactggtcgccccacggggcaggcggtgggggn

SEQ ID NO: 18907 - protein, 54 aa, Zea mays
  misc_feature: Ceres CLONE 1385546-F
  misc_feature (4)..(4): Xaa is any aa, unknown, or other
  misc_feature (12)..(12): Xaa is any aa, unknown, or other
  misc_feature (19)..(19): Xaa is any aa, unknown, or other
MPVXTGAFKPVXAGRNLGXLAAPRSGARGPRSGKINGNPDGEPLLVAPRGRRWG

SEQ ID NO: 18908 - DNA, 648 bp, Zea mays
  misc_feature: Ceres CLONE 1385549-F
  misc_feature: Translation starting site: 201
  misc_feature: SWISSPROT Homolog: EC 3.1.3.16 Phosphoprotein phosphatase
  misc_feature (474)..(474): n is a, c, t, g, unknown, or other
cgctctagaactagtggatcccccgggctgcaggaattcgcacgagaccattacctagaacatcctaatcgaaaaaaaagagactttagggttttagcggcttctatttctgagcgagggtttatccgccaggggcggcgcgacgcggcggcagttgagctgggatttccttcccatcccgttcccttccaggcgaggcgatggacgaggcggcggtcgacgacctcatccggcggctcctcgaggcccgcggcgggcgcaccccgcgcaacgcgcaggtgaccgacgctgagatccggcgcctctgcgccgccgccaaggatgtgttcctctcccagcccaacctcctggagctcgaggcccccatcaagataatgcggggatgtccatggtcagtattcagaccttcttcgattattttgagtatggtggctatccaccagatgcaaattatctgttcctcggtgactatgnttgatagggggaaacagagcatagaaacaatatgccttctcttggcatacaagataaagtacccagaaaacttcttttcttctcaggggaaaccatgaatgcgcctcatcacggaaaaaaaatgggggttttttgatgagtgtaagaggaggagattcatggtcgggatctgga

SEQ ID NO: 18909 - DNA, 677 bp, Zea mays
  misc_feature: Ceres CLONE 1385554-F
  misc_feature: Encodes the peptide sequence at SEQ ID NO. 18910
  misc_feature (508)..(508): n is a, c, t, g, unknown, or other
  misc_feature (531)..(531): n is a, c, t, g, unknown, or other
  misc_feature (582)..(582): n is a, c, t, g, unknown, or other
  misc_feature (596)..(596): n is a, c, t, g, unknown, or other
gcggtggcggccgctctagaactagtggatcccccgggctgcaggaattcgcacgagaccattacctagaacatcctaatcgaaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggctggcaggctaaagggctccacgctccttaccgaaggagtggtgacggatggatccgatgaatgggcaatctacggcggnacccggagagtttgtatgggcgnagaggtggtcgtcaaaagaaggtaccttggccgataggggacggcgccggnaacactgacgagtncagccatgcaggttttcttggggcccggggtgtttgggctcatcacagcaagccaaacaagcaggactccaccattcggca

SEQ ID NO: 18910 - protein, 144 aa, Zea mays
  misc_feature: Ceres CLONE 1385554-F
  misc_feature (133)..(133): Xaa is any aa, unknown, or other
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGRLKGSTLLTEGVVTDGSDEWAIYGGTRRVCMGXEVVVKRRYLGR

SEQ ID NO: 18911 - DNA, 719 bp, Zea mays
  misc_feature: Ceres CLONE 1385558-F
  misc_feature: Encodes the peptide sequence at SEQ ID NO. 18912
  misc_feature (666)..(666): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagacccaggagtgcatgaggcggtgccgccgccgcggactggccgtcgacatggagcaagagtacggtcgcggcagcgagagcgcgggcaagtgccgggagaggtgcgagcgccaccaccgcggngactggtgggagagcagcgctgcctggtgaaaaaaacccgggggggggggggg

SEQ ID NO: 18912 - protein, 160 aa, Zea mays
  misc_feature: Ceres CLONE 1385558-F
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETQECMRRCRRRGLAVDMEQEYGRGSESAGKCRERCERHHRGDWWESSAAW

SEQ ID NO: 18913 - DNA, 734 bp, Zea mays
  misc_feature: Ceres CLONE 1385561-F
  misc_feature: Encodes the peptide sequence at SEQ ID NO. 18914
  misc_feature (508)..(508): n is a, c, t, g, unknown, or other
  misc_feature (524)..(524): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcgaaaactgcgctgccattgctcgtccgcatcctccttggatttccctcccaggaaggttagggttttctgatgcgctcatacatggggcagcaagaagatgggatgtctgatggcttgtacacttacaagcatcaccgcgagcgaggagctgatatccacaccatctttgtgaagaagagcaaattcaggattctgctgtcatttatcggcacaacgttccttcttgtgtctgtttgctgcgccctgttatcgaaggatggtttatgtctttgttccctttggagcatttcatttgccagtgtaattgcgaaatgcctgcgatgtgaccctgtgaagaaagagtcattggtgatcatgccgacttttggaattcatttagagcacacttttggagtggaagagtcatcgcnaattgtgcccattggnncagatctagaccagtgctgaatgagcatgtgacccctgtctcatgctactggagcttgcccttgcttgtacgcaaagaaatgagctcatgctgtgtttcaggagctgaatccaccagtcaggatggtggttcattctggaaagggtaatggcattccgaaaactcaatttctctgggaaattcgggttggccccacccacatggacttg

SEQ ID NO: 18914 - protein, 121 aa, Zea mays
  misc_feature: Ceres CLONE 1385561-F
  misc_feature (110)..(110): Xaa is any aa, unknown, or other
  misc_feature (116)..(116): Xaa is any aa, unknown, or other
MGQQEDGMSDGLYTYKHHRERGADIHTIFVKKSKFRILLSFIGTTFLLVSVCCALLSKDGLCLCSLWSISFASVIAKCLRCDPVKKESLVIMPTFGIHLEHTFGVEESSXIVPIGXDLDQC

SEQ ID NO: 18915 - DNA, 692 bp, Zea mays
  misc_feature: Ceres CLONE 1385562-F
  misc_feature: Translation starting site: 172
  misc_feature: SWISSPROT Homolog: EC 1.6.5.3 NADH dehydrogenase (ubiquinone)
  misc_feature (443)..(443): n is a, c, t, g, unknown, or other
  misc_feature (501)..(501): n is a, c, t, g, unknown, or other
  misc_feature (568)..(568): n is a, c, t, g, unknown, or other
  misc_feature (569)..(569): n is a, c, t, g, unknown, or other
  misc_feature (613)..(613): n is a, c, t, g, unknown, or other
  misc_feature (616)..(616): n is a, c, t, g, unknown, or other
  misc_feature (644)..(644): n is a, c, t, g, unknown, or other
  misc_feature (645)..(645): n is a, c, t, g, unknown, or other
aaattggagctccccgcggtggcggccgctctagaactagtggatcccccgggctgcaggaattcgcacgagaccattacctaaaacatccaatcgaaaaatccccaaatcggcctacgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcccctgcttgccggtggagatgatgcacgccggcgcgtcccgctacacttcgancgggttcggcgtcatctttccgtccgtcgccgcgcccagtccgatttgcatgaatcgntcgccggcacgctcaccaacaagatggctccagccctcctgccaaggtttatgaccaaatgctgagnncttaaggttgggttattttcaatgggcagctgtgccaaacgggnggntggatactaccattactcctactctgtnngaaaccggggatgtgaccgtataagtccctgggggactcaaacggcc

SEQ ID NO: 18916 - DNA, 681 bp, Zea mays
  misc_feature: Ceres CLONE 1385567-F
  misc_feature: Encodes the peptide sequence at SEQ ID NO. 18917
  misc_feature (447)..(447): n is a, c, t, g, unknown, or other
ccccgcggtggcggccgctctagaactagtggatcccccgggctgcaggaattcgcacgagaccattacctagaacatcctaatcgaaaaataatatactcctctttcgaagtcgatctttcctcccctcattggggaaggataaacctcgccggatgagaagactatcctctctcatactgagaacatatctcctgcttgttctcaaacctcggctatcttcactccacgcgtatttgcatctcctcgtgacggagctcgacggactctcctgtcgagtctgctaagcttttcctccctttcgagccacgttcatgcctaatgatcaaagaacttcgcgatgggcatattcaatttcaagatctcgtctccgatggttgcggacttgaccaatctttggacgtcgtatacctgattcctcttcgcatgctgggcatcggagatgantcaacgtccatgcttttcgtacttttcctgaagatgctcaggctaaggatcagctcctatgggggcagagggttcctggatcttcgtagaccactccttccaatgttggttaattcccccggggcagaacattgggaaaggactcttttagccccccaaaatccgaaaggtaaaaatttcctttaccttggggggggtgggggaacccccaaaaaaaagaaaatatctgttttt

SEQ ID NO: 18917 - protein, 120 aa, Zea mays
  misc_feature: Ceres CLONE 1385567-F
  misc_feature (42)..(42): Xaa is any aa, unknown, or other
MIKELRDGHIQFQDLVSDGCGLDQSLDVVYLIPLRMLGIGDXSTSMLFVLFLKMLRLRISSYGGRGFLDLRRPLLPMLVNSPGAEHWERTLLAPQNPKGKNFLYLGGGGGTPKKKKISVF

SEQ ID NO: 18918 - DNA, 699 bp, Zea mays
  misc_feature: Ceres CLONE 1385568-F
  misc_feature: Translation starting site: 262
  misc_feature (392)..(392): n is a, c, t, g, unknown, or other
  misc_feature (407)..(407): n is a, c, t, g, unknown, or other
  misc_feature (422)..(422): n is a, c, t, g, unknown, or other
  misc_feature (522)..(522): n is a, c, t, g, unknown, or other
aagctggagctccccgcggtggcggccgctctagaactagtggatcccccgggctgcaggaattcgcacgagaccattacctagaacatcctaatcgaaaaatttgcagattactctacacgagtcacgataggaggaagactggaagaggaggcgagcacgtttgcggtgcccaccctcaccgtccactccagaaccccaaatccagttccgttccaatcgccgagaagggcagcaaaggggagaaaaaaaaggaaatctatggcggcggccggcggcgagaacagcggcgctggcgagggcgagggcgagttctacctgcgctactacgtgggacacaagggcaagttcgggcacgagttcctcgagttcgagttccggcccggacggcnagctccgctacgccnaccacttccactacnagaacgacaccatgatccggcagggaggccttcgtctcggcctccgtccctcgccgaggcagggagatcctcccggagtccgacctctggaaggaggacnacggcactggggccgagccccaccggatcgggccgcagaagcttcaaaatcgccttgggcaaccgggcaattttcattccccactttccagaaacgggtcccccccggcaatggcccagccccagaagggacccgggggggcccccccgaatcttttttataacccttgggcagggg

SEQ ID NO: 18919 - DNA, 661 bp, Zea mays
  misc_feature: Ceres CLONE 1385569-F
  misc_feature: Translation starting site: 125
  misc_feature: SWISSPROT Homolog: EC 1.11.1.9 Glutathione peroxidase
  misc_feature (538)..(538): n is a, c, t, g, unknown, or other
cgctctagaactagtggatcccccgggctgcaggaattcgcacgagaccattacctagaacatcctaatcgaaaaacctctgttacctgcaccgccgctccgttaaatcgcggcccgatcgccgatgcctccccgccccgtcccactattctctcgcctgcgcttccgcctcccgagttgcgccgccgtctccatctccacccctccatcctccgcggcgcccctgcactacggccatcgcactcccctcgctagcccttttcctctgtccccaccttgcccgcgcatcctccgtgcggtcgtcgcggtttcttcgctggatctgcgcccgatcaccggaggcttcgcgctattcagcatggctgctgcctcctccgccacctccgtccacgacttcagcgtcaaggatgctagcggaaaagatgtggaccttaccacctattaaaggcgaaggctctgctcatagtcaatgctgcatctcagagtggcttaaccaattccaactacacagagctgagccagttagtatgagaagacnagggttccagggaactctgagatccttgcatcccatgcaatcccagatccggagagctgcatcctgtcacaattggagcataacgttccagaaagacttgactcgcttacacgggtggaaatc

SEQ ID NO: 18920 - DNA, 693 bp, Zea mays
  misc_feature: Ceres CLONE 1385573-F
  misc_feature: Encodes the peptide sequence at SEQ ID NO. 18921
  misc_feature (294)..(294): n is a, c, t, g, unknown, or other
  misc_feature (384)..(384): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (440)..(440): n is a, c, t, g, unknown, or other
  misc_feature (452)..(452): n is a, c, t, g, unknown, or other
  misc_feature (490)..(490): n is a, c, t, g, unknown, or other
  misc_feature (546)..(546): n is a, c, t, g, unknown, or other
  misc_feature (662)..(662): n is a, c, t, g, unknown, or other
  misc_feature (693)..(693): n is a, c, t, g, unknown, or other
tacccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagngacggagtggtcgaacgggaccgcaaggagggacctgcggtggtgcaagcaggcgtggcgagtggcagtacggaaaggacaccccgcggnaagagggaatgcnnnagagcgagtgcccgcgagcggcaccagcaagctgacgcggngcgaggacgggnaccaggcggcggggaacgcctacgtctcccgctccggnaaaaagagggggggaagggccggcgccagtgcctggccccgccacgaggggccagnccgtgggaggaaccaggagggcaattgaggcggtgcccgccgccgcgggactggccgtcgaatggggacaaaagagtacggtcgcggcagcgagagccgcggcaaggggcccccgnagagaggtgcgagcgccacccccgggggggn

SEQ ID NO: 18921 - protein, 76 aa, Zea mays
  misc_feature: Ceres CLONE 1385573-F
  misc_feature (31)..(31): Xaa is any aa, unknown, or other
  misc_feature (61)..(61): Xaa is any aa, unknown, or other
  misc_feature (65)..(65): Xaa is any aa, unknown, or other
  misc_feature (66)..(66): Xaa is any aa, unknown, or other
MGKGSVGASWWAFLLLAGVLLVVAATAGAEXRSGRTGPQGGTCGGASRRGEWQYGKDTPRXEGMXXSECPRAAPAS

SEQ ID NO: 18922 - DNA, 605 bp, Zea mays
  misc_feature: Ceres CLONE 1385577-F
  misc_feature (363)..(363): n is a, c, t, g, unknown, or other
  misc_feature (475)..(475): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (559)..(559): n is a, c, t, g, unknown, or other
gcggtggcggccgctctagaactagtggatcccccgggctgcaggaattcgcacgagaccattacctagaacatcctaatcgaaaaagcaacatagaaagcacaatagtgtaccaacaatggcagccaaaatattttgcttccttatgctccttggtctttctgcaagtgctgctaccgcgaccattttcccgcaatgctcacaagctcctataacttcccttcttcccccatacctctcaccagcagtgtcttcagtgtgtgaaaacccaattcttcaaccctacaggatccaacaggcaatcgcagcaggcatcttacctttatcacccttgttcctccaacaaccgtcagccctattacnacaggtacctttggtggcatttgttgcacaaaacattagggcaccaacactaccaccacttgtgctaagaaacctttgctgcatactctcagcaacatcagtttcttccaancaacccactggctgcattgaactctgctggctatttgcannncacactaacattcaggcagctagctgctgcctacccccagcnattttcttcattcaatcaactggcagcaattgaactctgctgctta

SEQ ID NO: 18923 - DNA, 682 bp, Zea mays
  misc_feature: Ceres CLONE 1385581-F
  misc_feature: Encodes the peptide sequence at SEQ ID NO. 18924
  misc_feature (451)..(451): n is a, c, t, g, unknown, or other
  misc_feature (486)..(486): n is a, c, t, g, unknown, or other
  misc_feature (516)..(516): n is a, c, t, g, unknown, or other
  misc_feature (517)..(517): n is a, c, t, g, unknown, or other
  misc_feature (558)..(558): n is a, c, t, g, unknown, or other
  misc_feature (617)..(617): n is a, c, t, g, unknown, or other
aaagctggagctccccgcggtggcggccgctctagaactagtggatcccccgggctgcaggaattcgcacgagaccattacctagaacatcctaatcgaaaaatcgtcatcgcaaaatgcaggctctcctgctccccgcgcgggccgcgccgccgacgccggcgatgcttcggcagcgtgcggtttctgcctccgcgtgtgcgtcgcaggtctgccgccccctattcggtgccgccagttgcatctcctgtggggtccacggaagcgttcggcggcacctcacagtggcggtggcggcggccccgccctcgccttcgtcctcaccttcgtcgggaccgctctacccgacgcctccacccaccgagcaggaggtggagagggtcaagctcgagcaggttatgaggagactagagaaaacagcaaggtatttcaagaatttggttaccctggnggttctggtcccaattggtgtgcacaattatttcntgctggaattttggcattctctacagttgnnaacggggaaggtgacatcaccctttacattctatgcaactngctgctggtattgctgctgctttttatttcagtcttctgggtcatttgggttacatccngtctctctgaaaggcttagaaaaacatccaaagaacctgctaaggctctccacggggggctgatg

SEQ ID NO: 18924 - protein, 187 aa, Zea mays
  misc_feature: Ceres CLONE 1385581-F
  misc_feature (112)..(112): Xaa is any aa, unknown, or other
  misc_feature (124)..(124): Xaa is any aa, unknown, or other
  misc_feature (134)..(134): Xaa is any aa, unknown, or other
  misc_feature (148)..(148): Xaa is any aa, unknown, or other
MQALLLPARAAPPTPAMLRQRAVSASACASQVCRPLFGAASCISCGVHGSVRRHLTVAVAAAPPSPSSSPSSGPLYPTPPPTEQEVERVKLEQVMRRLEKTARYFKNLVTLXVLVPIGVHNYFXLEFWHSLQLXTGKVTSPFTFYATXCWYCCCFLFQSSGSFGLHPVSLKGLEKHPKNLLRLSTGG

SEQ ID NO: 18925 - DNA, 641 bp, Zea mays
  misc_feature: Ceres CLONE 1385589-F
  misc_feature: Encodes the peptide sequence at SEQ ID NO. 18926
  misc_feature (411)..(411): n is a, c, t, g, unknown, or other
  misc_feature (559)..(559): n is a, c, t, g, unknown, or other
  misc_feature (597)..(597): n is a, c, t, g, unknown, or other
  misc_feature (611)..(611): n is a, c, t, g, unknown, or other
  misc_feature (620)..(620): n is a, c, t, g, unknown, or other
tgagctccccgcggtggcggccgctctagaactagtggatcccccgggcttgcaggaattcgcacgagaccatttacctagaacattcctaatcgaaaaatcatccaatccagatcagcaaagcggcagtgcgtagagaggatcgtcgaacagaacagcatgaagatggtcatcgttctcgtcgtgtgcctggctctgtcagctgccagcgcctctgcaatgcagaagccctgcccctgcgcggggctgcagggcttgtacggcgcttgcgccggcctgacgacgatgatgggcgccggcgggctgtacccctacgcggagtacctgaggcagccgcagtgcagcccgctggcggcggcgctctactacgccgggtgtgggcagccgagcgccatgttccagccgctccgncaacagtgctgccagcagcagattgagatgatggacgtgcagtccgtcgcgcagcagctgcagatgatgatgcagcttgagcgtgccgctgccgccagcagcagcctgtacgagccagctctgatgcagcagcagcagcagctgctgncaagcccagggtctcaacccatggcccatgattaatgncgcagacatgcggnccctttggntggactctaccagtaccagct

SEQ ID NO: 18926 - protein, 144 aa, Zea mays
  misc_feature: Ceres CLONE 1385589-F
  misc_feature (134)..(134): Xaa is any aa, unknown, or other
MKMVIVLVVCLALSAASASAMQKPCPCAGLQGLYGACAGLTTMMGAGGLYPYAEYLRQPQCSPLAAALYYAGCGQPSAMFQPLRQQCCQQQIEMMDVQSVAQQLQMMMQLERAAAASSSLYEPALMQQQQQLLXSPGSQPMAHD

SEQ ID NO: 18927 - DNA, 685 bp, Zea mays
  misc_feature: Ceres CLONE 1385592-F
  misc_feature: Encodes the peptide sequence at SEQ ID NO. 18928
  misc_feature (413)..(413): n is a, c, t, g, unknown, or other
  misc_feature (450)..(450): n is a, c, t, g, unknown, or other
  misc_feature (475)..(475): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (515)..(515): n is a, c, t, g, unknown, or other
  misc_feature (524)..(524): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (580)..(580): n is a, c, t, g, unknown, or other
  misc_feature (581)..(581): n is a, c, t, g, unknown, or other
  misc_feature (671)..(671): n is a, c, t, g, unknown, or other
tggagctccccgcggtggcggccgctctagaactagtggatcccccgggctgcaggaattcgcacgagaccattacctagaacatcctaatcgaaaaatgacaccgcgtgccccgcagcttcggcatcacccgccgcacctcctcctcgccgaggctgtcgcctcctggcaccccttccacaagaagccctgtctcacggaccgctccacggctcccccctcctcggcccgcctccctgatgcggagactccgacgcctgccctctcggggggcggtagcggcggatccttccggtggttcgggctccgcaagcggcgccgccgcggtccgggctcgcggtccgtgtccggccgcagcagcgaccgccggagatccggcacgtgctccgacttccatttcacgtgcggcgccngtggttggttgggcggcggcggcgccactgactccgncggggaaaatgtgggcgtcggatgntcggggaggtggatgggnnnnnnnncccggcgtggggggncccccgggnttccgcccgtccctgttggtgttgggggtttttggtctttaaagggnnnggggggnncccccccctcttccccgggggggcccccctcccccccgtttcgtggttttgggggggcgaccctgggggcccccgggggcccccgggggnccttgggataatgg

SEQ ID NO: 18928 - protein, 194 aa, Zea mays
  misc_feature: Ceres CLONE 1385592-F
  misc_feature (106)..(106): Xaa is any aa, unknown, or other
  misc_feature (118)..(118): Xaa is any aa, unknown, or other
  misc_feature (126)..(126): Xaa is any aa, unknown, or other
  misc_feature (133)..(133): Xaa is any aa, unknown, or other
  misc_feature (134)..(134): Xaa is any aa, unknown, or other
  misc_feature (135)..(135): Xaa is any aa, unknown, or other
  misc_feature (140)..(140): Xaa is any aa, unknown, or other
  misc_feature (143)..(143): Xaa is any aa, unknown, or other
  misc_feature (159)..(159): Xaa is any aa, unknown, or other
  misc_feature (162)..(162): Xaa is any aa, unknown, or other
  misc_feature (192)..(192): Xaa is any aa, unknown, or other
MTPRAPQLRHHPPHLLLAEAVASWHPFHKKPCLTDRSTAPPSSARLPDAETPTPALSGGGSGGSFRWFGLRKRRRRGPGSRSVSGRSSDRRRSGTCSDFHFTCGAXGWLGGGGATDSXGENVGVGXSGRWMGXXXRRGGXPGXPPVPVGVGGFWSLKGXGGXPPSSPGGPPSPPFRGFGGATLGAPGGPRGXLG

SEQ ID NO: 18929 - DNA, 670 bp, Zea mays
  misc_feature: Ceres CLONE 1385595-F
  misc_feature: Encodes the peptide sequence at SEQ ID NO. 18930
  misc_feature (524)..(524): n is a, c, t, g, unknown, or other
  misc_feature (559)..(559): n is a, c, t, g, unknown, or other
  misc_feature (618)..(618): n is a, c, t, g, unknown, or other
  misc_feature (649)..(649): n is a, c, t, g, unknown, or other
tccccgcggtggcggccgctctagaactagtggatcccccgggctgcaggaattcgcacgagaccattacctagaacatcctaatcgaaaaaaaaccaagcagtaacaacattaatcacccactctactactcgaagttactaccagcagcttgcttcaacagtagaagagagcgagaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgctgcacccgcgcagccacgccgagttccccgtgtgctggtggacggggcgcctgcgcgcgcccgacgccgcccaggtggagttccacgtccggcgtcgacggcggctccttctacctggcccccaacgcgcagccgggccagncgcgtcccggtctccgtcaccccgcacggctcggncggctgcagggccgctgcccccgcccgtcggctggcgccatccagggcccgctgctccngtgcaccaggtggcccagcggcgactgccgncaacgtcaagggaagatgaag

SEQ ID NO: 18930 - protein, 163 aa, Zea mays
  misc_feature: Ceres CLONE 1385595-F
  misc_feature (115)..(115): Xaa is any aa, unknown, or other
  misc_feature (127)..(127): Xaa is any aa, unknown, or other
  misc_feature (157)..(157): Xaa is any aa, unknown, or other
MASPKPSSAALLLLAAAAVLALARADLTHDNCVKNKKVTVQNLCSHDVTLTLEPLANSPPLFAGTYTLHPRSHAEFPVCWWTGRLRAPDAAQVEFHVRRRRRLLLPGPQRAAGPXASRSPSPRTARXAAGPLPPPVGWRHPGPAAPVHQVAQRRLPXTSREDE

SEQ ID NO: 18931 - DNA, 707 bp, Zea mays
  misc_feature: Ceres CLONE 1385596-F
  misc_feature: Encodes the peptide sequence at SEQ ID NO. 18932
  misc_feature (582)..(582): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggncttgtagctgtccagcgccgcgcccacctcggcgtccgcggctcctagccgggccgccctgagccgncgccgcgccgcaccgtcgcagcttccgctggcagcagctgcagctcccaaccgtggcg

SEQ ID NO: 18932 - protein, 108 aa, Zea mays; identical to SEQ ID NO: 13037
  misc_feature: Ceres CLONE 1385596-F

SEQ ID NO: 18933 - DNA, 721 bp, Zea mays
  misc_feature: Ceres CLONE 1385601-F
  misc_feature: Encodes the peptide sequence at SEQ ID NO. 18934
  misc_feature (277)..(277): n is a, c, t, g, unknown, or other
  misc_feature (293)..(293): n is a, c, t, g, unknown, or other
  misc_feature (434)..(434): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (494)..(494): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (569)..(569): n is a, c, t, g, unknown, or other
  misc_feature (599)..(599): n is a, c, t, g, unknown, or other
  misc_feature (606)..(606): n is a, c, t, g, unknown, or other
cgcggtggcggccgctctagaactagtggatcccccgggctgcaggaattcgcacgagaccattacctagaacatcctaatcgaaaaatagagcaggcaagatcattgatccattactgataaaaaaaaatattcggatgcgctagagaggaggagaagcaggcaagcagcaatggcagcagcaatcgacgactcgtgcaggagaccaggctcgatcccgttcaagtgggagatctgcccggggacgcccaagcacgccaggagcagcagcgccagncgcggctccgtcgtcngtcgtcgtcgccgtactactcgtcctcctccgccaccgcctccgtctccaagggtagcggtgtcgccgaagctgacgccgcccccggccaatgcggccccgtcgccgtaccacttccccgcgcgtctcctactacccgggncgctctggggtccnnngtgccgcccgtcccgggggcccgcgcgccgcaccgccccacggntttttcctcgaggnnnnnccccccggggttcggcccccacgtacccggggccggggcttgctggagggttgaggnaccacccgaggggggcggggggccccccgncccgggnagggtgcttccccggctccccgggggtcccgggagggcggaacgggaaggaaagggggcccgaaaaggacgtccctccggggaagggggaacgggggcccgcgaaagaggcttca

SEQ ID NO: 18934 - protein, 183 aa, Zea mays
  misc_feature: Ceres CLONE 1385601-F
  misc_feature (35)..(35): Xaa is any aa, unknown, or other
  misc_feature (41)..(41): Xaa is any aa, unknown, or other
  misc_feature (88)..(88): Xaa is any aa, unknown, or other
  misc_feature (93)..(93): Xaa is any aa, unknown, or other
  misc_feature (108)..(108): Xaa is any aa, unknown, or other
  misc_feature (113)..(113): Xaa is any aa, unknown, or other
  misc_feature (114)..(114): Xaa is any aa, unknown, or other
  misc_feature (133)..(133): Xaa is any aa, unknown, or other
  misc_feature (143)..(143): Xaa is any aa, unknown, or other
  misc_feature (145)..(145): Xaa is any aa, unknown, or other
MAAAIDDSCRRPGSIPFKWEICPGTPKHARSSSAXRGSVVXRRRRTTRPPPPPPPSPRVAVSPKLTPPPANAAPSPYHFPARLLLPGXLWGPXCRPSRGPARRTAPRXFPRGXXPRGSAPTYPGPGLAGGLRXHPRGAGGPPXRXGCFPGSPGVPGGRNGKERGPEKDVPPGKGERGPAKEAS

SEQ ID NO: 18935 - DNA, 733 bp, Zea mays
  misc_feature: Ceres CLONE 1385604-F
  misc_feature: Encodes the peptide sequence at SEQ ID NO. 18936
  misc_feature (389)..(389): n is a, c, t, g, unknown, or other
  misc_feature (390)..(390): n is a, c, t, g, unknown, or other
  misc_feature (426)..(426): n is a, c, t, g, unknown, or other
  misc_feature (457)..(457): n is a, c, t, g, unknown, or other
tggagctccccgcggtggcggccgctctagaactagtggatcccccgggctgcaggaattcgcacgagaccattacctagaacatcctaatcgaaaaatatctttttctccccaagaaaaaaaaggcggcgagagcataagaagaaaaaaaacacacacacacacacacaaagcgcacttttcaaatcgacaaaggggaaaggttcgcttcttgtggcatcttgctttccttcgagtgccatggccgatccggcggaggagaacgttgtctcgccgccaccgacccctgcggccccagccgtgggcgcctcagacccgcccctgcagcctgctgctgacagcgcctcaacggagaaggtgtctgctccggcgccggaggtaaggtcccnngggatcaggcttcttggagaggacacttccgtgcancaatccctttgggggcggtaaactgctgacngtctgttatgggaagaccagaaaacttctgctgttgtaataggggggcaactgtcatcctgggtcttggtcgaagtgctggaataccacttcctgaccttgaatcccatggacggattggggggctgccaccttatcccgggggcccaaggcaccacctccatcagaaaaggcccccggaaattcccctagggcagggatctgaagaccttggggggaagggttccgggcatttccggaatgacttcaaagagggcttcccttggcccggggaacc

SEQ ID NO: 18936 - protein, 68 aa, Zea mays
  misc_feature: Ceres CLONE 1385604-F
  misc_feature (50)..(50): Xaa is any aa, unknown, or other
  misc_feature (62)..(62): Xaa is any aa, unknown, or other
MADPAEENVVSPPPTPAAPAVGASDPPLQPAADSASTEKVSAPAPEVRSXGIRLLGEDTSVXQSLWGR

SEQ ID NO: 18937 - DNA, 676 bp, Zea mays
  misc_feature: Ceres CLONE 1385606-F
  misc_feature (599)..(599): n is a, c, t, g, unknown, or other
aaactggagctccccgcggtggcggccgctctagaactagtggatcccccgggctgcaggaattcgcacgagaccatttacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacattcatcgtcatcggcttcgcgagctggaacctgaaccacttcatcaacgggcagaccaacttaccccggcgtggccggcaacggcgcgacgttctactttcctggtgttcgcctcctggccgggcgtggtggggcgcggcgtccaagcttggcgggcgtgcaccacgtgcgcgcctggcgccacgacagcctggncaccaacgccgcgtcttcgctcatcgcctgggccatcacggcgctcgcccttcgggctgcccttgcaaggagatcca

SEQ ID NO: 18938 - DNA, 677 bp, Zea mays
  misc_feature: Ceres CLONE 1385607-F
  misc_feature: Encodes the peptide sequence at SEQ ID NO. 18939
  misc_feature (554)..(554): n is a, c, t, g, unknown, or other
  misc_feature (571)..(571): n is a, c, t, g, unknown, or other
  misc_feature (620)..(620): n is a, c, t, g, unknown, or other
tccccgcggtggcggccgctctagaactagtggatcccccgggctgcaggaattcgcacgagaccattacctagaacatcctaatcgaaaaacattcttccccgagtcgccgtcgtctgctccgggctgctgttctgcgcctccacaaggctttggcctctgttgtaagttttaagcttcacctccagccatgggtaaggagaagtcccacatcaacattgtggttattggccatgtcgactctggcaagtcaaccaccaccggccacctgatctacaagcttggaggcattgacaagcgtgtgattgagaggttcgagaaggaagccgctgaaatgaacaaacggtccttcaagtacgcttgggtgcttgacaagctcaaggctgagcgtgagagaggtatcaccattgatatcgctctgtggaagtttgagaccaccaagtactactgcactgtcattgatgcccctggacatcgcgacttcatcaagaacatgatcacgggtacctccccaggctgactgtgctgtcctgatcattgatccacccactggnggggttttggaggccgntatcctctaaggatggccagacccgtgagcatgctctccttgcttccancctttggggtcaaagcagatgatttgctgctgcaacaagatggatgcgaccactcaa

SEQ ID NO: 18939 - protein, 109 aa, Zea mays
  misc_feature: Ceres CLONE 1385607-F
  misc_feature (5)..(110): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSPG

SEQ ID NO: 18940 - DNA, 662 bp, Zea mays
  misc_feature: Ceres CLONE 1385608-F
  misc_feature: Translation starting site: 358
  misc_feature: SWISSPROT Homolog: EC 2.4.2.7 Adenine phosphoribosyltransferase
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (177)..(177): n is a, c, t, g, unknown, or other
aaactggagctccccgcggtggcggccgctctagaactaagtgggatcccccgggctgcaggaattcgcacgagaaccattacctaagaacatcctaatcgaaaaagctgcgacgccgtcagcctgacggaggccggcaccaacgccaagccgtggggcccaagaagtcgnnnctcnagccggctgcagcccccgccgccgcggccgacccccggctgcagggcatttccgacgccatccgcgtcgtgccttacttccccaagcaaggcatcatgttcaacgacttcaccacgctgctgctgcgccccagggtgttcaaggacgccgtcgacctgttcttcgagcggctccgcggtgatgggcatcgacgccgtcttcgggattgaggccaggggcttcttgttcggcccggcgatctcgctggctattggcgtcaatttcatacctctgcggtagccaatgaagctcccaattgaggtgatctccgataactaccctctcgatacttgactgattgcctgaagatgtgtgtcgcccccatcaagtcatccagagaatgattgctgatcatcgacttcctgtttgtgaccggcatgacactctgcgctgtgatcaggcttctagaacttgctcgaaccatctcctcaagagacttctatgcc

SEQ ID NO: 18941 - DNA, 671 bp, Zea mays
  misc_feature: Ceres CLONE 1385614-F
  misc_feature: Translation starting site: 303
aagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcgactcctagccgggccgccctgagccgccgccgcgccgcaccgtcgcagtt

SEQ ID NO: 18942 - DNA, 669 bp, Zea mays
  misc_feature: Ceres CLONE 1385616-F
  misc_feature: Encodes the peptide sequence at SEQ ID NO. 18943
  misc_feature (498)..(498): n is a, c, t, g, unknown, or other
  misc_feature (577)..(577): n is a, c, t, g, unknown, or other
  misc_feature (578)..(578): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (633)..(633): n is a, c, t, g, unknown, or other
  misc_feature (634)..(634): n is a, c, t, g, unknown, or other
  misc_feature (642)..(642): n is a, c, t, g, unknown, or other
  misc_feature (643)..(643): n is a, c, t, g, unknown, or other
ctccccgcggtggcggccgctctagaactagtggatcccccgggctgcaggaattcgcacgagaccattacctagaacatcctaatcgaaaaacagctagcatcgatccgccattgctcaccgcacaagtgcacgctcacctcacacacgcagctaagtagctaacgccgtaggcgagaacaagaaaaggctcgacatggccgaggagaagaagcagggcctgcagctgctggacttctgggtgagcccattcgggcagcgctgccgcatcgcgctggacgagaagggcctggcctacgagtacctggagcaggacctgaggaacaagagcgagctgctcctccgcgccaacccggtgcacaagaagatccccgtgctgctgcacgacggccgcccccgtctgcgagtccctcgtcatcgtgcagtacctcgacgaggcgttcccggcagcgggcgccggcgctgctccccgccgacccctaagcggcgcgcgcaggnccgcttttctgggcggactacgtcgacaagaagctctacgacgggggcacccgggctgggaagctccaaaggggacggnncaggcgcaggggccgccgaaaaaagggtcgagatctcgnnnacgctggagggggnntcggagcnntttttttttttttggggggggggggc

SEQ ID NO: 18943 - protein, 157 aa, Zea mays
  misc_feature: Ceres CLONE 1385616-F
  misc_feature (7)..(77): Pfam Name: GST_N Pfam Description: Glutathione S-transferase, N-terminal domain
  misc_feature: SWISSPROT Homolog: EC 4.4.1.5 Lactoylglutathione lyase
  misc_feature (101)..(101): Xaa is any aa, unknown, or other
  misc_feature (128)..(128): Xaa is any aa, unknown, or other
  misc_feature (141)..(141): Xaa is any aa, unknown, or other
  misc_feature (146)..(146): Xaa is any aa, unknown, or other
  misc_feature (149)..(149): Xaa is any aa, unknown, or other
MAEEKKQGLQLLDFWVSPFGQRCRIALDEKGLAYEYLEQDLRNKSELLLRANPVHKKIPVLLHDGRPRLRVPRHRAVPRRGVPGSGRRRCSPPTPKRRAQXRFSGRTTSTRSSTTGAPGLGSSKGDGXGAGAAEKRVEISXTLEGXSEXFFFFWGGG

SEQ ID NO: 18944 - DNA, 703 bp, Zea mays
  misc_feature: Ceres CLONE 1385619-F
  misc_feature: Encodes the peptide sequence at SEQ ID NO. 18945
  misc_feature (301)..(301): n is a, c, t, g, unknown, or other
  misc_feature (339)..(339): n is a, c, t, g, unknown, or other
tggagctccccgcggtggcggccgctctagaactagtggatcccccgggctgcaggaattcgcacgagaccattacctagaacattcctaatcgaaaagttgtcttggcggctgcggcggagcacggaggcgaaggaggagcagcagcagcaggcggcgccgaggagcggcatcccactcagtgcttgcaaccatggctaggggattgaagaagcacttgaagaggctcaatgcgcccaagcattggatgctcgacaagcttggcggaggttttgctcccaagccatcttctggacctcancagatcagggagtgccttcctctgatcctcatcatcangaacaggctcaagtatgctctgaactaccggtgagtcatttccatcctggatgcacgcctgtacttgttggattggcaggtcaggactgacaaaacttacctggctgggtcaagggaggcctttcccttccccaaaaaaggggaaaattaagggtgttttttgaaacccggggggggtttccgttttccccaaatggggttagggaccccaatttaattctccgggggggagctcttttttttttggccaaaaaaggctcctcccctatggaaaaacaaaaagggggggatattttttttctcccaccgccttttttagggggcgccccccttttatttgtgttggggggaaccacaaatattt

SEQ ID NO: 18945 - protein, 59 aa, Zea mays
  misc_feature: Ceres CLONE 1385619-F
  misc_feature (3)..(40): Pfam Name: RS4NT Pfam Description: RS4NT (NUC023) domain
  misc_feature (36)..(36): Xaa is any aa, unknown, or other
  misc_feature (49)..(49): Xaa is any aa, unknown, or other
MARGLKKHLKRLNAPKHWMLDKLGGGFAPKPSSGPXQIRECLPLILIIXNRLKYALNYR

SEQ ID NO: 18946 - DNA, 682 bp, Zea mays
  misc_feature: Ceres CLONE 1385625-F
  misc_feature: Encodes the peptide sequence at SEQ ID NO. 18947
  misc_feature (463)..(463): n is a, c, t, g, unknown, or other
  misc_feature (545)..(545): n is a, c, t, g, unknown, or other
  misc_feature (589)..(589): n is a, c, t, g, unknown, or other
  misc_feature (617)..(617): n is a, c, t, g, unknown, or other
  misc_feature (630)..(630): n is a, c, t, g, unknown, or other
tggcggccgctctagaactagtggatcccccgggctgcaggaattcgcacgagaccattacctagaacatcctaatcgaaaactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggacgatgatngaccttgatctttttggtgatgaaactgaggaggacaagaagtgcagctgatgagcgtgccgccgctgccaaggcctcttcntaaaagaaagaaagtggtaaatcctccgccccttaatggatgtncaaaccatggggacgatgagactgatantgagaagctgggnaggagggctggtccgagtgtcccacaaaggggggagggctctggactgggga

SEQ ID NO: 18947 - protein, 98 aa, Zea mays
  misc_feature: Ceres CLONE 1385625-F
  misc_feature (97)..(97): Xaa is any aa, unknown, or other
MAVFSDLHTADGLKSLEAHLAGKTYVSGDSITKDDIKVFAAVPSKPGAEFPNAARWYETVSAAVASRFPGKAVGVNLPAGSAPAAAAPADEAEDDDXP

SEQ ID NO: 18948 - DNA, 659 bp, Zea mays
  misc_feature: Ceres CLONE 1385628-F
  misc_feature: Encodes the peptide sequence at SEQ ID NO. 18949
  misc_feature (386)..(386): n is a, c, t, g, unknown, or other
  misc_feature (454)..(454): n is a, c, t, g, unknown, or other
  misc_feature (629)..(629): n is a, c, t, g, unknown, or other
gaagctccccgcggtggcggccgctctagaactagtggatcccccgggctgcaggaattcgcacgagaccattacctagaacatcctaatcgaaaaaaccaactcatgctcgacggaccacctcgtcggagcttcgcatttatcgtgccgtccatgtccatgcaacagccgacgaacgccgcaagccaacttcacgccgcgatggaagcgccattgtcgctctcgtcactgcagctcgccttcacggcggtcgcggcgatcgcggcgctggccgtcgcggtggccgtcacgaggtacaaccggagatacatgggcctgaggctgcctccgggcccgcccgggtggcccgtcgtcggtcacctgttccagagtggcgatctccgggnagctcttcatccactacatccgcgagctccgcaagggagtacggcccatcctgacgctgcgcatgggnggagcgcacgctcgtgatcatcagcagcgtcgagctcgcgcacaggcgctggatgagaaaggggcggtaagttccgcgagccggccccgggagaaaccacgcgaacatccttctcgtccaacaagctcacgggaacctccgccgggacgggccccccaaatggcggtcctggcgnaaaaaaatgggggccccccgatgctgaaca

SEQ ID NO: 18949 - protein, 89 aa, Zea mays
  misc_feature: Ceres CLONE 1385628-F
  misc_feature (62)..(62): Xaa is any aa, unknown, or other
  misc_feature (85)..(85): Xaa is any aa, unknown, or other
MEAPLSLSSLQLAFTAVAAIAALAVAVAVTRYNRRYMGLRLPPGPPGWPVVGHLFQSGDLRXALHPLHPRAPQGSTAHPDAAHGXSARS

SEQ ID NO: 18950 - DNA, 652 bp, Zea mays
  misc_feature: Ceres CLONE 1385631-F
  misc_feature: Translation starting site: 166
  misc_feature (336)..(336): n is a, c, t, g, unknown, or other
gctctagaactagtggatcccccgggctgcaggaattcgcacgagaccattacctagaacatcctaatcgaaaagatggtctcgtactcttgtcacgttccttcctgactgcccccacttctcctccggcggcgcggcggcgggttacctcccaacagcccgaccatggaagccgacatcgctttcaggtatgagatcccccggaccgcccagttcctccgcgacggcgcctacaccagggtcgcgctccagttccccgacgagatgctgaaggatgctgctgcggtggcgagggcgttgcggcgggagcttgcctccggcggcgccgacagtggnggttagggtgttcgggatggccgacacggcgtacaactcctgctgggtggacgaggtgggcgcgtcccacatcgatgcggcagtgcgtcgtccactacggccacgcctgcatgagcccaacatcaaatttgccagctttctttggaatttgggaaggcaccggttggatgtccacgcatgggccggcacatttggtggagggctcaaggaaaagcaaaagcggcattctgggttttattggggactacagtacggcatatggcattgggatggaccttatacagacttttcgtgggagtcagtggaaatcaaattg

SEQ ID NO: 18951 - DNA, 642 bp, Zea mays
  misc_feature: Ceres CLONE 1385635-F
  misc_feature (257)..(257): n is a, c, t, g, unknown, or other
  misc_feature (271)..(271): n is a, c, t, g, unknown, or other
  misc_feature (272)..(272): n is a, c, t, g, unknown, or other
  misc_feature (349)..(349): n is a, c, t, g, unknown, or other
tcaccgcggtggcggccgctctagaactagtggatcccccgggctgcaggaattcgcacgagaccattacctagaacatcctaatcgaaaattttacacgcccccttctctctcgatttctcgcggagcggccctccacctttatcgccgccgccgccgttgctgtgttccgtctcttcgccgatggcttcggccaagttcggtgctgcccagcaggtggagaaccgaggcgcgctgtccaaaaggcacgtaacagnttgtctgtaagggnnaggggactggaattgtcctcagtggtggaatgtcaacttcagttttagaaatgtttgcaaccagtggagtctgtggntgcaccccgtccatcacccgagtccaagtccaagaaatgatgtcaggacctcctgctttcgggatatgaccggtcactctatttatcggggggggggggggggggttggggcccacccccccaattcccgctttggaaatgggaaaaactagtgttggtcccctatccacccccttggggatggcgataattggcttatgggaccaccagcagggtactcccgggggttataaggggtttttttcccctttaaatggggcccccctgggcccaagggaggggaatgggaaaaa

SEQ ID NO: 18952 - DNA, 657 bp, Zea mays
  misc_feature: Ceres CLONE 1385637-F
  misc_feature: Translation starting site: 198
  misc_feature (470)..(470): n is a, c, t, g, unknown, or other
  misc_feature (476)..(476): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacttccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcacccgtggctgggtggccggccgccatcgcgctggcgtncatggncggcgggttcgtcacctccggcggcctcggcgtcgctgcgctgtccgtgttctcctggatgtacaagtacctgacgggcaagcacccgccgggcgccgaccagctggacacgccaaggcgaggctggcgtccaaggcccgcgacatcaaggatgcagcacagcaccgcatcgaccaggggn

SEQ ID NO: 18953 - DNA, 680 bp, Zea mays
  misc_feature: Ceres CLONE 1385638-F
  misc_feature: Translation starting site: 272
tccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggaccatagccttgcttaaaagggtatggctcttaccagaaggacaaagggactggggcgtccagaaatttggatatacatgggacaaagttactaatgaaccagagggtgatgcaacagtcacactatgaggatccacatgctgcttcagctgcttggtggaatggttcgataacaaggatttccatgggagcaactattcagggtcacatagctgagtcaaaaagcaaagatgcattcgataaccccacaagttgacatcatttgggggggtgttggtgaacaagatgaactggattatggagcagcagag

SEQ ID NO: 18954 - DNA, 670 bp, Zea mays
  misc_feature: Ceres CLONE 1385644-F
  misc_feature: Encodes the peptide sequence at SEQ ID NO. 18955
  misc_feature (534)..(534): n is a, c, t, g, unknown, or other
  misc_feature (547)..(547): n is a, c, t, g, unknown, or other
  misc_feature (558)..(558): n is a, c, t, g, unknown, or other
  misc_feature (566)..(566): n is a, c, t, g, unknown, or other
tccccgcggtggcggccgctctagaactagtggatcccccgggctgcaggaattcgcacgagaccattacctagaacatcctaatcgaaaaatgcacactcactcactccagtgcccactgcccactgcccactggccgacgaggaagtttcacgatcccaacccgtataaatcgacgccgcgagggggagcgacgagcgatccccgtaattaacctgtcccagccgcaccgatccaccccccctcgggctcggcctccctccggtcatggaggtgttctactacgtcgtgttcggcgcgctggccgccgtcgtggcggggctcgagctcggcaagagcggcaaggaccgcgtcgccaccacctccgcattcaactccttcaggaacaactacgtcctcgtctactccctcatgatgtccggggactggctgcagggcccctacgtctactacctctacagccagtatggcttcgacaggggcgacatcggccgctccttcatcggcgggcttcggatcctccatgctctcggnaaccatcgtcggntccctcccganaacagggnccggcagaaagggctgcggtcaccttattgcatcagctacatcctcagctgcatcaccaagactccccccgagggacagggtcccctccggatcggcgccatcc

SEQ ID NO: 18955 - protein, 134 aa, Zea mays
  misc_feature: Ceres CLONE 1385644-F
  misc_feature (94)..(94): Xaa is any aa, unknown, or other
  misc_feature (97)..(97): Xaa is any aa, unknown, or other
  misc_feature (100)..(100): Xaa is any aa, unknown, or other
MEVFYYVVFGALAAVVAGLELGKSGKDRVATTSAFNSFRNNYVLVYSLMMSGDWLQGPYVYYLYSQYGFDRGDIGRSFIGGLRILHALGNHRRXPPXNRXRQKGLRSPYCISYILSCITKTPPEGQGPLRIGAI

SEQ ID NO: 18956 - DNA, 703 bp, Zea mays
  misc_feature: Ceres CLONE 1385645-F
  misc_feature: Encodes the peptide sequence at SEQ ID NO. 18957
  misc_feature (450)..(450): n is a, c, t, g, unknown, or other
  misc_feature (500)..(500): n is a, c, t, g, unknown, or other
  misc_feature (503)..(503): n is a, c, t, g, unknown, or other
  misc_feature (623)..(623): n is a, c, t, g, unknown, or other
aagctggagctccccgcggtggcggccgctctagaactagtggatcccccgggctgcaggaattcgcacgagaccattacctagaacatcctaatcgaaaatcccccacatcgcacggcgtacccgatctccaaatcgcccccccaaaccctcttcttcccccttcccgtgctcgacccagatcgagggctcgatccgtcggccatggcgctggagtgggtggtgctgggctacgcggcgggcgcggaggcgatcatgctgctgctgctgacgctgccggggctcgacggcctgcgccggggcatgatctccgtggtgcggagcgcgctgaagcccatgatgtcggtggtgcccttctgcctcttcctgctcatggacatctactgggagtacgagacgcgccccacctgcgacgacgagcacgcctgcaccccctccgagcacctccgnccacagaaagtcatcatgaagtcgcagcggaacgcgctcctcatcgccgncgngctgctcctctactggatcctcttctccgtcacccagttcgtcgtcaggctcagcagatgcagcagcgcgtcgacagctcaggaagcgcgacgactgatggatccgcatcatccggtggntcgttcttctttgccggcctggctcctgctatagtggggggctgaggttaaaatccgaacgaatttgaaacctggtgaac

SEQ ID NO: 18957 - protein, 150 aa, Zea mays
  misc_feature: Ceres CLONE 1385645-F
  misc_feature (99)..(99): Xaa is any aa, unknown, or other
  misc_feature (100)..(100): Xaa is any aa, unknown, or other
  misc_feature (140)..(140): Xaa is any aa, unknown, or other
MALEWVVLGYAAGAEAIMLLLLTLPGLDGLRRGMISVVRSALKPMMSVVPFCLFLLMDIYWEYETRPTCDDEHACTPSEHLRPQKVIMKSQRNALLIAXXLLLYWILFSVTQFVVRLSRCSSASTAQEARRLMDPHHPVXRSSLPAWLLL

SEQ ID NO: 18958 - DNA, 571 bp, Zea mays
  misc_feature: Ceres CLONE 1385646-F
  misc_feature: Pfam Name: FH2 Pfam Description: Formin Homology 2 Domain
  misc_feature (90)..(90): n is a, c, t, g, unknown, or other
  misc_feature (162)..(162): n is a, c, t, g, unknown, or other
  misc_feature (208)..(208): n is a, c, t, g, unknown, or other
  misc_feature (240)..(240): n is a, c, t, g, unknown, or other
  misc_feature (241)..(241): n is a, c, t, g, unknown, or other
tccccgcggtggcggccgctctagaactagtggatcccccgggctgcaggaattcgcacgagaccattacctagaacatcctaatcgaanaatcaccatttcgctagctccatagcacttgttccagctagctaggagagagagctttgtttaagcggcggncagatgaacaggaagcccagagactggtactgcagggggtggcagnacctccacttcgcccgttgggatgcatggcanngctgaagtgaccccggtaggtggggatccaacggcggtgtggggacttggtggggggggggggtctccttcggggggggtttgggggggtctaaggcccccccgtgaaggggaggggccgggggaaaacaatttgcggcggttcaggggtttagggggtgcgacaagggggggggggcggcccttttaaggggggggcctcccggggaaacccgtttttggggggggttgtcccgacaaagccccgggggggggtttttgatggaatttccccccacccgggggggaagaaaaaattcctttcccgacggagaggttttcctttgccccc

SEQ ID NO: 18959 - DNA, 711 bp, Zea mays
  misc_feature: Ceres CLONE 1385648-F
  misc_feature: Encodes the peptide sequence at SEQ ID NO. 18960
agagctggagctccccgcggtggcggccgctctagaactagtggatcccccgggctgcaggaattcgcacgagaccattacctagaacatcctaaccaaaaaaccgtgcaggcagcggtggacggtatggattcctcgttaaggtcagctttgaccgcgcggaaatggacagagagaccacagaccatgaccaccatgcccaccgcccagctcgctgctgcacactgccccactctcctctacctccgcgccaatgcgcctccccaacatttaaacggccaaaccagcccaaaccccaaacccacagtattaacagggggcacactatctaatgtaaacctcgccacgggacaggaatggcgtcgctccccgcttacccatcacgccctgcctctggctcttcctctgcctcctcgctgcgccgtgccccgcgtctcgggcggcgcggttcgcgatgtaacgccacgacgtccgcgagcgtccacgtgccacgcggtcgtctcctacgcgccgcccaaagggacgggcacgcccacgctggccgacgtgcgggcgctcttccagctccggtcccaccgagcgctgctgggcgccaaaggcctcccgctctacactccgcccactgcgcccgctcccgtgccggtgcgagtccgactgccctgcctctggtcagaaggcgccggggacacgatccatcgacccacgttacgg

SEQ ID NO: 18960 - protein, 175 aa, Zea mays
  misc_feature: Ceres CLONE 1385648-F
MTTMPTAQLAAAHCPTLLYLRANAPPQHLNGQTSPNPKPTVLTGGTLSNVNLATGQEWRRSPLTHHALPLALPLPPRCAVPRVSGGAVRDVTPRRPRASTCHAVVSYAPPKGTGTPTLADVRALFQLRSHRALLGAKGLPLYTPPTAPAPVPVRVRLPCLWSEGAGDTIHRPTLR

SEQ ID NO: 18961 - DNA, 696 bp, Zea mays
  misc_feature: Ceres CLONE 1385649-F
  misc_feature: Translation starting site: 209
  misc_feature (401)..(401): n is a, c, t, g, unknown, or other
  misc_feature (426)..(426): n is a, c, t, g, unknown, or other
  misc_feature (446)..(446): n is a, c, t, g, unknown, or other
  misc_feature (517)..(517): n is a, c, t, g, unknown, or other
  misc_feature (538)..(538): n is a, c, t, g, unknown, or other
  misc_feature (627)..(627): n is a, c, t, g, unknown, or other
  misc_feature (675)..(675): n is a, c, t, g, unknown, or other
aaagctggagctccccgcggtggcggccgctctagaactagtggatcccccgggctgcaggaattcgcacgagaccattacctaagaacatcctaatcgaaaattaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgttgntcggggctggcgctgacggctccgnggggtgggggctggccgggnccaccgcccggtgttcctgatcttcagccccgtgctcgtccccgccgcgctgctcatcggggacggcgggncatgggtctctctacgcgggncgcgctttgggtttttctgggggccctgcccctcgtctcacgtgcctcgccaaacgggggggggggaggcgttccagcgcacccgggantaataaggtgaaggaggcgcaccgcaaaaattatggcgggaggccgcnggcgcacgcgggccacaagaa

SEQ ID NO: 18962 - DNA, 683 bp, Zea mays
  misc_feature: Ceres CLONE 1385658-F
  misc_feature: Translation starting site: 119
  misc_feature: Pfam Name: Acetyltransf_1 Pfam Description: Acetyltransferase (GNAT) family
  misc_feature: SWISSPROT Homolog: EC 2.3.1.110 Tyramine N-feruloyltransferase
  misc_feature (477)..(477): n is a, c, t, g, unknown, or other
  misc_feature (530)..(530): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (645)..(645): n is a, c, t, g, unknown, or other
tccccgcggtggcggccgctctagaactagtggatcccccgggctgcaggaattcgcacgagaccattacctagaacatcctaatcgaaaacccgtttctctacacttcctgacccagatggcggcggcgccctgctctaccaccttctccggcgacgtgtgggcggagctgcgcctggcctccgctagcgatgtgccgcacatccaccgcctgatacaccagatggccgagttcgagctcctcaccgacctcttcgccgccaccgaagagctgctcacctccacgctcttcccctcgccgacgccgcctcccttcacctccttcacagccctcatcctcgacctatcccccttcccccgtcgcccccgacccctcgtccaccatcgcctcccgccgcctcgacctctccgcgtccccgctcgcggaccccgaggccgccgccttcgcctccccgcgcggaggcgggcgggcaccgnccggggttcgtgatctgcttccccaactactccaccttcctctccaagccggnctcctacgtggaggacatcttcgtgcgcgcgcctggnnncgccgcgggtttcgggcgggaatgatgctgtccgccgtcgccgggcagggcggcgaaactctggatgggccccccntgggaaaggggtcgcgtgttcgactgggaacaagaacg

SEQ ID NO: 18963 - DNA, 668 bp, Zea mays
  misc_feature: Ceres CLONE 1385659-F
  misc_feature: Encodes the peptide sequence at SEQ ID NO. 18964
  misc_feature (526)..(526): n is a, c, t, g, unknown, or other
  misc_feature (541)..(541): n is a, c, t, g, unknown, or other
  misc_feature (622)..(622): n is a, c, t, g, unknown, or other
cgcggtggcggccgctctagaactagtggatcccccgggctgcaggaattcgcacgagaccattacctagaacatcctaatcgaaaaatcagaaaccgatccttgtccctagcagcgcgcgacacgcacgtacccagcgcgcgagaaatcttacatcgatcatcacctgcgagccagccggccgagcagcaccgatggcggggtacatgcgcgtgacgcaccgcgacgaggaaggcaagaaggtgacggagaagatgccggtcccggaaacgcggcgcccggacacggacaagcacttcgagcgcaagctggaggagcaggacctccaccgcttcaagcggcacccggcgaacgcgccccggggcgtgggcatcggcgccccgccgcccaagtccggtcgcggcggcgagtacacctgggagggccccggcagcgtcgtcaaagaccagctcgacccgacgccgcccgccatcgaccccaacgacgccaactacgaggaggtggaggacgacgaggcgaccagggnaggtgcccgtcgtgnaaggaggaggtcgctacggtcgccgagtggcacggacggtgtcgccaaggagtcgacgtccccggccgggcctagctcagnaacagaaagcagtaaagaagacttgtcttttcctggatacgactaa

SEQ ID NO: 18964 - protein, 157 aa, Zea mays
  misc_feature: Ceres CLONE 1385659-F
  misc_feature (111)..(111): Xaa is any aa, unknown, or other
  misc_feature (116)..(116): Xaa is any aa, unknown, or other
  misc_feature (143)..(143): Xaa is any aa, unknown, or other
MAGYMRVTHRDEEGKKVTEKMPVPETRRPDTDKHFERKLEEQDLHRFKRHPANAPRGVGIGAPPPKSGRGGEYTWEGPGSVVKDQLDPTPPAIDPNDANYEEVEDDEATRXGARRXRRRSLRSPSGTDGVAKESTSPAGPSSXTESSKEDLSFPGYD

SEQ ID NO: 18965 - DNA, 651 bp, Zea mays
  misc_feature: Ceres CLONE 1385662-F
  misc_feature: Encodes the peptide sequence at SEQ ID NO. 18966
  misc_feature (565)..(565): n is a, c, t, g, unknown, or other
tccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaaggtcatggctgtccgcatcatcaagcatacccctggagatcattcacctgctcaccgatgccaccccatccaggtcgtcgtcgacgcgatcatcaacagtggaccccgtgagatgcaccccgattgttcccccctggggntggggaagggaagcaagccccgggatatctcacccggggagagggtggaacaggccatctacctcctcacactgtgggccggggag

SEQ ID NO: 18966 - protein, 156 aa, Zea mays
  misc_feature: Ceres CLONE 1385662-F
  misc_feature (44)..(156): Pfam Name: Ribosomal_S7 Pfam Description: Ribosomal protein S7p/S5e
  misc_feature (128)..(128): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVRIIKHTPGDHSPAHRCHPIQVVVDAIINSGPREMHPDCSPLGXGKGSKPRDISPGERVEQAIYLLTLWAGE

SEQ ID NO: 18967 - DNA, 667 bp, Zea mays
  misc_feature: Ceres CLONE 1385663-F
  misc_feature: Encodes the peptide sequence at SEQ ID NO. 18968
  misc_feature (291)..(291): n is a, c, t, g, unknown, or other
  misc_feature (384)..(384): n is a, c, t, g, unknown, or other
  misc_feature (385)..(385): n is a, c, t, g, unknown, or other
tccccgcggtggcggccgctctagaactagtggatcccccgggctgcaggaattcgcacgagaccattacctagaacatcctaatcgaaaaatactagcggatcctggcccgatccctcttcccacctacctccgcttctctccaagtgaggaaccccaagccctcgccatggcgtcgcggatcctggcccgatccaagtcccttcacctcgtcgccgccctcacccctgccgctgccaaagcagcaacgcctatcgccggagcccgcgcgctctcgtccctgccccgctnaccgtctgccccgtcgccccatgggctcggcaaggttctgggatatgaaccaacatctcacctcagtggaccacaagttttaacctcggtggnntttcctctctagcatcccaatggatctcaggtgcaggaagtcacagatctctgagacataccagttcagtgggggaaatggaacagtctgagaacacggaaatccagggagggagccccaccaaaaggtgtgggcgttcacatccgctataaaacaactatcgctaaacctagaagtaaccccctgaaaagggagaggtctaaaggttaggggtttcgagaatgccaaccccaggcacccttttaaagggatcccaagcccgtggttcttggctccaagaaa

SEQ ID NO: 18968 - protein, 75 aa, Zea mays
  misc_feature: Ceres CLONE 1385663-F
  misc_feature (41)..(41): Xaa is any aa, unknown, or other
  misc_feature (72)..(72): Xaa is any aa, unknown, or other
MASRILARSKSLHLVAALTPAAAKAATPIAGARALSSLPRXPSAPSPHGLGKVLGYEPTSHLSGPQVLTSVXFPL

SEQ ID NO: 18969 - DNA, 643 bp, Zea mays
  misc_feature: Ceres CLONE 1385664-F
  misc_feature: Encodes the peptide sequence at SEQ ID NO. 18970
  misc_feature (521)..(521): n is a, c, t, g, unknown, or other
  misc_feature (533)..(533): n is a, c, t, g, unknown, or other
  misc_feature (566)..(566): n is a, c, t, g, unknown, or other
  misc_feature (567)..(567): n is a, c, t, g, unknown, or other
  misc_feature (571)..(571): n is a, c, t, g, unknown, or other
tccccgcggtggcggccgctctagaactagtggatcccccgggctgcaggaattcgcacgagaccattacctagaacatcctaatcgaaaaaatggcaataattccttcctccttcgttccccatttctcctctttctaggtttctacccctcatcggtcctcgctccacggccatggtgaggatgaagcaggtaaagatctcggtaaagaaggacgtggattcgtacacaatccgcggcactaacaaggtcgtccatgtgggcgactgcgtgctgatgcgggcgtcggactcggacaagcagccgtatgtggcgcgggtggagaagatggaggccgacggacgcggcagcgtgcgggtgcaggtgcgctggtactaccgccctgaggaatccaagggcggtcgccggcagttccacggcgccaaggagcttttcctttccgatcatttcgacctacagagcgcccacaccatcgaggggaaaatgtgttgtccactctttcaagaactacccaagcttgnataatggtcggncctgaggacttcttctcccgatttgagtacagnncggnccaaccggggtcggtcacccctggacggcgtgggggagtgttattgcgaaaatgtgaggatgcataccccac

SEQ ID NO: 18970 - protein, 115 aa, Zea mays
  misc_feature: Ceres CLONE 1385664-F
  misc_feature (25)..(116): Pfam Name: BAH Pfam Description: BAH domain
MVRMKQVKISVKKDVDSYTIRGTNKVVHVGDCVLMRASDSDKQPYVARVEKMEADGRGSVRVQVRWYYRPEESKGGRRQFHGAKELFLSDHFDLQSAHTIEGKMCCPLFQELPKL

SEQ ID NO: 18971 - DNA, 627 bp, Zea mays
  misc_feature: Ceres CLONE 1385665-F
  misc_feature: Pfam Name: Sec61_beta Pfam Description: Sec61beta family
  misc_feature (518)..(518): n is a, c, t, g, unknown, or other
tccccgcggtggcggccgctctagaactagtggatcccccgggctgcaggaattcgcacgagaccattacctagaacatcctaatcgaaaaagttaagatccactctatcgaccatcatcgcactgtgcaagcacgagaggcgcatacagaggattactaagccgtcagagtgtcatgacaagaggctggccaatgaggatgcacctgctagagggagcgcgccgtcatccgcaagcctgcgtaggcgtacgaccacaagtgctgctgctgcaggaggaggcgccaccagatcgatgctcctattctacactgatgaggctgccggccgctaaacgtcaccaaacgctgttctgatcctgagaattgcgctcgtagcctacattactgtgctccatgtactgcggaagctgtacgcacctccaatagattggcatgccatatccacaaagctgactccacaagagatgattctggtagagcatttacttgtatgtaagtgactatctgactctgttgncacagttgatgaatacgctttgcaatgctcccgaggctattcctaaatgcccggcagatttcgattaaagaaaatggcttcaaatttttgaaaattggctgggaattaa

SEQ ID NO: 18972 - DNA, 662 bp, Zea mays
  misc_feature: Ceres CLONE 1385668-F
  misc_feature: Encodes the peptide sequence at SEQ ID NO. 18973
  misc_feature (556)..(556): n is a, c, t, g, unknown, or other
  misc_feature (622)..(622): n is a, c, t, g, unknown, or other
  misc_feature (662)..(662): n is a, c, t, g, unknown, or other
gctctagaactagtggatcccccgggctgcaggaattcgcacgagaccattacctagaacatcctaatcgaaaaatcaagtacccaaaccctttcgatctgctcaactaccaaactctgctcctccctgcttccgtcacgcgagagcactccactcccacgcgaaccctagcagtggttctccctcggggccccgctaagcagcttggttccaagctgtagaagcatctccgatcccatccgcggcgggttgaggccatcagctccggtttctgcagccggatttgggatccgcgagatgtcttggtccgcgcccgacgacatcctcctctccacctccctcgccggcttcttggacacaaatgttgttcttcagggtgcttgtgaacgagtgattgtgggggaacaatattgtgatgttcctcttgggctgtacgtaatccggggagagaacgttgttttaatcggagaattggatcgcgaaaaggatgaactccctgctcacatgacctgtgtttcagaagcagaaataagaaaggctgaaaaggcagaacggnaagccagagatctgaaagggacgatgaggaaaccggatggagttcctggacttcgattacaccgtnaaccgcggtcgttgccgctcctccattgtggcgggattcn

SEQ ID NO: 18973 - protein, 121 aa, Zea mays
  misc_feature: Ceres CLONE 1385668-F
  misc_feature (87)..(87): Xaa is any aa, unknown, or other
  misc_feature (109)..(109): Xaa is any aa, unknown, or other
MSWSAPDDILLSTSLAGFLDTNVVLQGACERVIVGEQYCDVPLGLYVIRGENVVLIGELDREKDELPAHMTCVSEAEIRKAEKAERXARDLKGTMRKPDGVPGLRLHRXPRSLPLLHCGGI

SEQ ID NO: 18974 - DNA, 727 bp, Zea mays
  misc_feature: Ceres CLONE 1385673-F
  misc_feature: Translation starting site: 222
  misc_feature (18)..(18): n is a, c, t, g, unknown, or other
ttttcccccccctccctnttttcctccctctccctccctacggcggggaagaagctggagctccaccgcggtggcggccgctctagaactagtggatcccccgggctgcaggaattcgcacgagaccattacctagaacatcctaatcgaaaaatcaaccatattattgagaccaacaagcaacatataaggtggaatacagtagcaacaatagagcaacaatggcggacaagatattttccatccttatgctccttgctctttctgcatgtgttgctaacgcgaccatttttcctcaatactcacaagctcctatagctgcccttcttcccccataccttccatcaatgagcgcttcagtatgtgaaaacccagaccttcaaccctacgggctccaacaagcaatcgcagcaagcaacttacctttatgcacccctgatctttcaacaatcgacagccctatctttggtgcagtcattgggacaaaccatcagggcacaacagatgcagcaactcgtgataccagtgatcaggcaaggagctctggcaaacctttctccctactctgagcaacaacaatttcttccattcaaccaactgtctacactgaaacctgctgcttatttgcagcaaatgcaactactaccattcgggcaggttaggtactgccctgctctccggaggaaccagtttctttccagtttaaccaatatcggccggccctgga

SEQ ID NO: 18975 - DNA, 589 bp, Zea mays
  misc_feature: Ceres CLONE 1385675-F
  misc_feature: Encodes the peptide sequence at SEQ ID NO. 18976
ggagctccccgcggtggcggccgctctagaactagtggatcccccgggcttgcaggaattcgcacgagaccatttacctagaacatcctaatcgaaaacgattagaaacggacgaccgagaccgcctgggcggatccgagttcggacggcccatccgcccatcagagcatcagacgaccaccttcctgcccccattcgtttccgcatcggcgtatctcccggcggcaaaggcgcttctcctcccgacctccctgcggtgccggtacgacagtcgacaggatggcaatggccacatcagcatcgtaccctccacctcctccattttaccgattgtacaaaaaatttgagcaagatccctcatctgcaccagaacctccaccaccaattgatgaaccattcaaagccttgggtgttgattacaacaggagattgttgtgatttccaagctttggaaaagccttaatgggcccgtccactttttttttccccagggggcccccaaaatttttttcttttccaaaaaaaaggggttttttaaccccctccaaaaaaatttttttttttttttttggggcccgggaaatatttt

SEQ ID NO: 18976 - protein, 52 aa, Zea mays
  misc_feature: Ceres CLONE 1385675-F
MAMATSASYPPPPPFYRLYKKFEQDPSSAPEPPPPIDEPFKALGVDYNRRLL

SEQ ID NO: 18977 - DNA, 769 bp, Zea mays
  misc_feature: Ceres CLONE 1385677-F
  misc_feature: Encodes the peptide sequence at SEQ ID NO. 18978
gctctagaactagtggatcccccgggctgcaggaattcgcacgagaccattacctagaacatcctaatcgaaaaactcactcactccccccattcctacctttcttctcctccacctcgtcaggcaccctcaaaccctcgccgcaagaaagaagaggtcaatcaaatcgaaccaaaacctcccgaccccacaaggccaagctcatttccatggtggtgtacacgcaggaacatgtgtaccggcacccgtgggaccgggtgacagcggcggcgtggcgcaagttcacggatccggcctcctgtacggggctctcccaccgtcgcagaaggttaacacccctacaacggccgccctcgaactccggacacggggccgccttccagggccggggcggcttccaattaccggggggggggcccccgcccggtttcccttttttcgtccctggggcccgaattccctcccccgtccggccggggggggggtcccccaaaaaaggggggcccgcgggcttttggcccacttgggggtccaaagaacctccctctcggggggacggcccaagagggcccgggggccatgggaaaggtccgtccggtgggggcaacaggtcaagccttcccggggggcctccattcgagagtcgcagggaagcccgcgcctccctaagagaaaccaacttcccgggaacgcggccccaaacaaattgggaagacggtttcaggggaggggaaacccccgaatccggggggccgccccgttcgggggc

SEQ ID NO: 18978 - protein, 186 aa, Zea mays
  misc_feature: Ceres CLONE 1385677-F
MVVYTQEHVYRHPWDRVTAAAWRKFTDPASCTGLSHRRRRLTPLQRPPSNSGHGAAFQGRGGFQLPGGGPPPGFPFFVPGARIPSPVRPGGGSPKKGGPAGFWPTWGSKEPPSRGDGPRGPGGHGKGPSGGGNRSSLPGGPPFESRREARASLRETNFPGTRPQTNWEDGFRGGETPESGGPPRSG

SEQ ID NO: 18979 - DNA, 676 bp, Zea mays
  misc_feature: Ceres CLONE 1385681-F
  misc_feature: Translation starting site: 418
  misc_feature: SWISSPROT Homolog: EC 2.4.2.7 Adenine phosphoribosyltransferase
  misc_feature (350)..(350): n is a, c, t, g, unknown, or other
aagctggagctccccgcggtggcggccgctctagaactagtggatcccccgggctgcaggaattcgcacgagaccattacctagaacatcctaatcgaaaagcttcaatactagctcgctcaccactcaccagtcaccagtccagcaagcaacaacaaaggcgcaggaggaagcttgttttggaccgagcaagcgagccagccgagcgtgggagagagagagagaggaattaattgatgggcgaggaggccagctgcgacgccgtcagcctgacggaggccggcaccaacgccaagccgggtgggcaaggagaacggccgcgagccggctgcggctcccgccgccgcggncgacccccggctgcaggccatctccgacggcatccgcgtcgtgccgcacttccccaagcaaggcatcatgttcaacgacatcaccacgctgctgctgcgccccagggtgttcaaggacgccgtcgacctggtcgtcgagcggtaccgcgggatgggcatcgacgccgtcgccggggattgaagccaggggcttcgtgttcgccccggcgatcgcgctggctattggcgctaaattcatacctctgcgcaagcccaggaagctccccagtgaggtgatctccgaggaatacgttctccagtacgggactgattgcctggagatgcgg

SEQ ID NO: 18980 - DNA, 674 bp, Zea mays
  misc_feature: Ceres CLONE 1385682-F
  misc_feature: Encodes the peptide sequence at SEQ ID NO. 18981
tggagctccccgcggtggcggccgctctagaactagtggatcccccgggctgcaggaattcgcacgagaccattacctagaacatcctaatcgaaaaaccgcagccgcagcacaatcgcctcgccttcccttccccaccagcccgtctctctcttctctctgtctctcttctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcccccggcggcgcgcccgccaacgtcgcctgcgccatcggcaagctcggcggatcctccgccttcgtcggcaagttcggcgacgacgagttcgggcacatgttggtgaacatcctgaagcagaacaacgtgaacgcggaggggtgcctgttcgacaagcacgcgcggacggcgctggccttcgtgacccctcagcacgacggggagcgcgaggtcatgttctacaggaacccgagcgcggacatgctgctgacggaggcggagcttgacctgggcctggtggcgcgcgccagggtgttccactacggctccatctcgctca

SEQ ID NO: 18981 - protein, 153 aa, Zea mays
  misc_feature: Ceres CLONE 1385682-F
  misc_feature: SWISSPROT Homolog: EC 2.7.1.4 Fructokinase
MAPLGDGGAAAAAASNNLVVSFGEMLIDFVPDVAGLSLAESGGFVKAPGGAPANVACAIGKLGGSSAFVGKFGDDEFGHMLVNILKQNNVNAEGCLFDKHARTALAFVTPQHDGEREVMFYRNPSADMLLTEAELDLGLVARARVFHYGSISL

SEQ ID NO: 18982 - DNA, 697 bp, Zea mays
  misc_feature: Ceres CLONE 1385683-F
  misc_feature: Encodes the peptide sequence at SEQ ID NO. 18983
  misc_feature (356)..(356): n is a, c, t, g, unknown, or other
  misc_feature (487)..(487): n is a, c, t, g, unknown, or other
  misc_feature (497)..(497): n is a, c, t, g, unknown, or other
  misc_feature (697)..(697): n is a, c, t, g, unknown, or other
tggagctccccgcggtggcggccgctctagaactagtggatcccccgggctgcaggaattcgcacgagaccattacctagaacatcctaatcgaaaagaacaacttcctgcttgcacgcaagccactccgaggccaagtctagggtttgggaatctgtaggaggggagaggggagcgcgctcagggtcagggaggcgaagatgatcgaggtggtgctgaacgaccgcctggggaagaaggtgcgggtgaagtgcaacgaggacgacaccatcggcgacctcaagaagctggtggcggcgcagacggggacgcgccccgagaagatcccgcatccagaagtggtacaacattctacnagggaccaccatcacgctcaagggactacgaggatccacgaacgggatgggggctccgagctctactacaactagggggccctgacccccaaccgtggccctgatttaaaggttaattccgaatttctggnagtcatgggnggcgccttccagtcaccggggtcctttaagctaacaaggctcgcaaaacttatagggcaacttgagtggagctatggtagtaccgaatatgggtggggtgccaaactggcaaatgactattgacattcttgcataatattgacatggggacaagggatcaacctggcaaaactggtggccctgggtactcgcagaccttn

SEQ ID NO: 18983 - protein, 76 aa, Zea mays
  misc_feature: Ceres CLONE 1385683-F
MIEVVLNDRLGKKVRVKCNEDDTIGDLKKLVAAQTGTRPEKIPHPEVVQHSTRDHHHAQGTTRIHERDGGSELYYN

SEQ ID NO: 18984 - DNA, 734 bp, Zea mays
  misc_feature: Ceres CLONE 1385685-F
  misc_feature: Encodes the peptide sequence at SEQ ID NO. 18985
  misc_feature (213)..(213): n is a, c, t, g, unknown, or other
  misc_feature (214)..(214): n is a, c, t, g, unknown, or other
  misc_feature (241)..(241): n is a, c, t, g, unknown, or other
  misc_feature (439)..(439): n is a, c, t, g, unknown, or other
  misc_feature (441)..(441): n is a, c, t, g, unknown, or other
  misc_feature (442)..(442): n is a, c, t, g, unknown, or other
  misc_feature (517)..(517): n is a, c, t, g, unknown, or other
  misc_feature (551)..(551): n is a, c, t, g, unknown, or other
  misc_feature (574)..(574): n is a, c, t, g, unknown, or other
  misc_feature (575)..(575): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (667)..(667): n is a, c, t, g, unknown, or other
  misc_feature (668)..(668): n is a, c, t, g, unknown, or other
aaagctggagctccccgcggtggcggccgctctagaactagtggatcccccgggctgcaggaattcgcacgagaccattacctagaacatcctaatcgaaaaatcgcacaaatcctcttcctcgagttctcctcaaccaaattcaaagtcacagcggcgaaactctcggcgatgtctggccgcggcaagggcgggaagggtctgggcaagggnncggcgccaagcggcccaccgcaagggntgctgcgtgacaacatccagggcatcaccaagccggcgatccgcagttggcgaggagggggcggcgtcaagcgcatctcccggggcttcaatctaccaagggaagaaccccggcggggggggggttcccaagaaattcttttccccccccccggaaaaaaaagggtgtttttctccccggggaaaaaggccccgcggntnncccctttaagaaaccccggaagaacccccccccccccccaaaaaaaatgtggggcaccccccccccgtgagaacncttttttttcaaaaaacccctctcccaaaaaagnccccccgggggggcgggggaaanncccctcttaaggagaggggggttnnnnnnaaagggagaggcccccccccctcccccccggggggggaaaaaaaaaatgcctggggggggggnnggggcccccccccccggttgtggtttctttttcttcccacaaaaaaaaaaagggggggtgggtttt

SEQ ID NO: 18985 - protein, 137 aa, Zea mays
  misc_feature: Ceres CLONE 1385685-F
  misc_feature (15)..(15): Xaa is any aa, unknown, or other
  misc_feature (24)..(24): Xaa is any aa, unknown, or other
  misc_feature (90)..(90): Xaa is any aa, unknown, or other
  misc_feature (91)..(91): Xaa is any aa, unknown, or other
  misc_feature (116)..(116): Xaa is any aa, unknown, or other
  misc_feature (127)..(127): Xaa is any aa, unknown, or other
  misc_feature (135)..(135): Xaa is any aa, unknown, or other
MSGRGKGGKGLGKGXAPSGPPQGXLRDNIQGITKPAIRSWRGGGGVKRISRGFNLPREEPRRGGGSQEILFPPPGKKRVFFSPGKKAPRXXPLRNPGRTPPPPQKKCGAPPPRENXFFSKNPSPKKXPPGGRGKXPS

SEQ ID NO: 18986 - DNA, 689 bp, Zea mays
  misc_feature: Ceres CLONE 1385688-F
  misc_feature: Translation starting site: 218
  misc_feature: Pfam Name: Aminotran_4 Pfam Description: Aminotransferase class IV
  misc_feature (375)..(375): n is a, c, t, g, unknown, or other
  misc_feature (508)..(508): n is a, c, t, g, unknown, or other
  misc_feature (513)..(513): n is a, c, t, g, unknown, or other
  misc_feature (514)..(514): n is a, c, t, g, unknown, or other
cgctctagaactagtggatcccccgggctgcaggaattcgcacgagaccattacctagaacatcctaatcgaaaaattgcccatcacattccatcgaccagtctcaattcaaggagctgaggacgacctgtccgtccggagctgatcgagaaacggaggggcggttccagtttcagtccagctagctagctagctagaagatcccattcgctgacagatgggttcctacatccaaggagatgatgaggtccctgtgtacgagtcgggcgccgaggtgcttgcgaaggtgcaagagaaatgggcggcggcggcggcatcgcggcctcctccctacccggtcatgtactcgagcgtgttcggcggcatcatcctggnacccggcatgatgggttctccccatcgacgaccacatggtcccacggggccacggcgtgttcgacacggccatgatcctggacggcgccatggacgagctggacgcgcacctgggacggctcctccggtccgncgcgnnggccccgtgggcacggccccggttcgggcggaggcggtgggggggatcctgatccaaatgaccgcccctcgggttggcgcatgggttcatccggaaatggttcactccggggccggggattttctggtgtctccaagggttgcccgctcccgggttttaacggggggagatccct

SEQ ID NO: 18987 - DNA, 699 bp, Zea mays
  misc_feature: Ceres CLONE 1385689-F
  misc_feature (382)..(382): n is a, c, t, g, unknown, or other
  misc_feature (529)..(529): n is a, c, t, g, unknown, or other
  misc_feature (699)..(699): n is a, c, t, g, unknown, or other
tccccgcggtggcggccgctctagaactagtggatcccccgggctgcaggaattcgcacgagaccattacctagaacatcctaatcgaaaaactccactccatcattccgtgcctcacgagtcacgagtcactccaggtccaggctgagcagcaatggtgccgtaaacgatcggtctcaacgcggacccgctcctccagattctgcggaccctgtgcctcctggacctcaccgcggaggcagcgatgtccgggcggcgccacggagcctccccgagaggacggagcgggcagatcatgtacctgtggccgtgctggcggccacacacgaggtcagtgacgtacttccacgacgtgggcagaggaaggacttccacaccgtangctccgatcttcgcggcatcgactggctcagactcggccgagccggcgttctgggatgttgccgtgcccgcgttctgggatgaagtcccccttcacctggcaggcaattgacctctactaccccaataagctgccccctcggttccnatacccatcttgggggcagtccccgatccttgcctttttaggggaaggcgggaaccgcccggggggtttccccacccccatcccgaaacccccttgccaaaaaggtttcagtgaaggggggaaatttaatgggaagcggccctttgtgggccaggggcccaaagcccccn

SEQ ID NO: 18988 - DNA, 702 bp, Zea mays
  misc_feature: Ceres CLONE 1385692-F
  misc_feature: Translation starting site: 167
gctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgagcggggagcgccttacaaactccctcatgatgcacgggcgcaacaacggcaagaaggtcatggctgtccgcatcatcaagcataccctggagatcattcacctgctcaccgatgccaaccccatccaggtcggcgtcgacgccgatcatcaacagtggcccccgtgaggatgccacccgtattggttccgcctggtgttgtgagaaggcaggccgtggatatctcacccctggggagggtgaaccagggcatctacctcctccccactggggccagggagagtgctttccgggaaatcaaaaccattgccgagggcctggcaaatgagctgatcaacgctgccaagggt

SEQ ID NO: 18989 - DNA, 656 bp, Zea mays
  misc_feature: Ceres CLONE 1385704-F
  misc_feature: SWISSPROT Homolog: EC 2.6.1.1 Aspartate transaminase
  misc_feature (342)..(342): n is a, c, t, g, unknown, or other
  misc_feature (348)..(348): n is a, c, t, g, unknown, or other
  misc_feature (359)..(359): n is a, c, t, g, unknown, or other
cccccccagtaaaaggggaccttgggtagaacatcctgggcggggagcaaaactagcggctttttaacaaaaggccacagcttcttccccctcctccttctccgtcatccggggggggggcgggcggcgccaccgcacaagaagctagctcctgcctgtaccaccccggcatggcgatgctatcccgcgcagcctcctccgcggcccggcgcccgctgctgccgccgcctaggcttctggcggagagggcgatggcgtcgtcgctcttcggccacgtcgagcaggcgcccaaggaccccattttctgtgtaaccgaggggggggggggcggcccctcgtccnacaaantgaacctcccncgtccgcgcctaccgggacgacaacggccagcccgtcgggctcagctgggtgcgcgaggccgagcggcggatcgcgggcaacctccacatggaggaccttccgatgggagggagcatcaagatgattgaagaggccactggaactgggggacggagaacattctgacttcatgcaagataagagggtaccagcgggggcagggctttcaggcactggggcctgccggctccttgctgatttccaaaacgggtttttggcgggatcccagatctacataccagacaccgacggggtcg

SEQ ID NO: 18990 - DNA, 681 bp, Zea mays
  misc_feature: Ceres CLONE 1385705-F
  misc_feature: Translation starting site: 395
  misc_feature: SWISSPROT Homolog: EC 3.4.21.92 Endopeptidase Clp
  misc_feature (562)..(562): n is a, c, t, g, unknown, or other
aagctggagctccccgcggtggcggccgctctagaactagtggatcccccgggctgcaggaattcgcacgagaccattacctagaacatcctaatcgaaaaagattagtcacactcttcgcaagcacacaaaaaaaaaaaacccccaaatagcgtaaggataagcctcgccggcgacgaaatcagggtttcatcgaacaagaagatggctcacgcttgcgtctccacatcagcttcctctctcaggtttacagccggattcgtctccgcgagtcccaacgcctcctctttcgattctcagaagctttccctccctttcgagcctcttcgttcaagaaagacgaagaagttggttagcggcagaaagacggctccgaaggctgtatactccggcaatgtctggactccggagactccttcgcctcaaggagtttggtccatcagagatgatttacaagtcccttcttcgccgtattttcctgtgtacgctcaaggacaaggaccacctcctatggtgcaagagcgtttccagagtatcataagccagctcttccaatataggnattattcgttgtggtggtgctgtggatgatgatatggccaacataatcgtagctcagcttctttacctcgatgctgttgatcctactaaggatattggtatgtatgtgaactctccctg

SEQ ID NO: 18991 - DNA, 770 bp, Zea mays
  misc_feature: Ceres CLONE 1385715-F
  misc_feature (350)..(350): n is a, c, t, g, unknown, or other
  misc_feature (358)..(358): n is a, c, t, g, unknown, or other
  misc_feature (443)..(443): n is a, c, t, g, unknown, or other
  misc_feature (743)..(743): n is a, c, t, g, unknown, or other
tccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcagnaacatggntgcgccgctcctggtgctcaacctcatcatgtacttcatcgtcatcggcttcgcgagctggaacctgaaccacttcatcaacggnagaacaactaccccggggtgcccgcaaacgccgcgacagtctacttcctggggtccgccatcctggcgggggtggggggccccgccctccaagttgggggggggtggaccaagtgggggcttgggggcccaaaaggctggaccccaaagcgcgggggggtcttttatcgccggggggcataaggggggctcccctttgggggtgggcccgagagggaaaccccatcggggaacaccccgggttggggccctggccgcgttttaaaacccttttgaaaaaatcccccccctttgaagaagnctctccagagggggttgtgggcccggg

SEQ ID NO: 18992 - DNA, 661 bp, Zea mays
  misc_feature: Ceres CLONE 1385716-F
  misc_feature: Encodes the peptide sequence at SEQ ID NO. 18993
  misc_feature (535)..(535): n is a, c, t, g, unknown, or other
gctctagaactagtggatcccccgggctgcaggaattcgcacgagaccattacctagaacatcctaatcgaaaactagctcgtgcatgccgccctgagcgccactgcacagacgcgcagagacagacattgcgactttgcgagagacaaaacctcccagataacgcccgcgcgctccccgatggcgtcgtcgtgccagaacgtggagattcccggcaagccgacggagacggggacggcgctgctggagacggcgacgggcaccatccaggggttcgcgccgctgagccagatccaccagcacctgtgcgcgttccacttctacgcggacgacatggggcgccaggtggaggcgcaccacttctgcgcgcacctgaacgaggacgtgcggcagtgcctcatcttcgacgggcccggggccgggcgcgcgcctcatcggcgtggagtaccatcgtcctccgagacggtgttcctgacgctggccgacgccgagaagccgctgtggcacacgcacgagttcaaggtgaaaggggggngtgctggttcattgccggggtggccccggcgtggtggagcgcccgggaccgggagaaagtgggcaagacctacggcaagaccatccactttctggcagggggaaccgcggagacgcgctcccgctc

SEQ ID NO: 18993 - protein, 160 aa, Zea mays
  misc_feature: Ceres CLONE 1385716-F
  misc_feature (11)..(159): Pfam Name: DUF1264 Pfam Description: Protein of unknown function (DUF1264)
  misc_feature (119)..(119): Xaa is any aa, unknown, or other
MASSCQNVEIPGKPTETGTALLETATGTIQGFAPLSQIHQHLCAFHFYADDMGRQVEAHHFCAHLNEDVRQCLIFDGPGAGRAPHRRGVPSSSETVFLTLADAEKPLWHTHEFKVKGGXAGSLPGWPRRGGAPGTGRKWARPTARPSTFWQGEPRRRAPA

SEQ ID NO: 18994 - DNA, 739 bp, Zea mays
  misc_feature: Ceres CLONE 1385720-F
  misc_feature: Translation starting site: 231
  misc_feature: SWISSPROT Homolog: EC 2.5.1.67 Chrysanthemyl diphosphate synthase
  misc_feature (241)..(241): n is a, c, t, g, unknown, or other
  misc_feature (325)..(325): n is a, c, t, g, unknown, or other
  misc_feature (356)..(356): n is a, c, t, g, unknown, or other
  misc_feature (370)..(370): n is a, c, t, g, unknown, or other
  misc_feature (471)..(471): n is a, c, t, g, unknown, or other
  misc_feature (527)..(527): n is a, c, t, g, unknown, or other
  misc_feature (587)..(587): n is a, c, t, g, unknown, or other
  misc_feature (654)..(654): n is a, c, t, g, unknown, or other
tggagctccccgcggtggcggccgctctagaactagtggatcccccgggctgcaggaattcgcacgagaccattacctagaacatcctaatcgaaaaaccctgctgtctccctccctccttccttccttccccgccactgcgcagcgcgagtgcggcgacagccagtcacacactcacactccctcgaccgctctcggccccgtccgcgtcgccgcagggcgaggaggcaatggcggcggncgggaatggcgccggcggggacaccagggcggccttcgcgcggatctacaagacgctcaaggaggagctgctcaccgacccggncttcgagttcaccgaggagtcacgccagtgnatcgaccgcatggntgactacgatgtactcggaggcaagtgtaaccgtgggctctctgtggtcgacagctacaagctgctcaagggcgctgatgctctgggcgagggaggaaacngtccttgcttgcaccctcgggtggtgcattgaatggcttcaggctttctttcttgngcttgatgatatcatgggatgactctcacactcgtcgcgggcaggctttgctggtcaggnggccctcaggtggcttaaatggctgcgaatgacgggatcatccttcgcaaccattatctcagggatncttcgggggccactttaagggcaaaacttacctaggctggatctcctggatttggtccaaggagggtgagttcaaggacaggttt

SEQ ID NO: 18995 - DNA, 707 bp, Zea mays
  misc_feature: Ceres CLONE 1385721-F
  misc_feature: Encodes the peptide sequence at SEQ ID NO. 18996
cgctctagaactagtggatcccccgggctgcaggaattcgcacgagaccattacctagaacatcctaatcgaaaaagatcagaccacactcgtagagagaaggaaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgagggggggcgcgggaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcgggcaggtcgtcgagggcatggacgtcgtcaagggcatcgagagggtggcacccgcaacggctccacctccagggtggtcaaggtcgctgactgcggaagctctcctagatctctctggatctgggctggtcggccggcctcccctcggcatcgtcgactcc

SEQ ID NO: 18996 - protein, 190 aa, Zea mays
  misc_feature: Ceres CLONE 1385721-F
  misc_feature (5)..(171): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MANPRVFFDMTVGGAPAGRIVMELYANEVPKTAENFRALCTGEKGVGKSGKPLHYKGSTFHRVIPEFMCQGGEGGRGNGTGGESIYGEKFPDEKFVRKHTAPGVLSMANAGPNTNGSQFFICTVATPWLDGKHVVFGQVVEGMDVVKGIERVAPATAPPPGWSRSLTAEALLDLSGSGLVGRPPLGIVDS

SEQ ID NO: 18997 - DNA, 691 bp, Zea mays
  misc_feature: Ceres CLONE 1385728-F
  misc_feature: Encodes the peptide sequence at SEQ ID NO. 18998
  misc_feature (356)..(356): n is a, c, t, g, unknown, or other
  misc_feature (395)..(395): n is a, c, t, g, unknown, or other
aagctggagctccccgcggtggcggccgctctagaactagtggatcccccgggctgcaggaattcgcacgagaccattacctagaacatcctaatcgaaaaagaagcatcacacactaatcaacaagcaggaccagctagctagctcctctcactgctatcacccgcccagccatctcgctgaaagagaaaagcgcagccatgaagactactagctcgggcattgcagtcgtcctactggtggccatgctggcagtccattccgcgttggccgacatctcgtgctccgacgtgctcaacgacctgtcgccgtgcctgcccttcctgcaggggcaggcagccaaacccagcgagagncacaacagtgctgcgacggcgtgagggccctgtacgcgncggcgggacaccaggcccgacaggcaggccacgtggcggtgcctcagggcggctaacgtccaggccacgctgggctctcggggggaaagagttgcccggggactgggccctctcgtggcctaaaaattccccccgaaatggatggggaaaaaaatgaagggagggaaatggtccctttaaccaaacccataaaggggggggggggggttcggggcccggttaaaaaaagggcgcttcgccccggggggaaaaaaaaaaaagagtttggggaggttttggcgaaaaaaaggggccct

SEQ ID NO: 18998 - protein, 59 aa, Zea mays
  misc_feature: Ceres CLONE 1385728-F
  misc_feature (52)..(52): Xaa is any aa, unknown, or other
MKTTSSGIAVVLLVAMLAVHSALADISCSDVLNDLSPCLPFLQGQAAKPSEXHNSAATA

SEQ ID NO: 18999 - DNA, 730 bp, Zea mays
  misc_feature: Ceres CLONE 1385730-F
  misc_feature: Encodes the peptide sequence at SEQ ID NO. 19000
  misc_feature (363)..(363): n is a, c, t, g, unknown, or other
  misc_feature (471)..(471): n is a, c, t, g, unknown, or other
  misc_feature (480)..(480): n is a, c, t, g, unknown, or other
tccccgcggtggcggccgctctagaactagtggatcccccgggctgcaggaattcgcacgagaccattacctagaacatcctaatcgaaagtgtttctgctgccgtctccaagaccgctgctgctcctattgagcgtgtcaagcttttgattcagaaccaggatgagatgcttaaggctggcaggctctctgagccttacaagggtattggtgactgtttcggcaggaccattaaggatgagggttttggttctttgtggaggggaaacactgctaatgttatccgttacttccccactcaggcgttgaactttgcgttcaaagattacttcaagaggcttttcaacttcaagaaggacaggnatggttactggaagtggtttgctgggaacttgggatctggaggtgcagctggtgcctcttcccttctcttcgtgtactctcttgactacgcacgtacccgtctcgccnatgactccnaggctgccaagaagggaggtgaaaggcagttcaatggtcttgtcgatgtctacaagaagacccctcagtctgatggtattgctggactctaccgtggattcacatctcctgtgttgtatcattggctaccgtggtctctactttgggctgtacgactctttgaagctcttctccctgctgaccccaggacagctcttcgctagttttgcccctggatggtcatcaccaagggggctggtcttgcatctac

SEQ ID NO: 19000 - protein, 171 aa, Zea mays
  misc_feature: Ceres CLONE 1385730-F
  misc_feature (71)..(166): Pfam Name: Mito_carr Pfam Description: Mitochondrial carrier protein
  misc_feature (3)..(63): Pfam Name: Mito_carr Pfam Description: Mitochondrial carrier protein
  misc_feature (66)..(66): Xaa is any aa, unknown, or other
  misc_feature (102)..(102): Xaa is any aa, unknown, or other
  misc_feature (105)..(105): Xaa is any aa, unknown, or other
MLKAGRLSEPYKGIGDCFGRTIKDEGFGSLWRGNTANVIRYFPTQALNFAFKDYFKRLFNFKKDRXGYWKWFAGNLGSGGAAGASSLLFVYSLDYARTRLAXDSXAAKKGGERQFNGLVDVYKKTPQSDGIAGLYRGFTSPVLYHWLPWSLLWAVRLFEALLPADPRTALR

SEQ ID NO: 19001 - DNA, 724 bp, Zea mays
  misc_feature: Ceres CLONE 1385734-F
  misc_feature: Translation starting site: 197
  misc_feature (324)..(324): n is a, c, t, g, unknown, or other
  misc_feature (359)..(359): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (367)..(367): n is a, c, t, g, unknown, or other
  misc_feature (369)..(369): n is a, c, t, g, unknown, or other
  misc_feature (383)..(383): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (398)..(398): n is a, c, t, g, unknown, or other
  misc_feature (399)..(399): n is a, c, t, g, unknown, or other
  misc_feature (402)..(402): n is a, c, t, g, unknown, or other
  misc_feature (403)..(403): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (426)..(426): n is a, c, t, g, unknown, or other
  misc_feature (431)..(431): n is a, c, t, g, unknown, or other
  misc_feature (432)..(432): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (459)..(459): n is a, c, t, g, unknown, or other
  misc_feature (488)..(488): n is a, c, t, g, unknown, or other
  misc_feature (489)..(489): n is a, c, t, g, unknown, or other
  misc_feature (497)..(497): n is a, c, t, g, unknown, or other
  misc_feature (521)..(521): n is a, c, t, g, unknown, or other
  misc_feature (526)..(526): n is a, c, t, g, unknown, or other
  misc_feature (635)..(635): n is a, c, t, g, unknown, or other
  misc_feature (661)..(661): n is a, c, t, g, unknown, or other
  misc_feature (664)..(664): n is a, c, t, g, unknown, or other
  misc_feature (667)..(667): n is a, c, t, g, unknown, or other
tggagctccccgcggtggcggccgctctagaactagtggatcccccgggctgcaggaattcgcacgagaccattacctagaacatcctaatcgaaaaacctaaccgattcccatccaaccaaccccgcacaccgccgcgggaagcagaagagactggaagagcctacaaaatcttgggggcgcggcacaacgcaggatggtgggcttcctccgggccttcgccgccgcttccgctgtgcccgcagcagctgccgcagcctatactctctttccctcctccgccccttccttctccaagctccgcttccctcttcctgactcctncctgctccgccgccgctctttaaaagcgccggggngnnnnntngnagggggggggcggnggaggnnnnannnanngannaannnnaagggaggggaaggaanggggnngggggaggggggggnnnnttccggggngggggaaacacggaagggggggaagaagnngaaggggngggaaagggccggggggggggggnaaggnaaaaggaggggcccccggggaaggcgaagccgggggccccaaacccaagggaacccccgaccggaacccggcggtgacccccccaaaagccaaccgcccccaaggacgnggggggccgaagggagcggcaggggntcnttngggggggtgggttccgaaacccgcccccggggaaggaggcttcccggggccacccct

SEQ ID NO: 19002 - DNA, 685 bp, Zea mays
  misc_feature: Ceres CLONE 1385738-F
  misc_feature: Translation starting site: 213
  misc_feature: SWISSPROT Homolog: EC 1.6.5.3 NADH dehydrogenase (ubiquinone)
  misc_feature (447)..(447): n is a, c, t, g, unknown, or other
tggagctccccgcggtggcggccgctctagaactagtggatcccccgggctgcaggaattcgcacgagaccattacctagaacatcctaatcgaaaaactcccgcaggccgcagcccagcaccggacgctctacgcctccacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcatagaggatgaggagaaagaacagcttgcaaagatgtcgcacagaattggatgctgtgtttgaaagagcatcatacattgtttttgactgaaatggtccgtgncttgatgctaactctcaagtacttctttgatagaaatgtcacattaactatccgtttgagaaggtcctctgaggcccggctcccggggtgacatgctctcaaacgttatgaatctggggagagcgctgcattgctggtaactatgcgaactatatgccagggggagcattacaatttaggctgaaaaacgtgaaatggcatccccaaccccaaaattggatttgacttggccaggggt

SEQ ID NO: 19003 - DNA, 722 bp, Zea mays
  misc_feature: Ceres CLONE 1385739-F
ggagctccccgcggtggcggccgctctagaactagtggatcccccgggctgcaggaattcgcacgagaccattacctagaacatcctaatcgaaaaattgggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggtgagcgccgggaacgagccctccgtcctcctactagctgcgatccgtagccttgcgtcgctttcgcgcctagtctagatcgccacgttctagatctgtgggtgttttactttcccgggtgcgggtggtcgaatccttccatcccacaggagagctcgtggctttgtcttgattagctcggtctcccctgtggccgtgatctgaatacgtccggatctgtctgctgtatcatcaggaaggtagaaggctgaggggttgaagttgaacctggatggcgccgggttcccccctcttgaaaccaaagggccgtcttttatccgggggggttgtggaagggggagattcccccccggggggggcacccctaccccccccccggggtccggaaactgggccccgggaaccccccccgggaaaaaaacccagaaccccgggggccccccccttc

SEQ ID NO: 19004 - DNA, 654 bp, Zea mays
  misc_feature: Ceres CLONE 1385742-F
  misc_feature: Encodes the peptide sequence at SEQ ID NO. 19005
  misc_feature (358)..(358): n is a, c, t, g, unknown, or other
  misc_feature (372)..(372): n is a, c, t, g, unknown, or other
  misc_feature (385)..(385): n is a, c, t, g, unknown, or other
  misc_feature (540)..(540): n is a, c, t, g, unknown, or other
  misc_feature (553)..(553): n is a, c, t, g, unknown, or other
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatgggccggaattgncagggacatggtgncgccgctcctggntgctcacctcatcatgtacatcatcgtcatcggcttcgcgagctggaacctgaaccacttcatcaacgggcagaccaactaccccggcgtggccggcaacggcgcgacgttctacttccctggtgtcgccatcctggccggcgtggtgggcgcgncgtccaagctggncggcgtgcaccacgtgcgcgcctggcgccacgacagcctggccaccaacgccgcgtcgtcgctcatcgcctggggcatcacggcgctcgccttncggctgg

SEQ ID NO: 19005 - protein, 96 aa, Zea mays
  misc_feature: Ceres CLONE 1385742-F
  misc_feature (10)..(96): Pfam Name: AWPM-19 Pfam Description: AWPM-19-like family
  misc_feature (3)..(3): Xaa is any aa, unknown, or other
  misc_feature (7)..(7): Xaa is any aa, unknown, or other
  misc_feature (59)..(59): Xaa is any aa, unknown, or other
  misc_feature (63)..(63): Xaa is any aa, unknown, or other
  misc_feature (94)..(94): Xaa is any aa, unknown, or other
MVXPLLXAHLIMYIIVIGFASWNLNHFINGQTNYPGVAGNGATFYFPGVAILAGVVGAXSKLXGVHHVRAWRHDSLATNAASSLIAWGITALAXRL

SEQ ID NO: 19006 - DNA, 727 bp, Zea mays
  misc_feature: Ceres CLONE 1385743-F
  misc_feature: Encodes the peptide sequence at SEQ ID NO. 19007
aagctggagctccccgcggtggcggccgctctagaactagtggatcccccgggctgcaggaattcgcacgagaccattacctagaacatcctaatcgaaaaccagctccgcctccttttcctgccttcctcctcactagtcgctcccccgcggctcgcgcaggcgggcgacacaacgaggctaaatccctatcgcgaggaggcgtgtgaggccagcggctttgcgatgacagcaccagcggacaaggggaagaaggccaagactgatgccgacggcggcgaggagaacgaacagatcgacggcgtcctcgtcctctccatcgagaagctccaggagatacaggacgagctcgaggaggtaaatgagggaacaagtggagagggttatggaggttgaacaaaattacggggagatcgcagaccgtgctatctcaagaggggggacattatcaagaccatcccggattttggggtccaggggtttatgacccaccctccataaaggggagtttctggacgggagggggcccaaaaaaatttccggggcctaaaccccccttgggggggggagggactccggggggtaagggggggaaacccccctctccctcttaaccttcccggggaaaacccgaatttttggagggcccacaaggttttgggaaaaaaccaatatttttgtggggggggggggggaacaccccccccaaaaagagtttccggaaaag

SEQ ID NO: 19007 - protein, 56 aa, Zea mays
  misc_feature: Ceres CLONE 1385743-F
MTAPADKGKKAKTDADGGEENEQIDGVLVLSIEKLQEIQDELEEVNEGTSGEGYGG

SEQ ID NO: 19008 - DNA, 653 bp, Zea mays
  misc_feature: Ceres CLONE 1385746-F
  misc_feature: Translation starting site: 159
  misc_feature (398)..(398): n is a, c, t, g, unknown, or other
  misc_feature (421)..(421): n is a, c, t, g, unknown, or other
  misc_feature (511)..(511): n is a, c, t, g, unknown, or other
  misc_feature (527)..(527): n is a, c, t, g, unknown, or other
  misc_feature (583)..(583): n is a, c, t, g, unknown, or other
  misc_feature (598)..(598): n is a, c, t, g, unknown, or other
aagctggagctccccgcggtggcggccgctctagaactagtggatcccccgggctgcaggaattcgcacgagaccattacctagaacatcctaatcgaaaaatcgccccgcgaaccctagctcccgcaactgccgccgccactcccacgctcgcagccatgccgcccaagctcgacccgtcgcaggtggtggaggtgttcgtccgtgtgaccggcggcgaggtcggcgcagcgtcttcgctggcccccaagatcggcccgctcggtctttcccccaagaagatctggagaggacatcgccaaggagacggccaaggactggaagggcctccgcgtcaccgtcaagctcaccgtccagaaccggcaggccaaggtctccgtcgtcccctccgccgcggngctcgtcatcaaggcgctcaggnagccagagagggacccgcagaaggtcaagaaccatcagcacagcggcaacatcagcctcgacgacgtcatcgagatcgccaggaccatgnagcacaggtccatggnccagggatttggccggcaccgtcaaggagatcctcggtacctgcgtcagcgtcggntgcaccgtcgacggnaaggaccccagggacttgcagcaagaaattgacgacagcaagggtgaagatcctg

SEQ ID NO: 19009 - DNA, 742 bp, Zea mays
  misc_feature: Ceres CLONE 1385748-F
  misc_feature: Encodes the peptide sequence at SEQ ID NO. 19010
aaagctggagctccccgcggtggcggccgctctagaactagtggatcccccgggctgcaggaattcgcacgagaccattacctagaacatcataatcgaaaactgcgctccgaataccccagacccccgatcctcccaatggccaccgcattttcgctgcgcgctgcggacccggacaccgctccccgcgccgtctcccgatccacctccgcggcgagggtcgtgcccgtggcctcggcactggcgggacgcggaaggctggtggcgcgtgcagcagttacagcaaaggcggatgtaccatcaagcacgtccgacggccatgaggtcttgctgtttgaagctcttcgtgaggccttgatggaagagatggaattagatccagcagtgtgtgtatttggtgaagatgttggccattacggtggttcttacaaggtgacaaaaggtttggctgatacgtttggagaccttcgagttctggacacccctattgcggagaactcgtttactggcatgggagttgcagcgagaatgaaagggctgaggcccgtcgttgaaggcatgaacatgggattcctgctccttgcttacaaccagatctcaaataactgtggcatgcttcattacacttccggcgagcagatcaaaatcccacttgtgatccgtggccccggtggtgtggatcgtcagcttggagcagagcactcgcagcgtctgggatcgtatttccagtgcatcccggcct

SEQ ID NO: 19010 - protein, 201 aa, Zea mays
  misc_feature: Ceres CLONE 1385748-F
  misc_feature (61)..(201): Pfam Name: Transket_pyr Pfam Description: Transketolase, pyrimidine binding domain
  misc_feature: SWISSPROT Homolog: EC 1.2.4.1 Pyruvate dehydrogenase (acetyl-transferring)
MATAFSLRAADPDTAPRAVSRSTSAARVVPVASALAGRGRLVARAAVTAKADVPSSTSDGHEVLLFEALREALMEEMELDPAVCVFGEDVGHYGGSYKVTKGLADTFGDLRVLDTPIAENSFTGMGVAARMKGLRPVVEGMNMGFLLLAYNQISNNCGMLHYTSGEQIKIPLVIRGPGGVDRQLGAEHSQRLGSYFQCIPA

SEQ ID NO: 19011 - DNA, 770 bp, Zea mays
  misc_feature: Ceres CLONE 1385754-F
  misc_feature: Encodes the peptide sequence at SEQ ID NO. 19012
  misc_feature (17)..(17): n is a, c, t, g, unknown, or other
  misc_feature (19)..(19): n is a, c, t, g, unknown, or other
  misc_feature (39)..(39): n is a, c, t, g, unknown, or other
  misc_feature (40)..(40): n is a, c, t, g, unknown, or other
  misc_feature (49)..(49): n is a, c, t, g, unknown, or other
  misc_feature (50)..(50): n is a, c, t, g, unknown, or other
gggggcgccccgcgggngnggggcgggtcgcccggcttnntttcccccnncccacaactggagctccccgcggtggcggccgctctagaactagtggatcccccgggctgcaggaattcgcacgagaccattacctagaacatcctaatcgaaaaaattgaaaacagggccttggccgagttaaaaaaaacgggagtgaaacacactgacaccgcacacacgccaaccgggctaccgccttcttctcttgtctcgtcctcctcgcgactatagccgccgtccgtcgaggtagatcccaaccccaacccgccgccaaatagagcctccgttctctccaagagcaagacgcgggaggccgaccggcgccgacgccgtcgcagcaaggtcaaaaagaacaagtccgtcactgagggtgatggccaggatggtgaggggggagcttctcgttccgacgacaaggacaaccccccatcccaaccccgatcctcagattgaggtggagataaagtacgttgccggagaagggcgagcttggagaccctctcctggaggatgtcaagggcatcttaccagaaagggaaccttgagggacggttgcttgcggccggaggtcgcgggcgggatgataacggaccgcgggggcccgcctcatgcccaccaaagaaaagggggtcatctgggatggatggcctgggcggaggaactaaacaattgagggcacggcgggcggggccagctgcaccaaggaaagcgggcgcaacgggccccta

SEQ ID NO: 19012 - protein, 99 aa, Zea mays
  misc_feature: Ceres CLONE 1385754-F
MARMVRGELLVPTTRTTPHPNPDPQIEVEIKYVAGEGRAWRPSPGGCQGHLTRKGTLRDGCLRPEVAGGMITDRGGPPHAHQRKGGHLGWMAWAEELNN

SEQ ID NO: 19013 - DNA, 730 bp, Zea mays
  misc_feature: Ceres CLONE 1385756-F
tccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgagttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcaggcattggtacaaaccatcagggcacaacagctgcagcaactcgtgctacctctgatcaaccaagtagctctggcaaacctttctccctactctcagcaacaacaatttcttccattcacacaactgtctacactgaaccctgctgcttatttgcagcaacaactattaccatttagccagctagctactgcctactctcagcatcaacaacttcttgcatataaccaattggccgcactgaaccccgctgcttatgtgcagcagcaaatactactaccatttagtcagctagctgcagcaaagcgtgcttccttcatga

SEQ ID NO: 19014 - DNA, 740 bp, Zea mays
  misc_feature: Ceres CLONE 1385757-F
  misc_feature: Encodes the peptide sequence at SEQ ID NO. 19015
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
nnnnnnnnnnnnnnnccccccccccccccggcacnnccctctannnnnacacagctggcgctccccgcggtggcggccgctctagaactagtggatcccccgggctgcaggaattcgcacgagaccattacctagaacatcctaatcgaaaaacctcagcactagtctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcacggctatggacgtcgtgtacgccctcaaacgccagggccgcactctctatggcttcggggggtagggtaggggtgggtaattgcctgtccaggggtcccgaacctggggcactagtttggctgccttcctggggtcgaattggaagaagtggggggaggtggggtgctttgggcgccctggaagcggggctttcttttgggtccggaaaaaacccgcttggttccgatggggaattggaatgggaccgcgggaa

SEQ ID NO: 19015 - protein, 103 aa, Zea mays; identical to SEQ ID NO: 6459
  misc_feature: Ceres CLONE 1385757-F
  misc_feature (25)..(94): Pfam Name: Histone Pfam Description: Core histone H2A/H2B/H3/H4

SEQ ID NO: 19016 - DNA, 715 bp, Zea mays
  misc_feature: Ceres CLONE 1385760-F
  misc_feature: Encodes the peptide sequence at SEQ ID NO. 19017
  misc_feature (483)..(483): n is a, c, t, g, unknown, or other
  misc_feature (715)..(715): n is a, c, t, g, unknown, or other
ctccccgcggtggcggccgctctagaactagtggatcccccgggctgcaggaattcgcacgagaccattacctagaacatcctaatcgaaaaaacctcatcttctctccttttgctcgcaacgcacacaccggccggtctccgatctccgatccccgatcccctcggctatccaagatgcagatcttcgtcgagactctcactggaaagactatcaccctcgaggtggagtcctctgacaccattgacaacgtccaggccaagatccaggacaaggaaggcattcccccggaccagcagggaatcatcttcgctggcaagcagctcgaggacgggcgcacacttgccgactacaacatccagaaggagagcaccctccaccttgttctccgcctcaggggaggcatgcagatcttcttcaagaccctcactggaaagactatcaccctcgaggtggagtcttctgacaccatcgacaacgtcnaggccaagatccaggacgaggagggcatccctccggaccagcagcggctcatttttgctggcaagcagctcgaggacgggcgcacgctggccgactacaacattcagaaggagagcaccctccacttggtgttgcgtctcaggggcggcatgcagatcttcgtgaagactctgactggcaagactatcacccttggaggtcgagtcttctgataccattgactatgtcaagn

SEQ ID NO: 19017 - protein, 172 aa, Zea mays
  misc_feature: Ceres CLONE 1385760-F
  misc_feature (82)..(150): Pfam Name: ubiquitin Pfam Description: Ubiquitin family
  misc_feature (6)..(74): Pfam Name: ubiquitin Pfam Description: Ubiquitin family
  misc_feature (103)..(103): Xaa is any aa, unknown, or other
MQIFVETLTGKTITLEVESSDTIDNVQAKIQDKEGIPPDQQGIIFAGKQLEDGRTLADYNIQKESTLHLVLRLRGGMQIFFKTLTGKTITLEVESSDTIDNVXAKIQDEEGIPPDQQRLIFAGKQLEDGRTLADYNIQKESTLHLVLRLRGGMQIFVKTLTGKTITLGGRVF

SEQ ID NO: 19018 - DNA, 726 bp, Zea mays
  misc_feature: Ceres CLONE 1385761-F
  misc_feature: Encodes the peptide sequence at SEQ ID NO. 19019
  misc_feature (455)..(455): n is a, c, t, g, unknown, or other
  misc_feature (636)..(636): n is a, c, t, g, unknown, or other
  misc_feature (660)..(660): n is a, c, t, g, unknown, or other
aagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccggactgatcctggccggcaccgtgatcgcgctcacggtggccacccccgtgctggtgatcttcagcccgggcttgggggccggggcgncatcgcgctggcgctcatggcgggccggggtcgtcacctccggcggtctcggcgtcgctgcgctgtccgtgttcctctggatgtacaggtacctgacgggcaagcacccggcgggcgccggacagcttggacacggccagggggaggctggcgtacagggcccggcacatcaaggatgcantacagcatcgcatcgaccaggggnagggggtccttgggagtaaaacaacactcgaggggacggggcgcgcgacttcttggaacagtggcg

SEQ ID NO: 19019 - protein, 160 aa, Zea mays
  misc_feature: Ceres CLONE 1385761-F
  misc_feature (36)..(153): Pfam Name: Oleosin Pfam Description: Oleosin
  misc_feature (87)..(87): Xaa is any aa, unknown, or other
  misc_feature (147)..(147): Xaa is any aa, unknown, or other
  misc_feature (155)..(155): Xaa is any aa, unknown, or other
MADHHRGATGGGGGYGDLQRGGGMHGEAQQQQKQGAMMTALKAATAATFGGSMLVLSGLILAGTVIALTVATPVLVIFSPGLGAGAXSRWRSWRAGVVTSGGLGVAALSVFLWMYRYLTGKHPAGAGQLGHGQGEAGVQGPAHQGCXTASHRPGXGGPWE

SEQ ID NO: 19020 - DNA, 778 bp, Zea mays
  misc_feature: Ceres CLONE 1385765-F
  misc_feature: SWISSPROT Homolog: EC 2.7.11.24 Mitogen-activated protein kinase
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (39)..(39): n is a, c, t, g, unknown, or other
  misc_feature (49)..(49): n is a, c, t, g, unknown, or other
  misc_feature (51)..(51): n is a, c, t, g, unknown, or other
ttttttcctnnntnntccccttttttttncnnnnanacnaacggggttnantttaaaagctggggctccccgcggtggcggccgctctagaactagtggatcccccgggctgcaggaattcgcacgagaccattacctagaacatcctaatcgaaaaatccctcctcacggcacgggactcgcctcccccctcctcttcctcccctcccgcccacggctggaggtgctcacagcgagcggagcggaggcgagggattcggccgcgcgcatggcgacgcctctctgaccgaagctgctccacccactcggccagtacaaaatggcgatgatggcggatcctccgaatgcaatcgggaaccaaggaaagcattactactctatgtgggcagaccttatttgagatagacaccaaatatgtggcgatcaagcccagttgggcgagggagcttatgggaataggtttgttcatcccttaagcggggaaacaaatggagaaagtgagcaataaaggaagatacacgacggttttccgacaacccgggggggagggcacctaacggacctttggggggagcctgaaaactcctttccgcccatcttccggacaaggagaaatgtcatttgcttttggaaggaaaaataatgggggggccaataacaagggggagggagcgtttctaaggggaggggggaccttggggtaatacgaaaactcccggggggaaagcggggatttggcagccgggaattaggcccaagagtgaggctcccggggggg

SEQ ID NO: 19021 - DNA, 757 bp, Zea mays
  misc_feature: Ceres CLONE 1385767-F
  misc_feature: Encodes the peptide sequence at SEQ ID NO. 19022
  misc_feature (362)..(362): n is a, c, t, g, unknown, or other
  misc_feature (365)..(365): n is a, c, t, g, unknown, or other
ggagctccccgcggtggcggccgctctagaactagtggatcccccgggctgcaggaattcgcacgagaccattacctagaacatcctaatcgaaaaaagaaaataggagcagcttcacctcggaagctcagactcagtaggatgcaacaagaacatgcccaaccttcaatggttggtgcgaaggggtgtgagagatgcagggactggcaggagcactactactgggagcatatggatgcgagcaagatccgcttcttcaggtgcatgacaggagactttgctcatcgcattagcgtgccagagaagttcgcaaagaacttcagggggcagatcaccgaaagagttcacctgaaatcacctancancgctgagacatggcacgttcggttaaaagagcatgggcaacaacctatttcctcggggcaggggtggaaaaatttccgccagggtcatggagctggaggaaaacgatccccgggcctccccttggcccgggaaaccctctcttttgagggcctaaacttttccaagcaggggggtggaaaaaagggttctccccttttttggagggggattttgcccccgaattgggaaaaaaattttagggggggggggggcgccaagggggggggccccccctcttgggggggggggggtttttagaggacaccggggcgccccccccggggtgtataccccccttcaaaagcttttttttttggagagccccggggggggtctcacaccgcaatatttt

SEQ ID NO: 19022 - protein, 164 aa, Zea mays
  misc_feature: Ceres CLONE 1385767-F
  misc_feature (65)..(65): Xaa is any aa, unknown, or other
  misc_feature (66)..(66): Xaa is any aa, unknown, or other
MVGAKGCERCRDWQEHYYWEHMDASKIRFFRCMTGDFAHRISVPEKFAKNFRGQITERVHLKSPXXAETWHVRLKEHGQQPISSGQGWKNFRQGHGAGGKRSPGLPLARETLSFEGLNFSKQGGGKKGSPLFWRGILPPNWEKNFRGGGGAKGGGPPSWGGGGF

SEQ ID NO: 19023 - DNA, 647 bp, Zea mays
  misc_feature: Ceres CLONE 1385774-F
tggagctccccgcggtggcggccgctctagaactagtggatcccccgggctgcaggaattcgcacgagaccattacctagaacatcctaatcgaaaaacctccgtctccgccgccgccgttgccgctctcgtcccacccctcaccggccgccggtcgccgccggcatctcgcgtaccgcagatttgccgcagaagaatcagatccaaaccccgtatcttctcttcttccccctccttccccattgtccccgccgctgccatggccaccggcggcgccgcccccaccgcctccgatgccgggtccaagaagaagttgctcatcttcgactccgaggaggatctcgcggtttctcttgcgaagtacactgcggagctgtcggagaagttcgcggccgagaggggtgccttcacgccgtgctctctggcggatccctcatcgaggcactcaagaagctgacggagcggccgtacctggattcaggggactggaagcagtggaacgtctttctggttgaattgaaagggtcgggcccagggccatggggaatacaaactacaagctccccaatgaggggtttccccccaaggggccgatccctcccgggaaagtttaggttaaaacgagggggttttacactgaggggggg

SEQ ID NO: 19024 - DNA, 620 bp, Zea mays
  misc_feature: Ceres CLONE 1385776-F
  misc_feature: Encodes the peptide sequence at SEQ ID NO. 19025
  misc_feature (580)..(580): n is a, c, t, g, unknown, or other
aagctggagctccccgcggtggcggccgctctagaactagtggatcccccgggctgcaggaattcgcacgagaccattacctagaacatcctaatcgaaaaaactgacgcggtcaccctcgcccccaacacagagagaaggtctgctctccaccggatggactcccacggcaagcccaagcccgccggttcgccgccgccgacgccgccgactccgccgacaccgccgactccgccgacgccgccgacaccgccgacgccgccgacgccgccgacgccgtcgacgctgccgacgccgacgacgccgctgacgccgccgacgccggcgacgcccgaggcgaggaagtggttcatgcgccgcatcttccctttgctcctaggcgccaacctctttgttggagcttatgacctcgagcggaccaaccggaaggactcaggaaagagcgacccaacgactgatcctgctactgcgactgctggaaagcctgctgagacagtctctatccccagaaaggagctcccaccaatcccctgaagatgaccagcgcaagttctacaaatggatgctgtaatgagagcgnaagatccacccacgcaatgctgcctacaagaagaaactcg

SEQ ID NO: 19025 - protein, 60 aa, Zea mays
  misc_feature: Ceres CLONE 1385776-F
MRRIFPLLLGANLFVGAYDLERTNRKDSGKSDPTTDPATATAGKPAETVSIPRKELPPIP

SEQ ID NO: 19026 - DNA, 622 bp, Zea mays
  misc_feature: Ceres CLONE 1385781-F
  misc_feature: Encodes the peptide sequence at SEQ ID NO. 19027
  misc_feature (383)..(383): n is a, c, t, g, unknown, or other
  misc_feature (384)..(384): n is a, c, t, g, unknown, or other
  misc_feature (389)..(389): n is a, c, t, g, unknown, or other
  misc_feature (397)..(397): n is a, c, t, g, unknown, or other
  misc_feature (409)..(409): n is a, c, t, g, unknown, or other
  misc_feature (410)..(410): n is a, c, t, g, unknown, or other
  misc_feature (473)..(473): n is a, c, t, g, unknown, or other
tggagctccccgcggtggcggccgctctagaactagtggatcccccgggctgcaggaattcgcacgagaccattacctagaacatcctaatcgaaaaatgctcttcgcccctcgcgcttaccgctgccgcgcctcccgacttgccgcctccgcctagctccgggctctccaatggcctccatgctcgccatcctcaggccctccgcgccggccccgctcgcggggcgccgggccagggctgccgcgccggcgaccgcgagggtggcgctatcttccagatctaggtattcgtcggtcagggtgtcgctcggctccgaggttgcagtgggcgtcgacgcgctcttcggcgactaatagccccacatcgctttcctcttcccggnncaggntgcccaanccgtggaatggnngcagaagctcagagtggtccagcagctaccaaattggtcaacccagcaaatggaatccctggnatatgaccttgctggatctttgcaccaatggacaaaagaaaagcttgacttcaccatgatcagtcagccggctatatatgtccacagccctgcagcagtaaaagttactaccgtgcacgcgatggaggcccagatgtgattaactctgt

SEQ ID NO: 19027 - protein, 60 aa, Zea mays
  misc_feature: Ceres CLONE 1385781-F
MASMLAILRPSAPAPLAGRRARAAAPATARVALSSRSRYSSVRVSLGSEVAVGVDALFGD

SEQ ID NO: 19028 - DNA, 657 bp, Zea mays
  misc_feature: Ceres CLONE 1385782-F
  misc_feature: Encodes the peptide sequence at SEQ ID NO. 19029
aagctggagctcaccgcggtggcggccgctcgagaatagtggatcccccgggctgccgaaattgccacgagaccattacctacaacatcctagtcgagaaaagaccatccgctgcgaccacaactccaagacgagagcggcggacgcgggacaggaatggcagacgcgggccagcacgtggtcgcggcgttcgtggaggaggcagcggactcgcacttccctatccataagctgcccttccgggtcttccgccggcgggggtccccaccgcaggctccgcgccccggggtggtcatcggggacttcgcgctccacctcgccaccgtcgccgactagcgtctcttcgacgggcccgcactctccggtgtccccgtgcttccacgaggagacgctcatcatgttcttgccacatgggcccaccgaagcgaagagaggcgcgcgtcactctacataagatcctctcagccgacgagccagacttgcgtgacaactgaattgctgaggaataaatgtcttattccaatgagtgatatcgatatggttctaccgatctgggctggaggctacgcagatttcttttgttctgtgcaccatggaagaaactgcggattcatcttctcgaggatgcgagactccagataatccaaactgcattta

SEQ ID NO: 19029 - protein, 59 aa, Zea mays
  misc_feature: Ceres CLONE 1385782-F
  misc_feature: SWISSPROT Homolog: EC 3.7.1.2 Fumarylacetoacetase
MADAGQHVVAAFVEEAADSHFPIHKLPFRVFRRRGSPPQAPRPGVVIGDFALHLATVAD

SEQ ID NO: 19030 - DNA, 642 bp, Zea mays
  misc_feature: Ceres CLONE 1385790-F
  misc_feature: Encodes the peptide sequence at SEQ ID NO. 19031
  misc_feature (633)..(633): n is a, c, t, g, unknown, or other
  misc_feature (642)..(642): n is a, c, t, g, unknown, or other
tggagctccccgcggtggcggccgctctagaactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaacttctaggaagatgatccgatctacggaaggctgtgcaaagagcattactttggagaggaacaacaaatcagacgatgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatgttccaacccggaaataggagcatcaaacatacaaggaccaactttgccatgagagtcaacagtttcttgcgtcagctacgcactcatcctactctttaataagtttgttattaaagttcngggctgcgn

SEQ ID NO: 19031 - protein, 120 aa, Zea mays
  misc_feature: Ceres CLONE 1385790-F
  misc_feature (38)..(85): Pfam Name: F-box Pfam Description: F-box domain
MAKQKEGVDKRTSRKMIRSTEGCAKSITLERNNKSDDVQLHDLPNDILGSILSRLTFRESSQMGLVSHTWRRLWRSCCRKLVFTSATMFQPGNRSIKHTRTNFAMRVNSFLRQLRTHPTL

SEQ ID NO: 19032 - DNA, 609 bp, Zea mays
  misc_feature: Ceres CLONE 1385796-F
  misc_feature: Encodes the peptide sequence at SEQ ID NO. 19033
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (488)..(488): n is a, c, t, g, unknown, or other
  misc_feature (498)..(498): n is a, c, t, g, unknown, or other
  misc_feature (505)..(505): n is a, c, t, g, unknown, or other
  misc_feature (527)..(527): n is a, c, t, g, unknown, or other
  misc_feature (589)..(589): n is a, c, t, g, unknown, or other
tggagctccccgcggtggcggccgctctagaactagtggatcccccgggctgcaggaattcgcacgagaccattacctagaacatcctaatcgaaaaatttacacgcgcacactccacttcatcaccggatcaccagcctacagctcgtcacatctctctctccgcccggccggcctctagactcactctagccatatggccacggtgcacggcagcaggctcatcttcctcttcgaggccacgctcttctcggcgctgctgctcgtcccggcacgccctgcttccgccacagacggcagcgcgtacccggccggcgactgcccctacccgtgcctgccgccgcccgccgtcaccgccaactgcccgccgcctccgccggctgcggcgtcgtactcgtacccgccaccgccgggggcttacattccctacttccagcctgcggcgggtggcggtggtggcgcgagnnngggnnnnnaaaaaccggggnttaccccggngccgccngccgcccaaccccatcctgccngtggtacccatgggtactacaagaaacgccgcccgtcgtccctcgggccggccacgtcgggncaggggggagtccccgttcc

SEQ ID NO: 19033 - protein, 137 aa, Zea mays
  misc_feature: Ceres CLONE 1385796-F
  misc_feature (90)..(90): Xaa is any aa, unknown, or other
  misc_feature (91)..(91): Xaa is any aa, unknown, or other
  misc_feature (93)..(93): Xaa is any aa, unknown, or other
  misc_feature (94)..(94): Xaa is any aa, unknown, or other
  misc_feature (98)..(98): Xaa is any aa, unknown, or other
  misc_feature (101)..(101): Xaa is any aa, unknown, or other
  misc_feature (111)..(111): Xaa is any aa, unknown, or other
MATVHGSRLIFLFEATLFSALLLVPARPASATDGSAYPAGDCPYPCLPPPAVTANCPPPPPAAASYSYPPPPGAYIPYFQPAAGGGGGAXXGXXKPGXTPXPPAAQPHPAXGTHGYYKKRRPSSLGPATSGQGGVPV

SEQ ID NO: 19034 - DNA, 646 bp, Zea mays
  misc_feature: Ceres CLONE 1385798-F
  misc_feature (604)..(604): n is a, c, t, g, unknown, or other
tccccgcggtggcggccgctctagaactagtggatcccccgggctgcaggaattcgcacgagaccattacctagaacatcctaatcgaaaaacacactatcactcaatctccactctttgtccgcatgacctcgatagattatctgaggctatcaccttcgtcaacgatctctatccctaaaaacagcgacttgtatcgcgagccaaggactctcctttcttggtcgggatgaatgacctcccacttccgcttctggatgttcatgatgaacgtaacaggagacgtgtggagttgacgtgtacgtgttgttgctccctgcatctcattgcttagtagcatgctctctgatgatctgcctgcagaacatgaaatggtactgctgactgtactactacatcaggcaggtccatgtgcttcgaagtagctcctgtcgacgggaggaagctgccattgactttgatacgacgtgtacacgcacgcgcttgtacccttataacgcgagagtggctgtctgatgcatactacgacacgaactatcatacatttcactgcacctgaagcagattgctgagacactgagcacagattcgtctagcacctccnaatgcttaagactacacttattgatgcgactccagcaagaac

SEQ ID NO: 19035 - DNA, 647 bp, Zea mays
  misc_feature: Ceres CLONE 1385811-F
  misc_feature: Encodes the peptide sequence at SEQ ID NO. 19036
  misc_feature (626)..(626): n is a, c, t, g, unknown, or other
tccccgcggtggcggccgctctagaactagtggatcccccgggctgcaggaattcgcacgagaccattacctagaacatcataatcgaaaaacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcacagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggacccctgtgagagaacattggtgctaaattggtcaggcaagcagcagctaaaaccaatgatctagctgggagatgggacaaccaacctctgtggtccttgctcagggctgatcccctgagggggggtttaggttgttggcagctggntgctaatccctgttcaaaatt

SEQ ID NO: 19036 - protein, 118 aa, Zea mays
  misc_feature: Ceres CLONE 1385811-F
MASTFGATSTVGLMAAPTGKNVRLQRRVNFTVRAAKELYFNKDGSAIKKLQTGVNKLADLVGVTLGPKGRNVVLESKYGSPKIVNDGVTVAREVELEDPCERTLVLNWSGKQQLKPMI

SEQ ID NO: 19037 - DNA, 639 bp, Zea mays
  misc_feature: Ceres CLONE 1385813-F
  misc_feature: Encodes the peptide sequence at SEQ ID NO. 19038
  misc_feature (511)..(511): n is a, c, t, g, unknown, or other
  misc_feature (538)..(538): n is a, c, t, g, unknown, or other
  misc_feature (602)..(602): n is a, c, t, g, unknown, or other
tccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgccagctcttccnacctgagcagctcatcagtggcaaggnagatgccgctaacaaatttcgcccgtgccactacaccattggcaagggaagatgtgatctgggncttgaacggatccgcaggttgctgaacactgcaccgc

SEQ ID NO: 19038 - protein, 130 aa, Zea mays
  misc_feature: Ceres CLONE 1385813-F
  misc_feature (88)..(88): Xaa is any aa, unknown, or other
  misc_feature (97)..(97): Xaa is any aa, unknown, or other
MRECISVHIGQAGIQVGNACWELYCLEHGIQPDGQVPGDKTAGHHDDAFSTFFSQTGAGKHVPRAIFVDLEPTVIDEVRTGTYRQLFXPEQLISGKXDAANKFRPCHYTIGKGRCDLGLERIRRLLNTAP

SEQ ID NO: 19039 - DNA, 647 bp, Zea mays
  misc_feature: Ceres CLONE 1385815-F
  misc_feature: Encodes the peptide sequence at SEQ ID NO. 19040
caaagctggagctccccgcggtggcggccgctctagaactagtggatcccccgggctgcaggaattcgcacgagaccattacctagaacatcctaatcgaaaaaacaaggtcttttccctctccaccggtccaccccaaccaacctcctcccaccctccctccaggcctctccactccccggcaacctcgccgccggcgccggggccatggaccggtggaccggcgtcgtctacgtcccactctccagaggcggacccgtcttccgcgtcgctgcctcgctcctcctctcgccagccaaaacgctcgccgttccacgagtcaacgcgatccttttcacgggcgaccgcgtccgcggcacggacgatccggtgatcgagcggctctctgacgccgcccacctggctggggtcctcgccgggaagctccctggggaggccaacgcgtgggtggtcgacgccgcgcgctttgctgggccatttgcggtgtaccgagagctcgttccgaccgtcgacgccgctggagaccccaagggatacagaatcaactcctggggttctcggcgaaggattcgactgtcaatgagcacccaccagcaccagtgccatcctaccatccactggctaggactatcatccttggcttcagc

SEQ ID NO: 19040 - protein, 146 aa, Zea mays
  misc_feature: Ceres CLONE 1385815-F
MDRWTGVVYVPLSRGGPVFRVAASLLLSPAKTLAVPRVNAILFTGDRVRGTDDPVIERLSDAAHLAGVLAGKLPGEANAWVVDAARFAGPFAVYRELVPTVDAAGDPKGYRINSWGSRRRIRLSMSTHQHQCHPTIHWLGLSSLAS

SEQ ID NO: 19041 - DNA, 651 bp, Zea mays
  misc_feature: Ceres CLONE 1385817-F
  misc_feature: Encodes the peptide sequence at SEQ ID NO. 19042
  misc_feature (591)..(591): n is a, c, t, g, unknown, or other
  misc_feature (613)..(613): n is a, c, t, g, unknown, or other
ggagctccccgcggtggcggccgctctagaactagtggatcccccgggctgcaggaattcgcacgagaccattacctagaacatcctaatcgaaaaacattattcaggtccaggtcacatgatgcacagacagcccgtccgacgccgcgttagctacttgcctacttcagctatatgaaacggcaaaagtcttcccctcgttccccaatctcctctccatcgaaaccctagcacgacgcaattcccgtcttcccacgccgtgtcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgaggaggtggaggtcgaggaggaaagtgggaagtggaagaggaagaagaaggcgagagcgaccaggcttcgatccaggcgctgctggattcgttccccaaggaccagctcgtcgagctgttacgcgacgctgccatcngctcacggcgacgtgctaaccnaccatccggcgcgtggccgacgccgacccggctcagcg

SEQ ID NO: 19042 - protein, 126 aa, Zea mays
  misc_feature: Ceres CLONE 1385817-F
  misc_feature (114)..(114): Xaa is any aa, unknown, or other
MGKKRKLEPKSAAGFTPVKASPTTRSATAKAAGLSEVLAPVEATMEKLPQGAGGEDVEEIEEVEVEEESGKWKRKKKARATRLRSRRCWIRSPRTSSSSCYATLPSAHGDVLTXHPARGRRRPGSA

SEQ ID NO: 19043 - DNA, 650 bp, Zea mays
  misc_feature: Ceres CLONE 1385822-F
  misc_feature: Encodes the peptide sequence at SEQ ID NO. 19044
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
ggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctgtgactccgcnnnnnnnnnggggggggcgccggcccctagcgctggggtcctgggggggggccggggtcggccacttcggggggctcggcggccctggccttggccgtgttctccctggaaggtacaggtacctgacggggcaagcacccgccgggcgccgaccagctggaccacgccaaaggcgagcttggcgtccaaggcccgcgacatcaaggatgcagcacagcaccgcac

SEQ ID NO: 19044 - protein, 75 aa, Zea mays
  misc_feature: Ceres CLONE 1385822-F
MADHHRGATGGGGGYGDLQRGGGMHGEAQQQQKQGAMMTALKAATAATFGGSMLVLSGLILAGTVIALTVATPVL

SEQ ID NO: 19045 - DNA, 673 bp, Zea mays
  misc_feature: Ceres CLONE 1385832-F
  misc_feature: Translation starting site: 214
  misc_feature: SWISSPROT Homolog: EC 1.11.1.7 Peroxidase
  misc_feature (530)..(530): n is a, c, t, g, unknown, or other
  misc_feature (531)..(531): n is a, c, t, g, unknown, or other
  misc_feature (597)..(597): n is a, c, t, g, unknown, or other
  misc_feature (598)..(598): n is a, c, t, g, unknown, or other
  misc_feature (633)..(633): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
aagctggagctccccgcggtggcggccgctctagaactagtggatcccccgggctgcaggaattcgcacgagaccattacctagaacatcctaatcgaaaatcgcgccagagccacgcacgctagtgtcagtggcacgcaggcagccgcgcgcaccgaggggagaccagagctagcggcgaggccaagggcaagggcaagggcgcggacggcaatggcgagagctggaggcggcggtccgttcttcccggtccgcggcgcggcgctggtggtcgtgctgctaggcatcgtcgcgggcgcggcgagggcgcagctgcggctgaactactacggcagctcgtgccccagcgcggagtccacggtgcgctccgtcatctcgcagcgcctccagcagaagcttcgccgtggggcccggcacgctccgcctcttcttccacgactgcttcgtcaggggatgcgacgcgtcggtgatgctgatggcgccgaacggggacgacgagagccacagcggcgcggacgccacgctgtcgnncggacgccgtggacgcctcaacaaggcaaaggcgggccgtggagggccttccccgggtgcggcggnnaagtctttcgtgcgcggacatccctcgcatgccgnaannngggacgcgtctcccttggtttgggcggcggaaatt

SEQ ID NO: 19046 - DNA, 658 bp, Zea mays
  misc_feature: Ceres CLONE 1385837-F
  misc_feature: Encodes the peptide sequence at SEQ ID NO. 19047
  misc_feature (624)..(624): n is a, c, t, g, unknown, or other
tggagctccccgcggtggcggccgctctagaactagtggatcccccgggctgcaggaattcgcacgagaccattacctagaacatcctaatcgaaaaaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgagaccatggcaagtgtcccgccaccaaggaggacctcaccatggatgatatcgtgccggtcaagaccaacacgatcgtgaagcccaggcctttgcaggctgcaagcattccaggactccttgggatttttcagaacgagtgggatgctctcatgctttctaattttgctttggagcagcagcttcacacagcaagacaagaacttagtcatgcactctaccagcatgacgcttgcctgccgtgttatagccagattaaagaaggaaagagatgacgctagagcacttttggctcaagctgagagacagattccctgcgtcagttgcaggagctgctcctngcagctgttgtttccaatggaaaaagagtaattg

SEQ ID NO: 19047 - protein, 77 aa, Zea mays
  misc_feature: Ceres CLONE 1385837-F
  misc_feature (18)..(76): Pfam Name: Prp19 Pfam Description: Prp19/Pso4-like
MDDIVPVKTNTIVKPRPLQAASIPGLLGIFQNEWDALMLSNFALEQQLHTARQELSHALYQHDACLPCYSQIKEGKR

SEQ ID NO: 19048 - DNA, 619 bp, Zea mays
  misc_feature: Ceres CLONE 1385838-F
  misc_feature: Encodes the peptide sequence at SEQ ID NO. 19049
ggagctccccgcggtggcggccgctctagaactagtggatcccccgggctgcaggaattcgcacgagaccattacctagaacatcctaatcgaaaaagtgttctcgactcgaccgccgccgtcccagttcgcttcgcgtcaccgagagctcgtcggcctccgtccccgcgagaagcgagagcatggacacccaggtgaagcttgctgttgtggtgaaggttatgggcaggaccgggtccaggggtcaggtgacccaggtcagagtgaagttcttggatgaccagaaccgtctcatcatgaggaacgtcaagggccctgttcgtgagggtgacatcctcaccctgctcgagtctgagtgggaggccaggaggctgcgctgaagccctggtggccttggatgtaattctgttaattttgttctatgtttgtcgaacttgccgtgtcccttgcaacatctgctttgagatttactgagcctggattgcagttttattttatgttcctgctggaaagtacacttgccgagacatagttatcattggttatctataatagctcaatcgacgcgtgcaatctgaaggctttgtttatatgtggtaagggcgtctaatgtagtttt

SEQ ID NO: 19049 - protein, 65 aa, Zea mays
  misc_feature: Ceres CLONE 1385838-F
  misc_feature (1)..(65): Pfam Name: Ribosomal_S28e Pfam Description: Ribosomal protein S28e
MDTQVKLAVVVKVMGRTGSRGQVTQVRVKFLDDQNRLIMRNVKGPVREGDILTLLESEWEARRLR

SEQ ID NO: 19050 - DNA, 671 bp, Zea mays
  misc_feature: Ceres CLONE 1385846-F
  misc_feature: Encodes the peptide sequence at SEQ ID NO. 19051
  misc_feature (337)..(337): n is a, c, t, g, unknown, or other
  misc_feature (386)..(386): n is a, c, t, g, unknown, or other
  misc_feature (419)..(419): n is a, c, t, g, unknown, or other
  misc_feature (483)..(483): n is a, c, t, g, unknown, or other
  misc_feature (490)..(490): n is a, c, t, g, unknown, or other
  misc_feature (555)..(555): n is a, c, t, g, unknown, or other
  misc_feature (566)..(566): n is a, c, t, g, unknown, or other
  misc_feature (571)..(571): n is a, c, t, g, unknown, or other
  misc_feature (579)..(579): n is a, c, t, g, unknown, or other
gaagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcgntggtgcaagcaggcgtgcgagtggcagtacgggaaagacacccccgcgnaagagggaatgcgagagcgagtgccgcgagcgncaccagcaagctgacgcgggcgaggacggcgacagcggcgtggacgcctacgtctccgctccgnaaagggnggagagtgcccgcgccagtgcttgcgcccgcacgaggggcaagccgtggaggaacccagagtggnttgtgaggccntgccngccggcgnggggactggccgtcgaattgaaacaaaaaagagtacggtcgcggcagccgagaggcgcgggcagtggcccccccgaaaagaggtgcgagcgc

SEQ ID NO: 19051 - protein, 74 aa, Zea mays
  misc_feature: Ceres CLONE 1385846-F
  misc_feature (60)..(60): Xaa is any aa, unknown, or other
  misc_feature (71)..(71): Xaa is any aa, unknown, or other
MGKGSVGASWWAFLLLAGVLLVVAATAGAEDGVVERDRKEDLRWCKQACEWQYGKDTPAXEGMRERVPRAXPAS

SEQ ID NO: 19052 - DNA, 661 bp, Zea mays
  misc_feature: Ceres CLONE 1385850-F
  misc_feature: Encodes the peptide sequence at SEQ ID NO. 19053
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (517)..(517): n is a, c, t, g, unknown, or other
tggagctccccgcggtggcggccgctctagaactagtggatcccccgggctgcaggaattcgcacgagaccattacctagaacatcctaatcgaaaaactgccctggtcccccattcaattcttccaactccgccgcttcgcctcgttccgtccgccgcccccatggcgtccgccgccgccacgaccacctccgcccccgcccagaacctcaatccccttagtatcaacatcaagctccccccatggctcagcgggctgcgctgccccttcaccttcgtctgcccgcccccgcccccgcctccgccgccgccgccgcctcctcccccgctgccacctacggaacccgtggtcccacggtcgcggaggttaccaagcctgcgggtgaccacggagtacgatagcgaagagggcgtgtttgtgaacaaggtgtcgtgcaagcttgcgggggacctcgccaaactgcggctctccttccagagcgaccgagaggnnnnnnnnnggggggggggggggggnaaaaaaagggaaaaccccctaccgcaacctcttgcgcccgtcccgtgggttggggctcatccaaaaaggggtttgctccgtggctctacaacgttcaaaggcacgtcaacgcggctgactcccacagcagactggtgtcgcttt

SEQ ID NO: 19053 - protein, 166 aa, Zea mays
  misc_feature: Ceres CLONE 1385850-F
  misc_feature (110)..(110): Xaa is any aa, unknown, or other
  misc_feature (111)..(111): Xaa is any aa, unknown, or other
  misc_feature (112)..(112): Xaa is any aa, unknown, or other
  misc_feature (113)..(113): Xaa is any aa, unknown, or other
MASAAATTTSAPAQNLNPLSINIKLPPWLSGLRCPFTFVCPPPPPPPPPPPPPPPLPPTEPVVPRSRRLPSLRVTTEYDSEEGVFVNKVSCKLAGDLAKLRLSFQSDREXXXXGGGGGKKRENPLPQPLAPVPWVGAHPKRGLLRGSTTFKGTSTRLTPTADWCRF

SEQ ID NO: 19054 - DNA, 648 bp, Zea mays
  misc_feature: Ceres CLONE 1385860-F
  misc_feature: Encodes the peptide sequence at SEQ ID NO. 19055
  misc_feature (427)..(427): n is a, c, t, g, unknown, or other
  misc_feature (460)..(460): n is a, c, t, g, unknown, or other
  misc_feature (461)..(461): n is a, c, t, g, unknown, or other
  misc_feature (474)..(474): n is a, c, t, g, unknown, or other
  misc_feature (505)..(505): n is a, c, t, g, unknown, or other
tccccgcggtggcggccgctctagaactagtggatcccccgggctgcaggaattcgcacgagaccattacctagaacatcctaatcgaaaaagcagttcggtagtccctctcctctcgaggtggcggcgctccccccgtcttcttcttcttcttcttcctgtactatatagcctcccctcgcaaatcgtcactgacgttcattccgcttgcttgattgttccaggtattagcagtcgaccggttcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcnggcagggagaagtttgcttcagtcccatgtggnntggcgcggtgtcnctgtttgcgcagctgcacctgctgctggcgnagctgctcctgcagctgaggcaaagaaagaagaggaggtggaaagagaggaaagaaagcgatgatgattatgggcttcaggctccttcgactaggctgacagtcattcaaaagtatggtttttgggcaaggaaacacaaggaa

SEQ ID NO: 19055 - protein, 88 aa, Zea mays
  misc_feature: Ceres CLONE 1385860-F
  misc_feature (69)..(69): Xaa is any aa, unknown, or other
  misc_feature (73)..(73): Xaa is any aa, unknown, or other
MKFVAAYLLAVLAGNASPSADDLTAILESVGCEVDNEKMELLLSQLSGKDITELIAAGREKFASVPCGXARCXCLRSCTCCWRSCSCS

SEQ ID NO: 19056 - DNA, 585 bp, Zea mays
  misc_feature: Ceres CLONE 1385867-F
  misc_feature: Encodes the peptide sequence at SEQ ID NO. 19057
  misc_feature (319)..(319): n is a, c, t, g, unknown, or other
  misc_feature (473)..(473): n is a, c, t, g, unknown, or other
  misc_feature (476)..(476): n is a, c, t, g, unknown, or other
  misc_feature (477)..(477): n is a, c, t, g, unknown, or other
  misc_feature (491)..(491): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (523)..(523): n is a, c, t, g, unknown, or other
  misc_feature (555)..(555): n is a, c, t, g, unknown, or other
  misc_feature (556)..(556): n is a, c, t, g, unknown, or other
  misc_feature (576)..(576): n is a, c, t, g, unknown, or other
aaagctggagctccccgcggtggcggccgctctagaactagtggatcccccgggctgcaggaattcgcacgagaccattacctagaacatcctaatcgaaaactaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacgntcagatgcccggtgaccagaccattgggggaggtgatgatgctttcaacaccttctcaagggggattggggcttggaaaaccacgggccccccccgggttggggttttttttttttggggcgcccgtgaaaaccccccccctgtggtttttttntgnnaaggaggggggggnaaggggaaaaaacgggggtttttnnntccccncccgcgcgcgggggccgttttcccgccccccnnccccccgcggcggggcgcanactattagg

SEQ ID NO: 19057 - protein, 121 aa, Zea mays
  misc_feature: Ceres CLONE 1385867-F
  misc_feature (34)..(34): Xaa is any aa, unknown, or other
  misc_feature (85)..(85): Xaa is any aa, unknown, or other
  misc_feature (86)..(86): Xaa is any aa, unknown, or other
  misc_feature (87)..(87): Xaa is any aa, unknown, or other
  misc_feature (99)..(99): Xaa is any aa, unknown, or other
  misc_feature (100)..(100): Xaa is any aa, unknown, or other
  misc_feature (102)..(102): Xaa is any aa, unknown, or other
  misc_feature (113)..(113): Xaa is any aa, unknown, or other
  misc_feature (120)..(120): Xaa is any aa, unknown, or other
MRECISIHIGQAGIQVGNACWELYCLEHGIQADXQMPGDQTIGGGDDAFNTFSRGIGAWKTTGPPRVGVFFFWGARENPPPVVFXXXGGGGKGKKRGFXXPXPRAGAVFPPPXPPRRGAXY

SEQ ID NO: 19058 - DNA, 651 bp, Zea mays
  misc_feature: Ceres CLONE 1385870-F
ggagctccccgcggtggcggccgctctagaactagtggatcccccgggctgcaggaattcgcacgagaccattacctagaacatcctaatcgaaaaagcgatctgcctctgcccttaccgcatatcctttcctcccgaataccggaactacaacacccagggccactggaccgaacttgcctgcccatcaatactgcaaggtgggaccaaacgatgatgaactaagctccctccacaccacgatacaagtaaccacatcgacagctacatcaaaggcagagccgacaaccacgacacagatagcccagaggatatgtaaatcatgtcatgctcactcaaaaaagccgagaaatagcaacaacactcgataaccccgctcctgtcgctcaaccacaacaaggacatcatcgtcaacagattcgcgaggttccaccagatacagttcaccatcgggaaaccaactacccttccactctgcaggaggcgtcagtaatacatcatcatcgctgatactcatgtctcgatcctcatgtccccttacatgcgtgctcctccgtgtgtcgcacccacgcctgagcatacacagcactacattctcacttactcgcgttctccatccgtgggccgcgtgaccagacactgcatctgacc

SEQ ID NO: 19059 - DNA, 651 bp, Zea mays
  misc_feature: Ceres CLONE 1385880-F
  misc_feature: Encodes the peptide sequence at SEQ ID NO. 19060
aaagctggagctccccgcggtggcggccgctctagaactagtggatcccccgggctgcaggaattcgcacgagaccattacctagaacatcctaatcgaaaaacctcgctccccatccgctcaggccaatcaacagaagtgacgcgagcacgaggacacatcccctcccttcttcgggtattcctcgccgtgtggcctcggcgcagacctctgccatggcggaccagctcaccgacgagcagatcgcggagttcaaggaggccttcagccgcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagttcctgaacctgatggcgaggaagatgaaggacacggactcagaggaggaggtcaaggaggccttccgcgtcttcgacaaggaccagaacggtttcatctcggctgccgagctccgacatgtcatgaccaaccttggcgagaagctgaccgacgaggaggtccacgagatgatccgtgaggccgacgtcgatggtgatggccagatcaactacgaggagcttgtcaagggta

SEQ ID NO: 19060 - protein, 145 aa, Zea mays
  misc_feature: Ceres CLONE 1385880-F
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature (121)..(145): Pfam Name: efhand Pfam Description: EF hand
  misc_feature: SWISSPROT Homolog: EC 2.7.11.1 Non-specific serine/threonine protein kinase
MADQLTDEQIAEFKEAFSRFDKDGDGCITTKELGTVMRSLGQNPTEAELQDMINEVDADGNGTIDFPEFLNLMARKMKDTDSEEEVKEAFRVFDKDQNGFISAAELRHVMTNLGEKLTDEEVHEMIREADVDGDGQINYEELVKG

SEQ ID NO: 19061 - DNA, 676 bp, Zea mays
  misc_feature: Ceres CLONE 1385883-F
  misc_feature: Encodes the peptide sequence at SEQ ID NO. 19062
gctctagaactagtggatcccccgggctgcaggaattcgcacgagaccattacctagaacatcctaatcgaaaatttttcggtgtcgcgagctcttcctccttccgcttctcttcgacagaaaactagggttttgctcttggaatctctctccccgctgccgccgccgccggacagggcaccgacgatacgacctcctccttcctccgatctggcctttttaatccgcggatcccgtacaagatgcttcccctctcgctcctcaagaccgcccaggggcacccaatgctcgtggagctgaagaatggtgagacgtacaacgggcatctggtcaattgcgacacgtggatgagcatccaccttagggagggtatttgcacctccaaggatggtgacaagtttttggaggatgccaaagtgttacattccgtgggaacaccattaagtatcctccaagtccctgtggaagtgattgacaagggtcccggaaggaaacttcccaaaagccccgtccaaataaggaaaccccccaagggggtttggccgccggaaaaagggaaggcggcgaaaccttgggtgcttaaaaccttggaaaggacaaaaggctattccggaacgtggcgccacaaaatgaatgggaagggtaaaaaggccacggtggtgtgggccccaaaaga

SEQ ID NO: 19062 - protein, 130 aa, Zea mays
  misc_feature: Ceres CLONE 1385883-F
MLVELKNGETYNGHLVNCDTWMSIHLREGICTSKDGDKFLEDAKVLHSVGTPLSILQVPVEVIDKGPGRKLPKSPVQIRKPPKGVWPPEKGKAAKPWVLKTLERTKGYSGTWRHKMNGKGKKATVVWAPK

SEQ ID NO: 19063 - DNA, 654 bp, Zea mays
  misc_feature: Ceres CLONE 1385886-F
  misc_feature: Encodes the peptide sequence at SEQ ID NO. 19064
  misc_feature (498)..(498): n is a, c, t, g, unknown, or other
acaagctggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggatgacaaggggcagactcccgtgttccctcggatctttggccacgaggctggagtatcatacatagtgttggagagggtgtgactgacgtagctccgggcgccatgtccttcctgtgtcactgcngagtgcaggagtgtgccactggcaggtcgcaatagcaacatgggtgatctgttcagatcacacctaccgggtgggatgatggcagatgccattccgggttttcatcaaggggaaagctataaccacttggttggaattccaccttcagggggaacc

SEQ ID NO: 19064 - protein, 81 aa, Zea mays
  misc_feature: Ceres CLONE 1385886-F
  misc_feature: SWISSPROT Homolog: EC 1.1.1.1 Alcohol dehydrogenase
MATAGKVIKCKAAVAWEAGKPLSIEEVEVAPPQAMEVRVKILFTSLCHTDVYFWDDKGQTPVFPRIFGHEAGVSYIVLERV

SEQ ID NO: 19065 - DNA, 660 bp, Zea mays
  misc_feature: Ceres CLONE 1385887-F
  misc_feature: Encodes the peptide sequence at SEQ ID NO. 19066
aagctggagctccccgcggtggcggccgctctagaactagtggatcccccgggctgcaggaattcgcacgagaccattacctagaacatcctaatcgaaaaatctatcatcatccatttcatatccctagatcgtcagagatgtagagaggtatctttaaaaataagagaatggagatgggcatcgatctctgcgtgtgcgtggctctgtcagctgtcagcgaactctgcagtgcagatgtcctgcccctgcgctgcctcttgctggcttgtacggtgctggcgccacactgacgaccatgatggacgacggcgagctgtacccctaccggaagtaccagatgcagtcggagcgcagaccgctggagggggagcactaataggacgtcctgtgggcagacgaaagccatgatccagtcgctccggcgacagcgctatgcatcagcagatgaagatgatggacagtgagttcgacgcgtacgaatctccacaccatgatgctaattgagcgtgacgatggcctcagcagcaaccagtaccagtcagctctgatgcagcagcacatgaagctgatgctacgccatggactgaacctcatgatcatgatgaagtcgcataacatggcggacatggctgcactctaccagtaccagctgcacag

SEQ ID NO: 19066 - protein, 55 aa, Zea mays
  misc_feature: Ceres CLONE 1385887-F
MMLIERDDGLSSNQYQSALMQQHMKLMLRHGLNLMIMMKSHNMADMAALYQYQLH

SEQ ID NO: 19067 - DNA, 668 bp, Zea mays
  misc_feature: Ceres CLONE 1385897-F
  misc_feature: Encodes the peptide sequence at SEQ ID NO. 19068
ggagctccccgcggtggcggccgctctagaactagtggatcccccgggctgcaggaattcgcacgagaccattacctagaacatcctaatcgaaaaagatcttacttgcaaaatgccatcctctgccttcgtcctgccctggatgtactgaaaggaccagctgtcttcttccagattcctatgacatcctggaggggtgtataacgacatcatgtgaggtaagccaatatccatatcgtgctacctccaccgaagcaccctgacccaattccctctatatcgagaaccattacacgggctcactggacgacgatgtacaaagaagggactggagaaacctcgtgcaggtacccgacttacctcgctatgcagcacatccgcctttcgccagctgtcgtaatagcaaaaagcgccgcaccgatcgcccttcacaacagatgcgataccgtgaatgtgcaatgaaaattgcaagcgtgaatatttcgtcaacattcgccacaaattgttgttacatcagctcactcctctaaccaataggcccaaatacaccaaatctcttataactcatcagataagagcgatatacgctggactgttggtccaatttgtgacagtagtccactattagagaaagtgcactccaacgcaaaggcacaacttctcctatc

SEQ ID NO: 19068 - protein, 30 aa, Zea mays
  misc_feature: Ceres CLONE 1385897-F
MRYRECAMKIASVNISSTFATNCCYISSLL

SEQ ID NO: 19069 - DNA, 630 bp, Zea mays
  misc_feature: Ceres CLONE 1385899-F
  misc_feature (307)..(307): n is a, c, t, g, unknown, or other
  misc_feature (353)..(353): n is a, c, t, g, unknown, or other
  misc_feature (357)..(357): n is a, c, t, g, unknown, or other
tggagctccccgcggtggcggccgctctagaactagtggatcccccgggctgcaggaattcgcacgagaccattacctagaacatcctaatcgaaaaatcgatcgtcaatgctagtttgtccattcgcattggtctgaatactgtaactactaacgcgagtgccactgtgacgcagatgcctgctcgccattactgcaaggtgcgttctatcgaagcttaattatgctctctctacatctgatccagctatagatctagccggcactattgacgggcgcgtcaagaatcatgatacagagagctggnaggctagctagctgagctcgtgcgactaaaactgagcgttattggncagnaacatgatgacaccgatcgtggaggtcaacctataatggatgtcatccgtatccgtatcgccgagtggaacctggacccacttcatcaggggtctgaccactataccccggcctggccgggaagggacccgaggtcctactttccggggggttccccctccgtggcccgccgggttgggcccggggaaccaaatttgggggagggggaccacagtggggggccttgggggcccaaaagcccttggcccccaaaccccgcgggtggtgggacac

SEQ ID NO: 19070 - DNA, 828 bp, Zea mays
  misc_feature: Ceres CLONE 1385900-R
  misc_feature (595)..(595): n is a, c, t, g, unknown, or other
atttgatgatcttgggttgggtaaaagaacgaagacattcctgcacgtgtccccatgctcacacaatgaacaaaaaaaattgggacgtaacagatccaacccagcacaagtaagatttcaacgcaaaacatctagtatttgggcacctttattaatttcctcgtccattcaactggacaagtgagggcaacaggctcttacaggggagatggagaacgacttcttcagcttctctacctccagataagcgttaaagtaaggcaggaactccgaggaatggctctgcatcagatcgttgatggcatatgccagcttcggtatctccatgatctcctcataggtcagcttccgaacgaacctagccaggcttcctgcccagagcacgccggtcggaatccgacttcctgggggcaatacagagccagcttcgaggatcgagttggtcttcaccagcgaaccttccataatgacagagtgctagccaatgatgcactcaggctcgatggtgctagagcgcaacagacagtaggcgcccactgtcacgtaccggtccacgagtgtctcagctggaagccctgtgggagccgtccatgcnggcatggaggacgcatcgctcctgtacgttggcgcagaagccgagcgtgattcttgttgaggtccccccgccagactgcgcccgctccaacggaggcgcccgtcgtgggacggttgacctggccgggcgagcacgggcctccggggggcgaacttaagcgttccccgggccaccctgtgggcatccccttgtgtcaccagcgggaaacaaggcttcccttcttgccccaggat

SEQ ID NO: 19071 - DNA, 656 bp, Zea mays
  misc_feature: Ceres CLONE 1385902-F
  misc_feature: Translation starting site: 194
agagctggagctccccgcggtggcggccgctctagaactagtggatcccccgggctgcaggaattcgcacgagaccattacctagaacatcctaatcgaaaagatggcctcgtactcttgtcacgttccttcctgactgcccccacttctcctccggaggagcggcggcgggttacctcccaacagcccgaccatggaagccgacatcgctttcaggtatgagatcccccggaccgcccagttcctccgcgacggcgcctacaccagggccgcgctccagttccccgacgagatgctgaaggatgctgctgcggtgtcgaggctgttgcgccggtgagcttgactccgtcgccgccgacagtgcttttaggatgttcgtgatgggcgacacggcgtacaactactgctgcgtgcacgaagtgcttgcgtctcacatcgatgaccagtgagtcgtccactacggtcacgcctgcatgagcccaacatcaaatttgccagctttctttagatttgccaaggcacctttggatgaccactcatgtgccggcacattgctggagtgctcaaggaaaagaatgagcgcatcctggctgtatatgaactatagtacccatatgcatggaatgaccttaaactgactttcatgaagccatgca

SEQ ID NO: 19072 - DNA, 733 bp, Zea mays
  misc_feature: Ceres CLONE 1385910-F
  misc_feature: Encodes the peptide sequence at SEQ ID NO. 19073
ccccgctggagctcaccgcggtggcggccgctctagtactagtggatcccccgggctgcaggaattcgcacgagaccattacctagaacatcctaatcgaaaaattatcatttccattcgcaccgaagatcccagaagcaagccaataggcaatagctacagatctctcttcgttgtgctgctagtacacataaaagaaagagcgagagcgagagagagaagaagaagaagaagaagatgaggtcggtgacacatggcgccagccctctctccctcccccctccccccccctgcccccctcccccccgtcccctgctgcgccccgccccccccccaccacccccccccaccccattccttccctggtcgtttccccttttctccacctcccccctggcccctccccccccccccccccccacctccccccccccccccacccatccactctcagatcccccacctcccctcctccacccccctcccccccctcccaaccccccacccactcctccaccacctccccccccgctcccttctcctcccccgcccccggacgccccccccccccccctcgcccccattcatcctgcctacctcgctccgcccccaccccccccgccgccgccgcggggcccccagagcgccggcacccctcccccccccacgctccccccacacctgcatctcaatctcaccccgcccgtggccactcgaggcctgccccttctcc

SEQ ID NO: 19073 - protein, 165 aa, Zea mays
  misc_feature: Ceres CLONE 1385910-F
MRSVTHGASPLSLPPPPPCPPPPRPLLRPAPPPPPPPTPFLPWSFPLFSTSPLAPPPPPPPTSPPPPTHPLSDPPPPLLHPPPPPPNPPPTPPPPPPPLPSPPPPPDAPPPPLAPIHPAYLAPPPPPPPPPRGPQSAGTPPPPTLPPHLHLNLTPPVATRGLPLL

SEQ ID NO: 19074 - DNA, 696 bp, Zea mays
  misc_feature: Ceres CLONE 1385914-F
ccggctggagctcaccgcggtggcggccgctcttcaactagtggatcccccgggctgcaggtatttcgcacgagaccattacctagaacatcctaatcgaaaacttttcctagggtttcgtcgcttccagccgacgccgcgtccgcctcgacaagagcagcagccgtcgcagcacctctctctctcgatctcagcccatggcgcacgtggtgcaccaacaggatacgccgaatctgttctcccgctgcaacttcggacgaggccccgtggacccacttctccagtgatgactacctcggctgtccacctcgagtactgccgcgcttgtccccccccgccccgcccaacgacgcctctccaagacctgcgatagtataggtttgagtggttaccatcgcccatcacattcacaagcctcgcgacctgcaggctctggtcgagattagtgtttcctactcgacctccgcccggaaggggccctgcccaccgcccccccggcgtaggcttccgcgttcggtccccctccttcccccacccccttctcccaaacctaagatttactttgccaccataacacgcggaacccaccagtcaatcacccccaccaccctcccccccccctcgcgttccttggcaaactaaacacccctcccttccccgcccccaggtcgctctccccccgccgccccccacccc

SEQ ID NO: 19075 - DNA, 725 bp, Zea mays
  misc_feature: Ceres CLONE 1385919-F
  misc_feature: Encodes the peptide sequence at SEQ ID NO. 19076
ccagctggagctccccgcggtggcggccgctctatcaactagtggatcccccgggctgcaggaattcgcacgagaccattacctagaacatcctaatcgaaaaaaccatattattgagaccaacaagcaacatagaaagtggaatccagtagcaacaatagagcaacaatggagaccaagatattttccctccttatgctccttgctctttctacatgtgttgctaacgcgacaattttccctcaatgctcacaagctcctatagcttacctttttcccccataccttccatcaattatagcttccgcctgtgcaaaccccgctcttcaaccatatagggttcaacaagtaatcgcagtaaggaacctacctctatcaaccgttgtggtgccaaccaccgtcagtccctacccccccctgcagatcttgcgaccacatccctccggcccacccccacctgtcactcgtctcccgcctacctgtcatcatctccaggagttggcccccccaccccgccttccctaactgcttaccacgctacccacccccgtccccatcccacactccctgctctgaccactgcacccccctactgcccatcctcttgtcggccacccaacctccctcccaatttcctcgccccagtccagcctcacacgacactcgcctgctccgaccggccccccgacccgttccttccgccctcactacacgcccgcactggc

SEQ ID NO: 19076 - protein, 118 aa, Zea mays
  misc_feature: Ceres CLONE 1385919-F
METKIFSLLMLLALSTCVANATIFPQCSQAPIAYLFPPYLPSIIASACANPALQPYRVQQVIAVRNLPLSTVVVPTTVSPYPPLQILRPHPSGPPPPVTRLPPTCHHLQELAPPPRLP

SEQ ID NO: 19077 - DNA, 705 bp, Zea mays
  misc_feature: Ceres CLONE 1385922-F
  misc_feature: Pfam Name: IBB Pfam Description: Importin beta binding domain
  misc_feature (705)..(705): n is a, c, t, g, unknown, or other
cccgctggagctcaccgcggtggcggccgctctatactagtggatcccccgggctgcaggaattcgcacgagaccattacctagaacatcctaatcgaaaactcttcttttccccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcgccgccgcgaggacaatatggtgtatatctccaagagccggtgcgaggacagcattatcaggaggccccgcgaggcgctccaccacccaggcacaccgacccccacccggccgcccacccccaccccgcagggctcccaccccatgcctcctcccgcgcacctcccacccaaacttaccttgcaggcgcgccgcctcccaccccacacccacaccacagtccagccacctcgcgagcaagctcacgcacccgacccccctccactcgctactgccgccatccgccctcctcattctcgacgcaccccgcaccccgacccatgaaacgccccattggctgcccttgtcctcgcttggcggcgtgacccgtaccggcgcgcacaccgtctcccatgtcggaacgcaaaacn

SEQ ID NO: 19078 - DNA, 650 bp, Zea mays
  misc_feature: Ceres CLONE 1385924-F
  misc_feature: Encodes the peptide sequence at SEQ ID NO. 19079
cccaactggagctcacccgcggtggcggccgctctataactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtggccgcgaacatctccggcgggtacgtgaaccctgccgtgacctttggtgacttcgtgcgtggccacatcaccctgcttccggggctcctgtactgcgcgtcgcacctgtctgcggtccaccgcgcggcggttcctgctccgtttctcgccccgcggccagccccccgccacttctggccgacgccgctgatccgtgtccgccccccccctctctctacccctc

SEQ ID NO: 19079 - protein, 149 aa, Zea mays
  misc_feature: Ceres CLONE 1385924-F
  misc_feature (13)..(139): Pfam Name: MIP Pfam Description: Major intrinsic protein
MPINRIALGSHQEVYHPGALKAAFAEFISTLIFVFAGQGSGMAFSKLTGGGPTTPAGLIAAAVAHAFALFVAVSVAANISGGYVNPAVTFGDFVRGHITLLPGLLYCASHLSAVHRAAVPAPFLAPRPAPRHFWPTPLIRVRPPPLSTP

SEQ ID NO: 19080 - DNA, 669 bp, Zea mays
  misc_feature: Ceres CLONE 1385929-F
  misc_feature: Encodes the peptide sequence at SEQ ID NO. 19081
ccccgctggagctccacgcggtggcggccgctctagactagtggatcccccgggctgcaggaattcgcacgagaccattacctagaacatcctaatcgaaaaattcccctcccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcggcgccggggtggagaaggttaagttggagaaccacacccggaaaatcgatactggaaccaggacatttgagatagaagtggcgatggcgccccgggctccccatgtggagatgagggccccccgctggcggctctcacggcaaggtacggtggccaggaggccctgttcgacgcggccaaggccacggcgctctgccgccccctggcacgccaggccttaaggggccccggcgtctaccggtccggcaccacctccctacggagaagccccaagacagccccttccccgcctcc

SEQ ID NO: 19081 - protein, 132 aa, Zea mays
  misc_feature: Ceres CLONE 1385929-F
  misc_feature: SWISSPROT Homolog: EC 2.5.1.8 tRNA isopentenyltransferase
MLWVDKYRPKTLDKVTVHDQVAQNLRKFVSEQDCPHLLFYGPSGSGKKTLILALIKQMFGAGVEKVKLENHTRKIDTGTRTFEIEVAMAPRAPHVEMRAPRWRLSRQGTVARRPCSTRPRPRRSAAPWHARP

SEQ ID NO: 19082 - DNA, 746 bp, Zea mays
  misc_feature: Ceres CLONE 1385930-F
  misc_feature: Encodes the peptide sequence at SEQ ID NO. 19083
  misc_feature (1)..(1): n is a, c, t, g, unknown, or other
ncgggctggagctcaccgcggtggcggccgctctagaactagtggatcccccgggctgcaggaattcgcacgagaccattacctagaacatcctaatcgaaaaaccgattcggcaaccgtgctaatcgatatccgtgcaattccacctcccgaaccgaatccctccaccgacccaaaccctagcgcgcacccttctccgtcgtcctttcctggcgcgcgggccggtgtcggagatgtgggcgctgcctcccggacggcgggatggcactggcggccgtcgccggaggccaacgagtggttgggtggcggtgccccgcccgcacgcccgctaccgccggcgccctgtgacgcagaccgcgcccgccgcaccctgcgccatgactgatgcccatccgctgctcgtcccccacccgttccctcgcccccccgtgcggtcgctgcgtgcaacacgcgctgctgcgtgtctgccccacactcccccccgcctccgccctgtcggcccccgcgcttcgcgcgtgggccgtaggtttccccccctcacgacccggacggtacccctcccgcctgattccttcccctccccgcgcttcagtagcatcgcggcgcgcgttggccggcctcccgccttcccccccctctcctaccccgcccctttctctctccccccccccctccccctccccctccatcccgtcctcctcccctcctccctcgccccgccccgtcctctcccccctcatctcacc

SEQ ID NO: 19083 - protein, 127 aa, Zea mays
  misc_feature: Ceres CLONE 1385930-F
RAGAHRGGGRSRTSGSPGLQEFARDHYLEHPNRKTDSATVLIDIRAIPPPEPNPSTDPNPSAHPSPSSFPGARAGVGDVGAASRTAGWHWRPSPEANEWLGGGAPPARPLPPAPCDADRARRTLRHD

SEQ ID NO: 19084 - DNA, 685 bp, Zea mays
  misc_feature: Ceres CLONE 1385931-F
  misc_feature: Encodes the peptide sequence at SEQ ID NO. 19085
cccgctggagctcaccgcggtggcggccgctctatactagtggatcccccgggctgcaggaattcgcacgagaccattacctagaacatcctaatcgaaaaacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggcccgtcaaggccgggctgcagttccccgtcggccggatcgggcgctacctcaagaaggggcggtacgcgcagcgcgtgggcaccggcgcccccgtctatctcgccgccgcgcttgagtacctcgccgccgaggcgctggagctggccggcaacgcggcgaacgcacaacaagaagacgcgcatccgtcccgggacacttgctcctggcgattcgtaacgacgctgaccccgcccagctgccgcccggcgccaccaccgcgcacggcagaggcctccccaaaatcaaccccgcctcctccccgcccacgacggtgccgagagccagcgcctccactcgccgggcagcgccggagagcaaggcccccctcaacaaggccgccccagcgtccccacatccgaccatcccccccgctcccccgccaccc

SEQ ID NO: 19085 - protein, 170 aa, Zea mays
  misc_feature: Ceres CLONE 1385931-F
  misc_feature (29)..(96): Pfam Name: Histone Pfam Description: Core histone H2A/H2B/H3/H4
MDASGAGSKAKKGAAGRKAGGPRKKSVSRPVKAGLQFPVGRIGRYLKKGRYAQRVGTGAPVYLAAALEYLAAEALELAGNAANAQQEDAHPSRDTCSWRFVTTLTPPSCRPAPPPRTAEASPKSTPPPPRPRRCREPAPPLAGQRRRARPPSTRPPQRPHIRPSPPLPRH

SEQ ID NO: 19086 - DNA, 663 bp, Zea mays
  misc_feature: Ceres CLONE 1385934-F
  misc_feature: SWISSPROT Homolog: EC 1.16.3.1 Ferroxidase
ccccgctggagctcaccgcggtggcggccgctcttgcaactagtggatcccccgggctgcaggaattcgcacgagaccattacctagaacatcctaatcgaaaaacaaaaaccctcttctcctctgtccgagattcatacaaaaatgcttctcaaatccgcttctgctttctcgctcgtgaacatccatggaggagtcaagaaggacatctctcctctctcctcctcattgagtcttcccgtttcttcgggaaaaccaagaaacctctccttctctgtttctgcctccacgcaaaccctgagcggcgtcgttttcgagccgtttgaggaggtgaagaaggagctcgatctcgtcccttcgagtgcacagctctctctcgctcgccccatgtactctcccgagcgagaagccgccgcgcatgagcagacccacgccgcgccccccgccccccatgcctctccccccccccccccccctccccccccccccccccgcgtcgcgcccccgctcgcctgcaacaccccctccacgccctccccgctcgcaaagaccgcccccccctcccccccctcgccccgcgcttcccccacccccctcccccacccctggcggtctccactcacctcaccccctctccccctacccccaccccccctcccaccc

SEQ ID NO: 19087 - DNA, 656 bp, Zea mays
  misc_feature: Ceres CLONE 1385939-F
  misc_feature: Encodes the peptide sequence at SEQ ID NO. 19088
ccccgctggagctcaccgcggtggcggccgctctatcaactagtggatcccccgggctgcaggaattcgcacgagaccattacctagaacatcctaatcgaaaacgcaaacccctctcgatcgacacacgcagccgcgacccatcgcgacctgacccgaccctcccgaggccgccagccttatcctctccgcctccgcctcccgccgtcccctccgacccatcacaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttctggagagtaagtacggctctcccaagacccgcccccttggcgttacagttgcaatagagagtgacctggaggaccctgtgcaaaacattgcaccccaaatcggtcacgccgccctccccgctaccacctaccatctctgctggtacctgctacaacgaccctctgtgcttcccccgcccatggggttcacgttt

SEQ ID NO: 19088 - protein, 138 aa, Zea mays
  misc_feature: Ceres CLONE 1385939-F
MASTFGATSTVGLMAAPTGKNVRLQRRANFRVKAAKELYFNKDGSAIKKLQTGVNKLADLVGVTLGPKGRNVVLESKYGSPKTRPLGVTVAIESDLEDPVQNIAPQIGHAALPATTYHLCWYLLQRPSVLPPPMGFTF

SEQ ID NO: 19089 - DNA, 746 bp, Zea mays
  misc_feature: Ceres CLONE 1385940-F
  misc_feature: Encodes the peptide sequence at SEQ ID NO. 19090
  misc_feature (746)..(746): n is a, c, t, g, unknown, or other
gcccgctgaagctcaccgcggtggcggccgctcttacaactagtggatcccccgggctgcaggtttttcgcacgagaccattacctagaacatcctaatcgaaaaaactcgccgtctgccttctgcgcctccatttcggcctctgtcccttgcaagttcaatctcacctccaaccatgggtaaagagaagtcccacatcaacattgtggttattgcccatgcccactctggcaagtcgaccaccacagcacacctcatccacaagcttgcacgtattgagaagtgtgtgatcgagaggtttcgacacccaccctgctgaaccccacaagccactccccacgcaccaccagatcgctcccataatttttattttataacaaagacacacccaccaccaaccgacaccactcccgtctccactcccctacccaccctccctacccacgccacccctccttaattacctcctccaaaatcgtatactacacccgaagacctcactttagcgcggatatgggtcgatcccccccccccccccccccccctttcaggtctcctctccccctcccccctcctcctatccaccgaacacacccaccccctccaccaatcccctaacccaccctaacactaatccatacccatcccccctccccctctcccctccaccctaaaccacacccccccataattccttctttttccttttttctctcttccctaatcataaatcatcactacagacn

SEQ ID NO: 19090 - protein, 47 aa, Zea mays
  misc_feature: Ceres CLONE 1385940-F
MGKEKSHINIVVIAHAHSGKSTTTAHLIHKLARIEKCVIERFRHPPC

SEQ ID NO: 19091 - DNA, 700 bp, Zea mays
  misc_feature: Ceres CLONE 1385942-F
  misc_feature: Encodes the peptide sequence at SEQ ID NO. 19092
caagctggagctcaccgcggtggcggccgctctagtactagtggatcccccgggctgcaggaattcgcacgagaccattacctagaacatcctaatcgaaaaatcatcagtccacatccagatcagcaaagcggcagtgcgtagagaggatcgtcgtagacagaacagcatgaagatggtcatcgttctcgtcgtgtgcctggctctgtctgctgccacgggctctgcaatgcagtatgacctgcccctgcgcgcacctgcggggcttgtacggcgctggcaggaggctgacgccctatgtgggcgcatgtgacccgcatgcccccccacattgcctggaccacgtcccccgcgccgccgtggccgtcgcccccctccttgaggggcgcgccgcccccacccccctgttccctctgcttttttttcccccgctgccagctgtccttgctcccgccgtctctctgctcctcttccccccctcctctccccctcgtcatcttgctcggttcctcccccctccacgcccccctccccttggtttggtccttcctctccccgtctcgtcactctctgcctcttcccccaccgcccccgccctcctcccgctcctccttgtcttctccccctcctacttccccttcccccttgcttccgccttctctcccccccctccctcccccctccctccccctagtctccg

SEQ ID NO: 19092 - protein, 154 aa, Zea mays
  misc_feature: Ceres CLONE 1385942-F
MTCPCAHLRGLYGAGRRLTPYVGACDPHAPPHCLDHVPRAAVAVAPLLEGRAAPTPLFPLLFFPPLPAVLAPAVSLLLFPPSSPPRHLARFLPPPRPPPLGLVLPLPVSSLSASSPTAPALLPLLLVFSPSYFPFPLASAFSPPPPSPLPPPSL

SEQ ID NO: 19093 - DNA, 679 bp, Zea mays
  misc_feature: Ceres CLONE 1385945-F
  misc_feature: Encodes the peptide sequence at SEQ ID NO. 19094
cccagctggagctcaccgcggtggcggccgctctagaactagtggatcccccgggctgcaggaattcgcacgagaccattacctagaacatcctaatcgaaaaaccgcattctagcttggtccattgacaaaaaccctgggtctctccttcgaggcttcaacctaaacctcgtctcgcctccttcagtccatcccctcaaccccggcggccaaaagccggcgcaccgaagcggcgggccggcggcaagcggtggccatggcggagctaaagcggctgtcagagagctgggacctgacgcggatcgagcgcatcggcgcgcactcccacatccgggggctagggctggactcctccatggaggcgcgcgacgcctcggagggcatgcgccggcagatgcccgggcgccgcgtcgcggggctcatactcaacctcatccgccacggtcaaatcgcccaccccgccggtctccctgcggttcagcccgcgttctccccccacccccccccgccccgggcccccgcccgcccgctccgccccgcggagccccacatatcctcagttagtctgtttgctagttttaccccgccccagccccttccccaaatattgtccgctaaacgaaatccccataccgccggttcccctccatcattcgcctcatccggctgataagggtcg

SEQ ID NO: 19094 - protein, 137 aa, Zea mays
  misc_feature: Ceres CLONE 1385945-F
MAELKRLSESWDLTRIERIGAHSHIRGLGLDSSMEARDASEGMRRQMPGRRVAGLILNLIRHGQIAHPAGLPAVQPAFSPHPPPPRAPARPLRPAEPHISSVSLFASFTPPQPLPQILSAKRNPHTAGSPPSFASSG

SEQ ID NO: 19095 - DNA, 689 bp, Zea mays
  misc_feature: Ceres CLONE 1385947-F
ccccgctggagctcaccgcggtggcggccgctctagcactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactacctgcaggcaagggcgaggaatggcaagcctttcatgtgctcgggcgcacggtgttgttccgttccggtgctctgcccgccaagctgttgctgtcccccccctgctgcttccctacggcggctccaaccccgtccgtacatgtgcatgtgtctcgccccctgcaagtatctccaccccccccccacaccccagcgattcccctcgcctgtcttcccctgtcgtcagctctgctcctataagccagttgcctattatcttacctataactatattctcttttgtatccttattccatctgccgcactctccaaatctcaccactcttacttcctcttactgagtcccgccacctcccgcactaccataatcac

SEQ ID NO: 19096 - DNA, 686 bp, Zea mays
  misc_feature: Ceres CLONE 1385948-F
  misc_feature: Encodes the peptide sequence at SEQ ID NO. 19097
  misc_feature (17)..(17): n is a, c, t, g, unknown, or other
  misc_feature (21)..(21): n is a, c, t, g, unknown, or other
ccccgctggagctcccngcgntggcggccgctcatgactagtggatcccccgggctgcaggaattcgcacgagaccattacctagaacatcctaatcgaaaaatttcagtttggaactgaactgggaatgacgaggccgaggacaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgtcgcctcagcccgtgaaggaggactacgtccagaacgccgcccagtttctctcccaccccaaggccaggggctcccccgtcctctaccaggcgacccttcccccagaagaaggcccttagcgcctgaggagatcgaccagtccttcctcagtgttcttgattctctacacagtactaggtgataccccccccccccccgcaccccgtccaccattatgaatcaacccccccctccccgtcactgtatggcgcccggccgccccttgttccccccgggagatccctttatacctaaagccctccccccccacccgtaaatatcccacccccccctccccggcgcctcccgcccattgacccgcccacacccacatccg

SEQ ID NO: 19097 - protein, 71 aa, Zea mays
  misc_feature: Ceres CLONE 1385948-F
MASGIGSGQQQPPAPAADADPGAVGDKLVFEASPQPVKEDYVQNAAQFLSHPKARGSPVLYQATLPPEEGP

SEQ ID NO: 19098 - DNA, 680 bp, Zea mays
  misc_feature: Ceres CLONE 1385950-F
  misc_feature: Encodes the peptide sequence at SEQ ID NO. 19099
cccgctgggagctcacgcggtggcggccgctctataactagtggatcccccgggctgcaggaattcgcacgagaccattacctagaacatcctaatcgaaaaatccaatccatcagtacccaatctcccctacaccagaaaaattcccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgacgagacccgcggcgcgctcacgatctttctcgagaacgtcatccgcgacgccgtcacctacaccgagatcgcgcgccccacgaccgtgaccggcatggacgccgtctacctgctgcagcgccagtgacgcaccctctacggctctcggaggctaccctaggcgccccttcctcgctcgcggaatcgctcaggcgcacatggcccctgggtcctcgttgttctgacgccctcgttggtcccccctccgtccgcggcatcgccagcccccgtccggatgacagacatctcctcgttgaccacccccaaccgcctgtcctgcgaaccgccccgcactcaccccg

SEQ ID NO: 19099 - protein, 94 aa, Zea mays
  misc_feature: Ceres CLONE 1385950-F
  misc_feature (25)..(91): Pfam Name: Histone Pfam Description: Core histone H2A/H2B/H3/H4
MSGRGKGGKGLGKGGAKRHRKVLRDNIQGITKPAIRRLARRGGVKRISGLIYDETRGALTIFLENVIRDAVTYTEIARPTTVTGMDAVYLLQRQ

SEQ ID NO: 19100 - DNA, 734 bp, Zea mays
  misc_feature: Ceres CLONE 1385953-F
  misc_feature (21)..(21): n is a, c, t, g, unknown, or other
  misc_feature (734)..(734): n is a, c, t, g, unknown, or other
gcccgctggagctcaccgcgntggcggccgctcttgcactagtggatcccccgggctgcaggatattcgcacgagaccattacctagaacatcctaatcgaaaaagatcgggtcctaggctacagcagccgccgcatccgtcaccttcacaccgcgtgcgtgctctctctccccctccccctctccgtgcgacgactgggtgggctaccgccgccctacgcaaggagacgagaacttaatcgatatcctgcgcggagaagagtgcccaccacagcaggcgcttagaaggcgcgctggtcgttgtatgaccatgccggctccccgcgccctgcaccgctcttcctcccctccccacccttaactacacacctcccccctaacccaggtcaaccccgccacccgcctctgactgccccccccccaacccaaccaaagcacctaatatactcacccagcacaaaccccacaaccacacaccaaccgcctcctctctacccccaatatgcttggtccccccctcccccccccagtttgtacctattctaaacatgaacgaaatcaccctgactcacatgcgtctccaccccccccctccttccccccccccaccctccccccctctcttaccactcctgacctgctcacgccacactgccccccctactatcccaccttctaattctctagcttcacatttataacctttcccaccctcattcgctctcccctctccn

SEQ ID NO: 19101 - DNA, 712 bp, Zea mays
  misc_feature: Ceres CLONE 1385959-F
ccccgctggagctcaccgcggtggcggccgctctacactagtggatcccccgggctgcaggtaattcgcacgagaccattacctagaacatcctaatcgaagaaattggcgacgaagcaaggaacgcaccccgaatcccaactcctgtgtccgccatcgcctcgtggcggtcgctcctgctcctcctgctgctgctgctccccagccgctcccgcccggagcacgccgccggcgccgacgtcctcgcgtcgcatggatatggcccccgcgtctgtctactttcctccgcgctcgcccgaccccccctcacggacttctcctgccgccgcctgcctctcccccctcccctgatgtttgttgttgggcgccttcccgccgcccgggcgcactccccccccccaccctgccccctccctggtttttcccacaccctgctcggccgcggttccccccacttccgccgatgctataccctcactgcgcctgtatgtggggggacgatcccccccccccccctccgcctctcctctcttttgccaccccctccccccaccgccctccttccttctcctccctctccagccccccccctccacctctcctcctgcctcccccccgctcgcgcgccactcccactcccctccactcgcctctctatctaattccgtttgactctctccacccccttccccccctctctccccctctcctt

SEQ ID NO: 19102 - DNA, 648 bp, Zea mays
  misc_feature: Ceres CLONE 1385960-F
  misc_feature: Encodes the peptide sequence at SEQ ID NO. 19103
aaagctggagctccccgcggtggcggccgctctagaactagtggatcccccgggctgcaggaattcgcacgagaccattacctagaacatcctaatcgaaaaagtttcccggctccctcgctcacgcgccgcggcatcactccggccggctggccagtcgcccactcttcccacccacaccgccgctgcctttccttccacggcgaactctccgcgggcgacgtccagactggcaacggcattccaataaaagaatgcgcccctgctctggccaactctctccacctgcattccccgttccgctaaaccctagccgcctccggcgcgtagtagattcgccatcagagacgacgctcggcggccctgaggagggatgacctacgtcaacccagacccccagccgctcgccgccgctacggcggatgattccgcaacccagcatcaagctgcggtgaccgccgcgccgcagtcgacgcgaggcgttctggggcccccccccacggcggagcccaaacagggcgcgccctgcgcggcgcctccccccccctgggacgccacccgccccccgccctcccccacgcccgcgccccaccccccccacgagccccccagcgcctgcgctgtacaccccgaactcgagacaccccc

SEQ ID NO: 19103 - protein, 91 aa, Zea mays
  misc_feature: Ceres CLONE 1385960-F
MTYVNPDPQPLAAATADDSATQHQAAVTAAPQSTRGVLGPPPTAEPKQGAPCAAPPPPWDATRPPPSPTPAPHPPHEPPSACAVHPELETP

SEQ ID NO: 19104 - DNA, 710 bp, Zea mays
  misc_feature: Ceres CLONE 1385965-F
  misc_feature (357)..(357): n is a, c, t, g, unknown, or other
  misc_feature (371)..(371): n is a, c, t, g, unknown, or other
aaagctggagctccccgcggtggcggccgctctacaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatgcccggaattgncaagaacatgctgncgccgctcctggtgctcacctcatcatgtacatcatcggcatcgggtttcccgaggtgaaacctgaaccacttcatcaacggggaaaaccaactacccccgggggggcccggaaacggggcgaatttcaaactctctgtggtcccccatcctggcccggcgggggggggccccgcggtcccaaattgggggggggggacccaccggggcggccctgggggccccaaaaaacctgggcccccaaacgcgcgggggggggctttttacccccggggagaccaccccgggggccctcccctcttgggggtgggcgcccgaaaggaaaacaccccccctcggg

SEQ ID NO: 19105 - DNA, 669 bp, Zea mays
  misc_feature: Ceres CLONE 1385978-F
  misc_feature: Encodes the peptide sequence at SEQ ID NO. 19106
  misc_feature (458)..(458): n is a, c, t, g, unknown, or other
  misc_feature (468)..(468): n is a, c, t, g, unknown, or other
  misc_feature (511)..(511): n is a, c, t, g, unknown, or other
  misc_feature (532)..(532): n is a, c, t, g, unknown, or other
  misc_feature (552)..(552): n is a, c, t, g, unknown, or other
  misc_feature (553)..(553): n is a, c, t, g, unknown, or other
  misc_feature (568)..(568): n is a, c, t, g, unknown, or other
  misc_feature (642)..(642): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaactctcttcttcccgcggtctgctcgttcgatctgtgcagcagatctgaggtcccgggcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagtttcttaagatgaacccccttgggaaggttcctgttctggagactcctgatggccctgtttttgagagtaatgctatcgcacgctatgttgctcgcttgaaggatgacaacccctcttttgggtcttcccgtattgaancagcccacgntgagcaatggatggattttgccgcaacagaagttgatcctggntgtgcatggtacttgtatccnaggcttgggtacctcccttnnatgtagcacactgangaaacagctatttcttcatttgagaggtcgcttgttgctctgaacacacacttgcttcaaacacataccttggntggcatgctgttactctagctgacatn

SEQ ID NO: 19106 - protein, 123 aa, Zea mays
  misc_feature: Ceres CLONE 1385978-F
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
  misc_feature (91)..(91): Xaa is any aa, unknown, or other
  misc_feature (94)..(94): Xaa is any aa, unknown, or other
  misc_feature (122)..(122): Xaa is any aa, unknown, or other
MALVLHSGAGNKNAFKALIAAEYSGIKVELTKDFEMGVSNKTPEFLKMNPLGKVPVLETPDGPVFESNAIARYVARLKDDNPSFGSSRIEXAHXEQWMDFAATEVDPGCAWYLYPRLGYLPXM

SEQ ID NO: 19107 - DNA, 713 bp, Zea mays
  misc_feature: Ceres CLONE 1385989-F
  misc_feature: Encodes the peptide sequence at SEQ ID NO. 19108
  misc_feature (454)..(454): n is a, c, t, g, unknown, or other
  misc_feature (512)..(512): n is a, c, t, g, unknown, or other
  misc_feature (513)..(513): n is a, c, t, g, unknown, or other
  misc_feature (554)..(554): n is a, c, t, g, unknown, or other
  misc_feature (555)..(555): n is a, c, t, g, unknown, or other
  misc_feature (568)..(568): n is a, c, t, g, unknown, or other
  misc_feature (601)..(601): n is a, c, t, g, unknown, or other
  misc_feature (612)..(612): n is a, c, t, g, unknown, or other
  misc_feature (641)..(641): n is a, c, t, g, unknown, or other
  misc_feature (647)..(647): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
aacctggagctccccgcggtggcggccgctctagaactagtggatcccccgggctgcaggaattcgcacgagaccattacctagaacatcctaatcgaaaaacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcggtatgtgaaaacccaattcttcaaccctacaggatccaacaggcaattgcagctggcatcttacctttatcacccttgttcctccaacaatcatcagccctattacagcagttacctttggtgcatttattggcacaaaacatcagggcacaacaactacnacaacttgtgctagcaaaccttgctgcctactctcagcaacatcagtttcttccattnncaccactagctgcattgaactctgcttttctatttgcacanncacactaccattncagcagctatctgctgcctacccccagcaattncttcccatcanccactgacagcattgaactctcctgcttnattacngcagnnnacactactaccatttcagcagttagctggggggaggcctgctaccttcttgaacaaacc

SEQ ID NO: 19108 - protein, 186 aa, Zea mays
  misc_feature: Ceres CLONE 1385989-F
  misc_feature (100)..(100): Xaa is any aa, unknown, or other
  misc_feature (119)..(119): Xaa is any aa, unknown, or other
  misc_feature (120)..(120): Xaa is any aa, unknown, or other
  misc_feature (133)..(133): Xaa is any aa, unknown, or other
  misc_feature (134)..(134): Xaa is any aa, unknown, or other
  misc_feature (138)..(138): Xaa is any aa, unknown, or other
  misc_feature (149)..(149): Xaa is any aa, unknown, or other
  misc_feature (153)..(153): Xaa is any aa, unknown, or other
  misc_feature (162)..(162): Xaa is any aa, unknown, or other
  misc_feature (166)..(166): Xaa is any aa, unknown, or other
  misc_feature (167)..(167): Xaa is any aa, unknown, or other
MAAKIFCLLMLLGLSASAATATIFPQCSQAPIASLLPSYLSPAVSSVCENPILQPYRIQQAIAAGILPLSPLFLQQSSALLQQLPLVHLLAQNIRAQQLXQLVLANLAAYSQQHQFLPXXPLAALNSAFLFAXXHYHXSSYLLPTPSNXFPSXTDSIELSCXITAXXTTTISAVSWGEACYLLEQT

SEQ ID NO: 19109 - DNA, 639 bp, Zea mays
  misc_feature: Ceres CLONE 1385991-F
  misc_feature: Encodes the peptide sequence at SEQ ID NO. 19110
  misc_feature (437)..(437): n is a, c, t, g, unknown, or other
atagctggagctccccgcggtggcggccgctctagaactagtggatcccccgggctgcaggaattcgcacgagaccattacctagaacatcctaatcgaaaaatccagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtaatgtgggggacaagcacggcgcgtctctgccgccaacttcaagagatgcttncatccaggttcggggggtccgaagccaagggaaaggtccgggaagcaaaggttccaaacaagttcctcggagcccgccaaaaaggattcccccaaagaccaaggttaacccggaaaaaggcccccttttgcaaaaaccccggccccaaaaccggcaaagggccccccccccccaaatcaaaaaaagaggagcgggttgtcca

SEQ ID NO: 19110 - protein, 63 aa, Zea mays
  misc_feature: Ceres CLONE 1385991-F
MPALAKPASRTAKPAAAPKPKPAAAKPKAATAGASHPPYFEMIKEAITALKERTGSSSQAIAK

SEQ ID NO: 19111 - DNA, 656 bp, Zea mays
  misc_feature: Ceres CLONE 1385993-F
  misc_feature: Encodes the peptide sequence at SEQ ID NO. 19112
  misc_feature (452)..(452): n is a, c, t, g, unknown, or other
  misc_feature (578)..(578): n is a, c, t, g, unknown, or other
  misc_feature (610)..(610): n is a, c, t, g, unknown, or other
aaagctggagctccccgcggtggcggccgctctagaactagtggatcccccgggctgcaggaattcgcacgagaccattacctagaacatcttaatcgaaaagcgaggtcgaaatccccaaggcgaggcgttgaaacccttaaccctcttccacctcgaagcggcgcgaggagggagagtgtgagtggactcaggaggcggcgggcgaaatgaagcttaacgtcaagaccctcaagggcaccaacttcgagatcgaggcgagccccgatgcgtcggttgctgaggtgaagaggatcatcgaaactactcagggtcagagtacctacccagcagaccagcaaatgctcatataccaagggaaaattctgaccgcatgagaccactttggaaagcaacggagttgctgagaacagcttccttgttataatgctgtccaaggctaaggcatcgtncagtggagcttccaccgctactgctgcaaagctcctgcaactccaggccaacctgctgcccctggcacatcagttggtagaacacctacacaagctcctgttgccacagctgaaacggcacctccnagtgcacagactcaggctgctccagctgctancgctgctgcatcggatgatgctgatgtgtacagtcaggcagcttca

SEQ ID NO: 19112 - protein, 55 aa, Zea mays
  misc_feature: Ceres CLONE 1385993-F
MKLNVKTLKGTNFEIEASPDASVAEVKRIIETTQGQSTYPADQQMLIYQGKILTA

SEQ ID NO: 19113 - DNA, 657 bp, Zea mays
  misc_feature: Ceres CLONE 1386009-F
  misc_feature (522)..(522): n is a, c, t, g, unknown, or other
  misc_feature (595)..(595): n is a, c, t, g, unknown, or other
aagctggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgccccgcggcgcggggcggcgcggttcgcgtgcaacgccacggcgccgcgagcgtccacgtgccaggcgctcgtctcctacgcgccgcccaacgggacggncacgcccacgctggccgccgtgcgggcgctcttccagctccgctcccacggcgcgctgctggccgccaacggnctcccgctctcacgccgcccacgggcccgcgccccgtgccgctgcgggtccgctgccctgcc

SEQ ID NO: 19114 - DNA, 667 bp, Zea mays
  misc_feature: Ceres CLONE 1386015-F
  misc_feature: Encodes the peptide sequence at SEQ ID NO. 19115
  misc_feature (441)..(441): n is a, c, t, g, unknown, or other
  misc_feature (522)..(522): n is a, c, t, g, unknown, or other
  misc_feature (629)..(629): n is a, c, t, g, unknown, or other
gctggagctccccgcggtggcggccgctctagaactagtggatcccccgggctgcaggaattcgcacgagaccattacctagaacatcctaatagaaaaagaagccgcagccacgcccccacaccaagccgtatcgtcttctccctcttgtccggttcgggtggtccgcggtcggggtgagtgagtgagcagctttgcttctccatctccccgttcccttccctccccagccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggaggcggcagcggcggcggcggtggcggccaacggaaaggcgtgctgccacgccgccnaggggcccgggtacgccacgccgctggaggccatggagaagggccccagggagaagctcgtctacgtcacctgcgtctacnacggcaccggaattaaacagccggattaccttgcgacggtggatttggatcccagctctcctacgtactcccaggtgatccacaggcttccggtcacccacatcggngacgagctgcatcactctggctgggactcctgcaggtc

SEQ ID NO: 19115 - protein, 101 aa, Zea mays
  misc_feature: Ceres CLONE 1386015-F
  misc_feature (27)..(27): Xaa is any aa, unknown, or other
  misc_feature (54)..(54): Xaa is any aa, unknown, or other
MAGAAAVEAAAAAAVAANGKACCHAAXGPGYATPLEAMEKGPREKLVYVTCVYXGTGIKQPDYLATVDLDPSSPTYSQVIHRLPVTHIGDELHHSGWDSCR

SEQ ID NO: 19116 - DNA, 652 bp, Zea mays
  misc_feature: Ceres CLONE 1386018-F
  misc_feature: Encodes the peptide sequence at SEQ ID NO. 19117
  misc_feature (488)..(488): n is a, c, t, g, unknown, or other
  misc_feature (526)..(526): n is a, c, t, g, unknown, or other
  misc_feature (546)..(546): n is a, c, t, g, unknown, or other
  misc_feature (652)..(652): n is a, c, t, g, unknown, or other
tggagctccccgcggtggcggccgctctagaactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaacttctaggaagatgatccgatctacggaaggctgtgcaaagagcattactttggagaggaacaacaaatcagacgatgtgcagcttcacgatctgccgaatgacatcctaggtagcatactatcacggttgacattcagagaatcctcacagatgggccttgtttctcatacctggcggcggctgtggagaagctgttgccgganactggtcttcaccagtgccaccatgttccaacccgganataggagcatcaaacatacnaggaccaactttgccatgagagtcaacagtttcttgcgtcagctacgcactcatcctactcttaataagtttggtattaagttcgggctgcgcaggaagcacactn

SEQ ID NO: 19117 - protein, 134 aa, Zea mays
  misc_feature: Ceres CLONE 1386018-F
  misc_feature (38)..(85): Pfam Name: F-box Pfam Description: F-box domain
  misc_feature (80)..(80): Xaa is any aa, unknown, or other
  misc_feature (93)..(93): Xaa is any aa, unknown, or other
MAKQKEGVDKRTSRKMIRSTEGCAKSITLERNNKSDDVQLHDLPNDILGSILSRLTFRESSQMGLVSHTWRRLWRSCCRXLVFTSATMFQPGXRSIKHTRTNFAMRVNSFLRQLRTHPTLNKFGIKFGLRRKHT

SEQ ID NO: 19118 - DNA, 666 bp, Zea mays
  misc_feature: Ceres CLONE 1386021-F
  misc_feature: Translation starting site: 184
  misc_feature (355)..(355): n is a, c, t, g, unknown, or other
  misc_feature (490)..(490): n is a, c, t, g, unknown, or other
  misc_feature (545)..(545): n is a, c, t, g, unknown, or other
  misc_feature (546)..(546): n is a, c, t, g, unknown, or other
  misc_feature (604)..(604): n is a, c, t, g, unknown, or other
aagctggagctccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgattccggctgggcgtgccggccgcggtgttgggcggncggcgccaacgcgcccatgtcagcggccgacctcctcccgccgggccaccgggacccgtccgtcctggagcggctgctccgcctgctggcgtcccgcggcgttttctccgagtccaccgagtccacgcccaccancgcggcggcggctattccggctcaaccgcggtgggccgacccctgggtgccgggnncccgcctcgggcgcgtcctacgccgactacgtgctgcagcaccacaggacgcgttggntgggcggcgtggccccgcctgcacgaggccgtgtttgaccccgcggggcccgagccgttcgc

SEQ ID NO: 19119 - DNA, 649 bp, Zea mays
  misc_feature: Ceres CLONE 1386023-F
  misc_feature: Translation starting site: 343
  misc_feature (535)..(535): n is a, c, t, g, unknown, or other
  misc_feature (586)..(586): n is a, c, t, g, unknown, or other
  misc_feature (594)..(594): n is a, c, t, g, unknown, or other
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaaaaatggccggaattggcaggaacatggtggcgccgctcctggtgctcaacctcatcatgtacatcatcgtcatcggcttcgcgagctggaacctgaacacttcatcaacgggcagacaactaccccggcgtggccggcaacggcgcgacgttctacttccctgtgtcgccatccctgccggcgtggtgggcgcgncgtccagctgggcggcgtgcacacgtgcgcgcctggcgcacgacagctggncccaacgncgcgtcgtcgctcatcgcctgggccatcacgcgctcgctttcggctgcctgcagg

SEQ ID NO: 19120 - DNA, 699 bp, Zea mays
  misc_feature: Ceres CLONE 1386029-F
  misc_feature: Encodes the peptide sequence at SEQ ID NO. 19121
  misc_feature (313)..(313): n is a, c, t, g, unknown, or other
aaagctggagctccccgcggtggcggccgctctagaactagtggatcccccgggctgcaggaattcgcacgagaccattacctagaacatcctaatcgaaaatcccacctcccaactccagaagtcctccctagacgccgccagccgcgcgcacacccaccgagagctcctcgggctttctttctccgttcctccctcgcgcgctcagggtttcacgatggaggccgaggcggcggccaagagggcgcgggagggcggggaggacgccaccgcgccggtggcgggggccgaggcggtggtcgccggtgctggngagcaggcggaaatctccgccgtcatcccaggatggttctccgagatcagccccatgtggcccggtgaggcgcactccttgaaggtggagaaggttctgttccaggggcaagccagactaccaaaatgtgatggttttttcacccctccacgcaccgggaaggggctttgtcctcgacggagtttattccagtggacagaaagggaatgagggggcggcaccaaaaacacgattactccccctgcccctttggatcccaaaaagaaccccaaaaaaagtgtttggttattgagaggggggagacgggcggtactttaagctccgaaccatcccccacccactcttcgtgagggatggacaacggaacaccgctaggaaacacttat

SEQ ID NO: 19121 - protein, 101 aa, Zea mays
  misc_feature: Ceres CLONE 1386029-F
  misc_feature: SWISSPROT Homolog: EC 2.5.1.16 Spermidine synthase
MEAEAAAKRAREGGEDATAPVAGAEAVVAGAGEQAEISAVIPGWFSEISPMWPGEAHSLKVEKVLFQGQARLPKCDGFFTPPRTGKGLCPRRSLFQWTERE

SEQ ID NO: 19122 - DNA, 663 bp, Zea mays
  misc_feature: Ceres CLONE 1386031-F
  misc_feature: Encodes the peptide sequence at SEQ ID NO. 19123
tggagctccccgcggtggcggccgctctagaactagtggatcccccgggctgcaggaattcgcacgagaccattacctagaacatcctaatcgaaaaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgcccacatccccggcaagtgcggcgtctccgtcggcgtgcccatcagccccaccgtcgactgcaccaagatcaactgatcgatggaccgtagtggaggtagctatgcctctgcatgctcgttggatggcagcgtggccatcagcagcatgcggtcgtcgtcg

SEQ ID NO: 19123 - protein, 126 aa, Zea mays
  misc_feature: Ceres CLONE 1386031-F
  misc_feature (36)..(122): Pfam Name: Tryp_alpha_amyl Pfam Description: Protease inhibitor/seed storage/LTP family
MAARSSSQQLVAAAVLAAALLLLAAGAGTASAAVSCGEVTSSVAPCLGYAMGSAASPSAACCSGVRSLNSRASSTADRQATCNCLKSMTGRLGGGVSMANAAHIPGKCGVSVGVPISPTVDCTKIN

SEQ ID NO: 19124 - DNA, 657 bp, Zea mays
  misc_feature: Ceres CLONE 1386039-F
  misc_feature: Translation starting site: 237
  misc_feature: Pfam Name: Glyco_hydro_79n Pfam Description: Glycosyl hydrolase family 79, N-terminal domain
  misc_feature (153)..(153): n is a, c, t, g, unknown, or other
  misc_feature (530)..(530): n is a, c, t, g, unknown, or other
  misc_feature (531)..(531): n is a, c, t, g, unknown, or other
  misc_feature (585)..(585): n is a, c, t, g, unknown, or other
aaagctggagctccccgcggtggcggccgctctagaactagtggatcccccgggctgcaggaattcgcacgagaccattacctagaacatcctaatcgaaaaaacagcgtcctcctcccgcgtgctctccactcccagaccccggggactacnagggcactgggctaggtccgttggcaacagccgccacactgctccgctctgctctctggaggcattgcctgcctcgagttgtcatggcggcagcggggacgcagctgggtcggctccttgttggcggcctctggctcctggccgcgttgctgcagcggggcgctgcggcggcagtggccgccgtggatgggcggcgcgccatcgcagcgactggggagaacttcgtgtgcgcgacattggactggtggccgccggacaagtgcgactatggcacctgcccctggggccgcgccggcctgctcaacctggatctctccaacaaggtcctcctcaacgccgtcagaggacaaggtggtgtacggcaccgcggacctcgnngcggcgtgcgcgccgttcgccaagaacgcgtcggagatgcacggcttcacgcanggctgcctgaccctgcgcaggtgggacgagctcaacgccttcttccagaaatctgggtttttagatcagctt

SEQ ID NO: 19125 - DNA, 602 bp, Zea mays
  misc_feature: Ceres CLONE 1386044-R
  misc_feature (602)..(602): n is a, c, t, g, unknown, or other
gaggtcgacggtatcgataagcttttttttttttttttttatcgagaaatcattttttattttcttattactaaatacatcacagaccaacaccatcgagaacccgagtgtcctctcattaccccagacacacacgcaacacacgaacggttagtatttcatgaatcaagaaccacaaagttcatacagacagcacaaggcagacctgacaacatgtagccatgcatggacaataggctcttggcctggcacatgttctacggctaacctttctttggcatgggccgccagccttgtatacatgcgggccattgattgatagccttcctgatatcacccggaacgcaagaaaatttgcctgaaatccccagttaaagggggctgtccttgggttcaggggggggcccattcaaaacaatttttgggtttcttccaaacaaaaactgaaaggggccccaattaagggggcccccggggaattcctttaaaataattttcccgaaaaaaaatttccacccccggttcttttgaaaaaaggcccacatttttgggggggggggaaaaaaagaattttttttgtggccaaaaaaaaaaacccccan

SEQ ID NO: 19126 - DNA, 685 bp, Zea mays
  misc_feature: Ceres CLONE 1386045-F
  misc_feature (485)..(485): n is a, c, t, g, unknown, or other
  misc_feature (486)..(486): n is a, c, t, g, unknown, or other
  misc_feature (502)..(502): n is a, c, t, g, unknown, or other
  misc_feature (624)..(624): n is a, c, t, g, unknown, or other
aagctggagctccccgcggtggcggccgctctagaactagtggatcccccgggctgcaggaattcgcacgagaccattacctagaacatcctaatcgaaaaccgcagttcccacccaccaaaccaaactctcctccacaaccacaacctcccccgccgcccctcctcttctcggcttctcccctgccttgttcggccccaaaacggcaagagccgacgccagcaaaccctcgggttcgggagggaaggaaggcacgagcagtgcggctgcctacccgcagctaaccccaaacagcaacgtcgtagccgacgagagcctccgccacctacccaccaactcccgcccgtcgtcgcctccgcttgggttctcgtcgagcagttggtgggcacctaccgcatccagccacagagagagagtgagccactgagccagggcggcaagggggagatgaagaactgtacaggcgcaaaggggggggggccggnngcaacccggcgcccgnctgacgcaatcggcagcccgtggcgctgcccgcccgcccgtgctgggcccctggcgtcccgcgctgaacgcccgaagaagcaaggaaggtgctggcctacctccctggccctggcggcgggnggccgggaaccaccaacggccacggcccggcggccgcgggggccaaacccgccgggagaag

SEQ ID NO: 19127 - DNA, 682 bp, Zea mays
  misc_feature: Ceres CLONE 1386050-F
  misc_feature: Encodes the peptide sequence at SEQ ID NO. 19128
  misc_feature (316)..(316): n is a, c, t, g, unknown, or other
  misc_feature (393)..(393): n is a, c, t, g, unknown, or other
aaagctggagctccccgcggtggcggccgctctagaactagtggatcccccgggctgcaggaattcgcacgagaccattacctagaacatcctaatcgaaaaaaaccctccgtcgacccctcctcctcgatctacaccggcgatcggcggcgagtgatggggtgggcgacgcggttcctggcggcggtgtgcttctttgctgcgggtgtcctcttcgtccccgaggctctccttggttccccctccggcgcaggcgccgtcaccgctgccaagctggcccacgtcctctcctttgccacttcctggggcgccgccntctgggccacctttatcggcggcatcatcatgttcaagaaccctgcgaggcacaggttcgggaaacttgcagagcangatgttccccggctacttcacgcttatctctgcctggcgcagcctctcggtcggcaccttcctcgacctccccccctgaaagacgggtccacccggggaagggctccaggctgggatccccccattaaggggtcggttgagatcttcccccacctggttgtccttccccccccttgcattttgggatggtttaaaaaagggccccaattttggggggggccctggttttctgggaggggaagggggaggtgccaaaaaaaaccccggggtgggtaaatccccccccccc

SEQ ID NO: 19128 - protein, 170 aa, Zea mays
  misc_feature: Ceres CLONE 1386050-F
  misc_feature (54)..(54): Xaa is any aa, unknown, or other
  misc_feature (79)..(79): Xaa is any aa, unknown, or other
MGWATRFLAAVCFFAAGVLFVPEALLGSPSGAGAVTAAKLAHVLSFATSWGAAXWATFIGGIIMFKNPARHRFGKLAEXDVPRLLHAYLCLAQPLGRHLPRPPPLKDGSTRGRAPGWDPPIKGSVEIFPHLVVLPPPCILGWFKKGPQFWGGPWFSGRGRGRCQKKPRGG

SEQ ID NO: 19129 - DNA, 674 bp, Zea mays
  misc_feature: Ceres CLONE 1386055-F
  misc_feature: Encodes the peptide sequence at SEQ ID NO. 19130
  misc_feature (245)..(245): n is a, c, t, g, unknown, or other
  misc_feature (246)..(246): n is a, c, t, g, unknown, or other
  misc_feature (261)..(261): n is a, c, t, g, unknown, or other
  misc_feature (264)..(264): n is a, c, t, g, unknown, or other
  misc_feature (268)..(268): n is a, c, t, g, unknown, or other
  misc_feature (270)..(270): n is a, c, t, g, unknown, or other
aagctggagctccccgcggtggcggccgctctagaactagtggatcccccgggctgcaggaattcgcacgagaccattacctagaacatcctaatcgaaaaaccatcacagtacgcacgcacgcacacaccagcccagcagcagaagcgcccctcggccctcgctcccacaacaagctcaagccagccttctctctctgctccaatggcgcgcttccagctcgcagccgtggccatggccatgcnncttcgccgcggcggnggngcangncccgaccgccaccccgacgccggctcccaggcgtcccccccccggcgacgccgccgccgacccccgcgccggggtctccgcccgtgccgcccccaacatggctcctcgggggcagggcacgccccaaaggcccggccccggggccgaaggccccaaccccgggccgacagccaaggctccccctccccaatagggcccccgcccaaggccccggaggggccccgcacaggcccccccccggaggtctccccggacgacaaaaagaaaagggttttgggggtcaacttgccccatagggcccccccccctgcaaaggaagagggcgggtccggacccggcgttcttaacctaaggagaaaaccaccccctcccccaccccgcaaaaaaattgtaaaaccccccgc

SEQ ID NO: 19130 - protein, 187 aa, Zea mays
  misc_feature: Ceres CLONE 1386055-F
  misc_feature (82)..(82): Xaa is any aa, unknown, or other
  misc_feature (87)..(87): Xaa is any aa, unknown, or other
  misc_feature (88)..(88): Xaa is any aa, unknown, or other
  misc_feature (89)..(89): Xaa is any aa, unknown, or other
  misc_feature (90)..(90): Xaa is any aa, unknown, or other
AGAPRGGGRSRTSGSPGLQEFARDHYLEHPNRKTITVRTHAHTSPAAEAPLGPRSHNKLKPAFSLCSNGALPARSRGHGHAXSPRRXXXXRPPPRRRLPGVPPPATPPPTPAPGSPPVPPPTWLLGGRARPKGPAPGPKAPTPGRQPRLPLPNRAPAQGPGGAPHRPPPGGLPGRQKEKGFGGQLAP

SEQ ID NO: 19131 - DNA, 653 bp, Zea mays
  misc_feature: Ceres CLONE 1386060-F
  misc_feature: Encodes the peptide sequence at SEQ ID NO. 19132
  misc_feature (461)..(461): n is a, c, t, g, unknown, or other
  misc_feature (544)..(544): n is a, c, t, g, unknown, or other
  misc_feature (616)..(616): n is a, c, t, g, unknown, or other
  misc_feature (630)..(630): n is a, c, t, g, unknown, or other
tggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgccccgcggcgcgggcggcgcggttcgcgtgcaacgccacggcngcgcgagcgtccacgtgccaggcgctcgtctcctacgcgccgcccaacgggacggccacgcccacgctggccgccgtgcgggngctcttccagctccgctcccaccgggcgctgctgggccgcaacggccttccgttcttcacgcccgccacggngcccgcgcccgtgncgctgcgggtcccgctgccttgc

SEQ ID NO: 19132 - protein, 101 aa, Zea mays
  misc_feature: Ceres CLONE 1386060-F
  misc_feature (65)..(65): Xaa is any aa, unknown, or other
  misc_feature (89)..(89): Xaa is any aa, unknown, or other
  misc_feature (94)..(94): Xaa is any aa, unknown, or other
MAPLPASLTPCLWLFLCLLAAPCPAARAARFACNATAARASTCQALVSYAPPNGTATPTLAAVRXLFQLRSHRALLGRNGLPFFTPATXPAPVXLRVPLPC

SEQ ID NO: 19133 - DNA, 668 bp, Zea mays
  misc_feature: Ceres CLONE 1386064-F
  misc_feature: Translation starting site: 173
  misc_feature (516)..(516): n is a, c, t, g, unknown, or other
  misc_feature (517)..(517): n is a, c, t, g, unknown, or other
  misc_feature (588)..(588): n is a, c, t, g, unknown, or other
  misc_feature (597)..(597): n is a, c, t, g, unknown, or other
  misc_feature (620)..(620): n is a, c, t, g, unknown, or other
  misc_feature (661)..(661): n is a, c, t, g, unknown, or other
gctggagctcaccgcggtggcggccgctctagaactagtggatcccccgggctgcaggaattcgcacgagaccattacctagaacatcctaatcgaaaaccattttctctcctctctccgtcgccgcctcgggccaaaccctacgcagggagttgattgatcgattgcagccatgagtaagttgcattccgagcttctcaaggattgcatctcccagatagttcaggatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgaggaggctgagaagatgggacttgactacatggatgttgaggccctcaagaaatgaaacagaacaagaagcttgttaagaagcttgccaagaagtaccatgctttttttgcatcagagaacatcatnncagcaattccccgtctccttggtcctggtctcaacaagcaggcaagttccccactctggtcactcaccagnaaatcctgnaaatcaaggtgaatgagacgaangctacagtcaagtttcaactgaagaaagtcctttgcatggntgtcgcg

SEQ ID NO: 19134 - DNA, 664 bp, Zea mays
  misc_feature: Ceres CLONE 1386067-F
  misc_feature: Encodes the peptide sequence at SEQ ID NO. 19135
  misc_feature (521)..(521): n is a, c, t, g, unknown, or other
  misc_feature (526)..(526): n is a, c, t, g, unknown, or other
  misc_feature (535)..(535): n is a, c, t, g, unknown, or other
  misc_feature (579)..(579): n is a, c, t, g, unknown, or other
  misc_feature (581)..(581): n is a, c, t, g, unknown, or other
  misc_feature (582)..(582): n is a, c, t, g, unknown, or other
aaagctggagctccccgcggtggcggccgctctagaactagtggatcccccgggctgcaggaattcgcacgagaccattacctagaacatcctaatcgaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctncaggntggtgccangaaggttgttatctctgcccccagcaagatgcacccatgtttgntnngtggtgtcatgaggacaagtacacctcggatgttaacattgtttccaatgctagctgcacccacaactgccttgctcccctt

SEQ ID NO: 19135 - protein, 161 aa, Zea mays
  misc_feature: Ceres CLONE 1386067-F
  misc_feature (4)..(145): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (116)..(116): Xaa is any aa, unknown, or other
  misc_feature (119)..(119): Xaa is any aa, unknown, or other
  misc_feature (134)..(134): Xaa is any aa, unknown, or other
  misc_feature (135)..(135): Xaa is any aa, unknown, or other
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLQXGAXKVVISAPSKMHPCLXXGVMRTSTPRMLTLFPMLAAPTTALLP

SEQ ID NO: 19136 - DNA, 648 bp, Zea mays
  misc_feature: Ceres CLONE 1386072-F
  misc_feature: Encodes the peptide sequence at SEQ ID NO. 19137
  misc_feature (438)..(438): n is a, c, t, g, unknown, or other
  misc_feature (439)..(439): n is a, c, t, g, unknown, or other
  misc_feature (446)..(446): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (460)..(460): n is a, c, t, g, unknown, or other
  misc_feature (480)..(480): n is a, c, t, g, unknown, or other
  misc_feature (481)..(481): n is a, c, t, g, unknown, or other
  misc_feature (526)..(526): n is a, c, t, g, unknown, or other
  misc_feature (576)..(576): n is a, c, t, g, unknown, or other
aagctggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagagggcagcgcccgcccgcgcgttgcaggggttcctgtgcctggnnagagtgnacgnnnnagcgtgnagctacgtggtggacgtggnngcccgcaaaggggaagagcagggggcgggccgtccccgctggggnccgcgtcagggccgtgccgctgcagtcgccgcttcccgctggcgagaaantatggcattcataagatcatatgtggtgcctgaaggtgttccagacagggttactccttcatatgtacctaa

SEQ ID NO: 19137 - protein, 130 aa, Zea mays
  misc_feature: Ceres CLONE 1386072-F
  misc_feature (61)..(61): Xaa is any aa, unknown, or other
  misc_feature (64)..(64): Xaa is any aa, unknown, or other
  misc_feature (65)..(65): Xaa is any aa, unknown, or other
  misc_feature (66)..(66): Xaa is any aa, unknown, or other
  misc_feature (68)..(68): Xaa is any aa, unknown, or other
  misc_feature (75)..(75): Xaa is any aa, unknown, or other
  misc_feature (107)..(107): Xaa is any aa, unknown, or other
MAPAVGLKRSATQTITLPPPDTRLAVRDVMRSTIPSQPAVAPASTERAAPARALQGFLCLXRVXXXAXSYVVDVXARKGEEQGAGRPRWGPRQGRAAAVAASRWREXMAFIRSYVVPEGVPDRVTPSYVP

SEQ ID NO: 19138 - DNA, 632 bp, Zea mays
  misc_feature: Ceres CLONE 1386083-F
  misc_feature: Encodes the peptide sequence at SEQ ID NO. 19139
  misc_feature (327)..(327): n is a, c, t, g, unknown, or other
  misc_feature (378)..(378): n is a, c, t, g, unknown, or other
  misc_feature (379)..(379): n is a, c, t, g, unknown, or other
  misc_feature (402)..(402): n is a, c, t, g, unknown, or other
aagctggagctccccgcggtggcggccgctctagaactagtggatcccccgggctgcaggaattcgcacgagaccattacctagaacatcctaatcgaaaaaagcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtgnaggagaaccggcgggctctccgtgagctcctggtctgctgccctggtgccnntcagacatcaggcgtgtgatccntcttccgagaaaaaaccctctctccccaaaaaaaccccgggggggggggaggcccccttttttttttagggcccccccccacgagaggggggggggggcccccccccccttcttttttttgggcaaaaggagacacctttttttgttgttgtgtttgtccacaaaaaaaaacaccccccccccccgaaaatatttttcgggggggggggggttttaataaaaaaaaaggc

SEQ ID NO: 19139 - protein, 71 aa, Zea mays
  misc_feature: Ceres CLONE 1386083-F
  misc_feature: SWISSPROT Homolog: EC 4.1.2.13 Fructose-bisphosphate aldolase
  misc_feature (49)..(49): Xaa is any aa, unknown, or other
  misc_feature (66)..(66): Xaa is any aa, unknown, or other
MSAYCGKYADELIKNAAYIGTPGKGILAADESTGTIGKRLSSINVENVXENRRALRELLVCCPGAXQTSGV

SEQ ID NO: 19140 - DNA, 659 bp, Zea mays
  misc_feature: Ceres CLONE 1386089-F
  misc_feature: Translation starting site: 198
  misc_feature (530)..(530): n is a, c, t, g, unknown, or other
  misc_feature (553)..(553): n is a, c, t, g, unknown, or other
  misc_feature (554)..(554): n is a, c, t, g, unknown, or other
  misc_feature (591)..(591): n is a, c, t, g, unknown, or other
aaagctggagctccccgcggtggcggccgctctagaactagtggatcccccgggctgcaggaattcgcacgagaccatacctagaacatcctaatcggaactccaaagtttcgtccaccatttcgctcccgcaagcaccgatttgtttactgctctctccgacgcgcggcggcggagctccctacgacgactgaaccatgtgcggcggcgcgatccttgccaaccttcgcgagccggcgccgcgccggctcacagagcgggacatctggcagcagaaaaagaagctcaagaggggcggcggcggcgggaggcgctcgttcgcggcggaggacgatgaggacttcgaggccgactttgaggtcttcgaggccgactccagtgattcagatttggagctcagggaggggactgacgacgacgtcgtcgagatcaagcccttcactgcccagaggactttctccagcgatggcttaagcaccatgactagtgctgtagcaaggtcagccaaagagaagagaagaatctatacnggggtatccgccagcggccttgnngcaagtgggctgctgagatcagagatcctcgaagggngtccgtggttggcttggtactttcaatagtccctgagaaagctgcagagctatgatgcccaagcgcgc

SEQ ID NO: 19141 - DNA, 661 bp, Zea mays
  misc_feature: Ceres CLONE 1386091-F
  misc_feature: Encodes the peptide sequence at SEQ ID NO. 19142
  misc_feature (373)..(373): n is a, c, t, g, unknown, or other
  misc_feature (413)..(413): n is a, c, t, g, unknown, or other
aaagctggagctccccgcggtggcggccgctctagaactagtggatcccccgggctgcaggaattcgcacgagaccattacctagaacatcctaatcgaaaaatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgcccggcggctgtacccctacgcggagtaccctgagcagccgcagtgcagcccgctggcggcggcgccctactacngcgggtgtgggcagccgagcgccatgttccagccgctccnggcacagtgctgccagcagcagatgaggatgatggacgtgcagtccgtcgcgcaccagctgcagatgatgatgcagcttgagcgtgccgctgccgccagcagcagcctgtacgagccagctctgatgcagcagcagcagcagctgctgccagcccagggtctcaaccccatgcccatgatgatggcgcaaaccatgcccgcccatggtgaactctaccagtaccagttggccaggtacggcaccaacc

SEQ ID NO: 19142 - protein, 166 aa, Zea mays
  misc_feature: Ceres CLONE 1386091-F
  misc_feature (71)..(71): Xaa is any aa, unknown, or other
  misc_feature (84)..(84): Xaa is any aa, unknown, or other
MKMVIVLVVCLALSAASASAMQMPCPCAGLQGLYGAGAGLTTMMGARRLYPYAEYPEQPQCSPLAAAPYYXGCGQPSAMFQPLXAQCCQQQMRMMDVQSVAHQLQMMMQLERAAAASSSLYEPALMQQQQQLLPAQGLNPMPMMMAQTMPAHGELYQYQLARYGTN

SEQ ID NO: 19143 - DNA, 653 bp, Zea mays
  misc_feature: Ceres CLONE 1386092-F
  misc_feature: Encodes the peptide sequence at SEQ ID NO. 19144
tggagctcaccgcggtggcggccgctctagaactagtggatcccccgggctgcaggaattcgcacgagaccattacctagaacatcctaatcgaaaaatatatgtaacttcattcttgcaacatcacaagcacacaggctttcacacccatcttgcattggctctccggctgctgttcttgcttcctcgctgcacacaaccaagcaaagtcacttttccaaggtaaagaagcatgcatccgagctgctctccactggcagtgcctccgggcttccggttccacccgacagacgaggagctcctctactactacctgaggaagaaggttgcctatgagcccatagatcttgatgtcataagggaggtggacctcaacaagcttgaaccatgggacctcaaagatcggtgcaggattgggacggcggagcctcaggacgagtggtatttcttcagccacaaggacaggaagtaccctacggggacgcgaaccaaccgggcgacgacggctgggttctggaaggcgaccggacgggacaaggccatcttcctcggcaacgctgggaggaggatcggcctgaggaagacgctggtgttttacactggcagggcaccccatggcaagaagacggactggatcatgcacgagtaccgcc

SEQ ID NO: 19144 - protein, 140 aa, Zea mays; identical to SEQ ID NO: 15595
  misc_feature: Ceres CLONE 1386092-F
  misc_feature (10)..(140): Pfam Name: NAM Pfam Description: No apical meristem (NAM) protein

SEQ ID NO: 19145 - DNA, 714 bp, Zea mays
  misc_feature: Ceres CLONE 1386102-F
  misc_feature: Encodes the peptide sequence at SEQ ID NO. 19146
  misc_feature (501)..(501): n is a, c, t, g, unknown, or other
  misc_feature (647)..(647): n is a, c, t, g, unknown, or other
  misc_feature (714)..(714): n is a, c, t, g, unknown, or other
cacccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgcttccacccgtccgtcgcctctctctcggctgcctgattgatttggttgccccggttccagcaatggcggtccaggcgcattatcaccaccactaccaccgcgagtcccctttcctcgtcagcggcgcgccggagggcagccggttggcggcagcgatggagctgcatcatcaggcgcagaaggaggctatggcgccgcagcaggctcaggctccgcccctcttcttggacttctcgcatggagattacggcggcgggaggaagcggcagcgcgaggcggagcctggggccggtcgcagttcttctctctgcagcagcaaccgcaggcgcaggggncccaaggtgatcaacctggcgcaacttcagaagcgggacggcgatgggcctccggctcactttcgacgaggactcggaagcacgtggtcgtggacgtccccggcctcggccttcggcctcatgtctcctctctaaagagctcgccngcgcagcgcgatcggcacagggaacgagaatgggacgggctgatccaggaaacatgcgggacaggcn

SEQ ID NO: 19146 - protein, 135 aa, Zea mays
  misc_feature: Ceres CLONE 1386102-F
MAVQAHYHHHYHRESPFLVSGAPEGSRLAAAMELHHQAQKEAMAPQQAQAPPLFLDFSHGDYGGGRKRQREAEPGAGRSSSLCSSNRRRRGPKVINLAQLQKRDGDGPPAHFRRGLGSTWSWTSPASAFGLMSPL

SEQ ID NO: 19147 - DNA, 737 bp, Zea mays
  misc_feature: Ceres CLONE 1386103-F
  misc_feature: Encodes the peptide sequence at SEQ ID NO. 19148
  misc_feature (405)..(405): n is a, c, t, g, unknown, or other
ggagctccccgcggtggcggccgctctagaactagtggatcccccgggctgcaggaattcgcacgagaccattacctagaacatcctaatcgaaaacccatttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggcccagctggctgcctcctctatcgacagcatcgtggacggcagcgacgccntcatgggagccggttggtgctggcagcaacacggtagtagctggtggcccaggtggagtgcaaccattgaacgtgcaccagccggtttatgttgcggacccaaggagggggggggggggaattccaaaggggggaaaggaaggcccaaccggggaagccctggaagaaaaaagggttggacttacggggttccacgggcgcgggggggaaaatttgaatggggattccccgggtttccccaaaaagagagggggggagtttaaaaacgcgggggtgttgggggggaccctttgcagaggtataatcggggggggggggggcgaaacccaaac

SEQ ID NO: 19148 - protein, 150 aa, Zea mays
  misc_feature: Ceres CLONE 1386103-F
  misc_feature (14)..(38): Pfam Name: zf-A20 Pfam Description: A20-like zinc finger
  misc_feature (64)..(64): Xaa is any aa, unknown, or other
MEHKEAGCQAPEGPILCINNCGFFGSAATMNMCSKCHKEMITKQDQAQLAASSIDSIVDGSDAXMGAGWCWQQHGSSWWPRWSATIERAPAGLCCGPKEGGGGNSKGGKGRPNRGSPGRKKGWTYGVPRARGGKFEWGFPGFPQKERGGV

SEQ ID NO: 19149 - DNA, 705 bp, Zea mays
  misc_feature: Ceres CLONE 1386113-F
  misc_feature: Encodes the peptide sequence at SEQ ID NO. 19150
tccccgcggtggcgcccgctctagaactagtggatcccccggtctgcaggaattcgcacgagaccattacctagaacatcctacatcgaaaactcagctgctgacccgctgcctgaagtctttgcccgctcctctaggttaaatggcccctgcccccgctctcaccgccacatccgacctgaagtgttcccacctacccgaagtccactcgctggcctgtcaccgccacccgggataccaccgcgactcgatgctttctccagcgataccgccgccccctggctcatgtcatcaaggatctggagtgattgctaaaagcctcctctggttgagagcgagtagctccttccagaaagataacatccgagaggacgcgtagttgcccttctcacatagtgtcgcagaataaagaaaattttgtgaagattttaaagagtgccaactccattattccccatatagtgtgaggggagtacaattctcgccctgttgtaccccgccttcaattacctggctctataccatgtagtatgcaccagctttactacccgtgaagtatggctgtcgaagaagcctcccaaaggcacgccattttatccgaacatctaagaaatcccgaagcaatcgctgcgaggaattatcaccaccacctagcccccaagcccctgacacgggatccacttcttggcactccttgcctcataa

SEQ ID NO: 19150 - protein, 42 aa, Zea mays
  misc_feature: Ceres CLONE 1386113-F
MLSPAIPPPPGSCHQGSGVIAKSLLWLRASSSFQKDNIREDA

SEQ ID NO: 19151 - DNA, 865 bp, Zea mays
  misc_feature: Ceres CLONE 1386114-F
  misc_feature (15)..(15): n is a, c, t, g, unknown, or other
  misc_feature (18)..(18): n is a, c, t, g, unknown, or other
  misc_feature (21)..(21): n is a, c, t, g, unknown, or other
ccccccatattcccncanctnaaatcataccctccccccccccccacactggagctccccgcggtggcggccgctctataactagtggatcccccgggctgcaggaattcgcacgagaccattacctagaacatcctaatcgaaaaaccgagaaacaaaaattgaaggaaattgaaggggccgcagtgcagcaggacgatggtcagaacagtgaagacgggtggacctggttcagtagacccagcgtgagtactctcgcgccactcgcctccgcgtccgccaccgccttctccaccacacgccccactgcgtacaggccttgcttggactggtactgcatccaaagcaatgttagtagaacacacacacacacacgcatatgtctatccgttacgtgctagtagcatgcagtacagtacctgagaggtgtatctttggaacgacccacgtctcgagctttgagcttgtgcgagcctgttggccctccggacctgaaggccggtccgggttccccgcccgaggagccggggtcagctgggcacgccacccgcccgcccgaccataaactcttgctgctggctgcctggctggcaggcgcccggaatccgggaacccgggctccgccgccccggtcgccgaatggctgtagggcactgcgaaatcccgatatcctgttacggcgcgaagtacggcgaagcccggttgtggccctaaagtccccctctacattcggatcctacgtccgcgacgtcggtccttccccgtgaatgtggatttctttcatcaccctcattcgcctccgtcaatagcgacagtcccctctcaccacctaggtacccccccccacccccaataatatggtgat

SEQ ID NO: 19152 - DNA, 749 bp, Zea mays
  misc_feature: Ceres CLONE 1386120-F
  misc_feature: Encodes the peptide sequence at SEQ ID NO. 19153
tcaccgcggtggcggccgctctagaactagtggatcccccgggctgcaggaattcgcacgagaccattacctagaacatcctaatcgaaaaacttctacctggcctcgcaggcttcgcaaggcggccacacgccgatacctcctccttcacccgctccgtcgtcccccccagccggccacgccaccatgctgccaccggccgcgcgccttgcggcccgccgcctcctcggcctcgcctccgcatctgcgtcggaagccgccggccgccgggtagcttcctctccgatcgcttccgcaggctactccgccgacgcgtccaggggctccgtctccagcaccaggcccttctccacgtctcttaactaccaccttgactcgccggagaacaagccggaccatgaaatgggagttctcacaggcgaatatgaagaaggtcaatgagattctgtctcactatccaagcaactacaagcaatctggtattattccgctgcttgatcttgcacagcagcagcatggtggatgggtgccagttgcagcaatggatgctattgctaaaattgtcgaagatgcaccaatcagggcctatgaagttgcaacccttctataccatgtttaacaggactaaagctcggtaaataccacctttttggtgggggggaactacaccctttgtatgattccggggcttcacgcagaaaaacgaaagaaaacgattgtttgggaaccaccttttggtaagctaaaac

SEQ ID NO: 19153 - protein, 73 aa, Zea mays
  misc_feature: Ceres CLONE 1386120-F
  misc_feature: SWISSPROT Homolog: EC 1.6.99.5 NADH dehydrogenase (quinone)
MKWEFSQANMKKVNEILSHYPSNYKQSGIIPLLDLAQQQHGGWVPVAAMDAIAKIVEDAPIRAYEVATLLYHV

SEQ ID NO: 19154 - DNA, 731 bp, Zea mays
  misc_feature: Ceres CLONE 1386126-F
  misc_feature: Encodes the peptide sequence at SEQ ID NO. 19155
  misc_feature (553)..(553): n is a, c, t, g, unknown, or other
  misc_feature (588)..(588): n is a, c, t, g, unknown, or other
  misc_feature (606)..(606): n is a, c, t, g, unknown, or other
  misc_feature (634)..(634): n is a, c, t, g, unknown, or other
  misc_feature (635)..(635): n is a, c, t, g, unknown, or other
caaagctggagctccccgcggtggcggccgctctagaactagtggatcccccgggctgcaggaattcgcacgagaccattacctagaacatcctaatcgaaaaaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacagaccattgggggaggtgatgatgctttcaacaccttcttcagtgagactggtgctgggaagcacgtgccccgtggctgtttttgttgaccttgaacccactgtcatcgatgaggtgagaactggcacctaccgccagctcttccaccctgagcagctcatccagtggggaaaggaggatgcagccaacaacttttgcccgtggtcactacccattggncaagggagattgttgacctggtgccttgatcgcantcaggaagcttgccgacnactgcactgggtctccagggcttcccgnnctcaacggctttggggggggggaggaacggtttcgcgggccttggttccctctccagaaaggcgcctgtctgttgactacggcagaaatcccaggg

SEQ ID NO: 19155 - protein, 171 aa, Zea mays
  misc_feature: Ceres CLONE 1386126-F
  misc_feature (124)..(124): Xaa is any aa, unknown, or other
  misc_feature (130)..(130): Xaa is any aa, unknown, or other
  misc_feature (140)..(140): Xaa is any aa, unknown, or other
MRECISIHIGQAGIQVGNACWELYCLEHGIQADGQMPGDRPLGEVMMLSTPSSVRLVLGSTCPVAVFVDLEPTVIDEVRTGTYRQLFHPEQLIQWGKEDAANNFCPWSLPIGQGRLLTWCLDRXQEACRXLHWVSRASRXQRLWGGGGTVSRALVPSPERRLSVDYGRNPR

SEQ ID NO: 19156 - DNA, 784 bp, Zea mays
  misc_feature: Ceres CLONE 1386129-F
gctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcgtataccatccgtacggctatcggcgtcatcggcaatggcaccgcccttgtgctcttcctctccccggggtaagaatttatcgattctgcttctgcctgatatgttttatctaccaatcacaatactaaaaaaaataatggaaactagtactacgcaatccaggctttctccttatcccgaacatcatggataaatttcaaaaaaaggagagcatccctccccagcaaaaaaaactggatggccacgtaactttgacaagttgactttttccgcgcgaaaacaagccaccctaaccactaacgtaacttgtgcctcctggcttatggtataaccatacttgcactaccaatatagccttcatattattccgaaacacatggctgcacccgcagggccccccccctcctcggcgccatcttggaaaagaagcgcggccgggcgctgacaaaatcctcgaccgaatccccgaaccccggtcgcacccttgtctgaactctgccatggaggggcggtgtgctcccacggtactgcccccccgccgtcactcccctacccacacggccgggtgg

SEQ ID NO: 19157 - DNA, 670 bp, Zea mays
  misc_feature: Ceres CLONE 1386130-F
  misc_feature: Encodes the peptide sequence at SEQ ID NO. 19158
  misc_feature (457)..(457): n is a, c, t, g, unknown, or other
gctctagaactagtggatcccccgggctgcaggaattcgcacgagaccattacctagaacatcctaatcgaaaaatcgacccagccatctcctcaccctcgttcccacacagtccgccactcctttagtagcttgtgatttgtacggcgacgagatcactggtcgggtggcggacgacgacacatggtgaagggtagtgtgggtgcatcatggtgggcgttcctcctgctcgccggcgtgctgctggtcgtagcagccacggccggggcggaggacggagtggtcgaacgggaccgcaaggaggacctgcggtggggcgagcaggcgtgcgagtgtcagtacggaaaggacaccccgcggaagagggaatgctagagcgagtgccgagcggcaccagcaagctgacgcggtcgaggacggcgacagcggcgtggacgcctacgtctcccgctccggngaggggcgagtgccgtcgccagtgcctgcgccgccacgagggccagccggtgggatacccaggagtgcatgaggcggtgccgccgacgcggactggccgtcgacagtggagcaagagtacggtcgcgggagcgatagcgcggcaaagtggccgatagaggtgcgagcgccaccgccgcgggtgactgggtgggatacgcattgctgcctgatg

SEQ ID NO: 19158 - protein, 63 aa, Zea mays
  misc_feature: Ceres CLONE 1386130-F
MVKGSVGASWWAFLLLAGVLLVVAATAGAEDGVVERDRKEDLRWGEQACECQYGKDTPRKREC

SEQ ID NO: 19159 - DNA, 725 bp, Zea mays
  misc_feature: Ceres CLONE 1386131-F
  misc_feature: Encodes the peptide sequence at SEQ ID NO. 19160
ggagctccccgcggtggcggccgctctagaactagtggatcccccgggctgcaggaattcgcacgagaccattacctagaacatcctaatcgaaaaaagatccgatctccctctctctccccaatcctccccgcctccccgcctccccctaccaaatcagcaccacccaaggcgcatccgagccacggccgcgcaatgccgccctctgtcgatgcaatgccggcccccggagacgccgcgggcggcggcgacgtgcgcatgatctcctccaaggagctccgctctcacgcgtccgccgacgacctctggatctccatctccggcgacgtgaacgacgtcacgccctggctcccccaccacccgggcggcgacctcccgcttctcaccctggaggggcaggacgccaccgacgccttcgccgactaccacccgccctcggagcgcccgctcctccgccgcttcttcgttggccgcctctccgactacgccgtctcccccgcgtccgccgactaccgccgtctcctcgcgcagctatcctccgcgggcctcttcgaacgcgtcaggcccacccccaagatgcagctcgtactgatggactgcctcttctacaccgcgctctacctcgtcctcgcctgcgacagcgcctgagcgcacctcctcatggagaaacacatcgaattcgtctgcatccagtccgagtggaagggccacgactctggccacca

SEQ ID NO: 19160 - protein, 150 aa, Zea mays
  misc_feature: Ceres CLONE 1386131-F
  misc_feature (22)..(95): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MPPSVDAMPAPGDAAGGGDVRMISSKELRSHASADDLWISISGDVNDVTPWLPHHPGGDLPLLTLEGQDATDAFADYHPPSERPLLRRFFVGRLSDYAVSPASADYRRLLAQLSSAGLFERVRPTPKMQLVLMDCLFYTALYLVLACDSA

SEQ ID NO: 19161 - DNA, 756 bp, Zea mays
  misc_feature: Ceres CLONE 1386133-F
  misc_feature: Translation starting site: 206
tccccgcggtggcggccgctctagaactagtggatcccccgggctgcaggaattcgcacgagaccattacctagaacatcctaatcgaaaaaattgagcatcgcatagataggcgtcttcgtactcgcctacctccgcggctcaaacctttcccccttctcccaattccttccgcaggccgccgctccacccggacgatgacgccatgagggagcgcatttcgatccgcatcggccaggccggtatccaggtcggaaacccgtgctgggagctgcactgccttgagcatggcattcaggctgagggacacatgcccggagacaagacgattgggggaggagcatgatgctttcaacaccttcttcagcgacactggcgctgggaagcacgtgccccgtgaccccctgtggcgaccgtgaacccactggcatcgatgaggcgagaactggcacctaccgacagctcttccacacctgaccagtccatcagggggaaggaggacgcagccaacaactttgcccgaggccacctacaccactggggaggaccatgctgacctggggccttagtcgcttccggaagcttgcccgacaaatgctatgggtctcaacagacttccctcgtcttcaacggctttctggtagtaaggaaccgggccccctgagccttggaatcccctcctcccaaagacggcgtgggccgcccccaataggggcaagagagctcaagcgttggggtgtaaagagggccacaact

SEQ ID NO: 19162 - DNA, 734 bp, Zea mays
  misc_feature: Ceres CLONE 1386135-F
  misc_feature: Translation starting site: 196
  misc_feature (539)..(539): n is a, c, t, g, unknown, or other
  misc_feature (565)..(565): n is a, c, t, g, unknown, or other
  misc_feature (658)..(658): n is a, c, t, g, unknown, or other
  misc_feature (659)..(659): n is a, c, t, g, unknown, or other
aaaagctggagctccccgcggtggcggccgctctagaactagtggatcccccgggctgcaggaattcgcacgagaccattacctaaaacatcataatcgaaaactttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcacaacggcaaaagggtcatggctgtccgcatcatcaacataaccctggagatcattcacctgctcaccgatgccaccccatcccaggtcgtcggtcgacgcgatcatcacagtggncccccgtgaggagcacccccgatggntcccccctttggggtgggaaaaaagccagcccgtggatactcacccccggtgaggagggtgaaccaggccatctacctcctcacactgggggnnccaggggaagagtggctttccggaacatcaaacccccattgccgagtgggcctggcaagatgagcttgatcaacc

SEQ ID NO: 19163 - DNA, 823 bp, Zea mays
  misc_feature: Ceres CLONE 1386138-F
cacccgcggtggcggccgctctagaactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactacgagggccgcctcatccgtcaccgccaggctgccagccgtcgcccgccgtcgcccgcagctcctcgtgcgtgcccccgccaaggagatcgccttcgaccagggctccagagccgccccttccggtcggacgtggagaagttccgccgcccgggggcagtggatccccttggacccagagggaacaaaatggtggccttggattgctctctacaccccccccagagctgcccatacgacggaaggttccacattggccgccgcggtaaggcagccctcgatcgatccccactggaccacacggcccgggaacttcccctccggcctggaggggaggttggttaagaaccgacgcaaggaccttttagtttggtgagaacgaaaataaaaacccgcgccccttgatttccccactaaggcaaacccccttcccaactcagcccccagtggaccgccccgcaccgcgccgggcgcgagaagcccaggcgcctcgcctcatcagaccgggcactcgcatccacaacggtgctctgcacaatggggcgcggacgcagtatgccaacgagcctacccatggcaaacaccaggacgcctccgaagcatatt

SEQ ID NO: 19164 - DNA, 741 bp, Zea mays
  misc_feature: Ceres CLONE 1386139-F
  misc_feature: Encodes the peptide sequence at SEQ ID NO. 19165
ggagctccccgcggtggcggccgctctagactagtggatcccccgggctgcaggaattcgcacgagaccattacctagaacatcctaatcgaaaaagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcgctggtgcaagcaggcgtgcgagtggcagtacggaaaggacaccccgcggaagagggaatgcgagagcgagtgccgcgaccgcccccagcaagctgacgcgggccgaggacggcgacagcgccgtggacgccctacgtctcccgctccgggaagggcgagtgccgccgccagtgccctgcgccgccacgaagggccagccgcgggaaacccaggaggtgcatgagctggggccccccccccgggacgggccgccgacatgggagcaagaagcccggcccccgccaacgaaaagcgcgggccaaattcgctggcagaagtgcccaacacccacccaccccgggcgactgggggggaaaaaggcacccgcctgccctgaagggactcggcagaaaccccgggaagcccgtaaaagcaag

SEQ ID NO: 19165 - protein, 116 aa, Zea mays
  misc_feature: Ceres CLONE 1386139-F
MGKGSVGASWWAFLLLAGVLLVVAATAGAEDGVVERDRKEDLRWCKQACEWQYGKDTPRKRECESECRDRPQQADAGRGRRQRRGRPTSPAPGRASAAASALRRHEGPAAGNPGGA

SEQ ID NO: 19166 - DNA, 673 bp, Zea mays
  misc_feature: Ceres CLONE 1386173-F
  misc_feature: Encodes the peptide sequence at SEQ ID NO. 19167
  misc_feature (542)..(542): n is a, c, t, g, unknown, or other
agagctggagctccccgcggtggcggccgctctagaactagtggatcccccgggctgcaggaattcgcacgagaccattacctagaacatcctaatcgaaaaatctccagcagcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccaggcgtgagtgttctgattgaaaccactagcggcaacacaggcattggactgggctttatggctgctgccaagggctacaaacttacactcacaatgcctgcctccatgagcatggagagggagatcatattgaangcttttggtgctgaacttgtccttactgacccactccctggaaatgaaagagctgtcaagaaagcggaagagatacagcaaagacacccaactcttacaccttttcacaattgaaaatccagctaacccaa

SEQ ID NO: 19167 - protein, 150 aa, Zea mays
  misc_feature: Ceres CLONE 1386173-F
  misc_feature (12)..(151): Pfam Name: PALP Pfam Description: Pyridoxal-phosphate dependent enzyme
  misc_feature: SWISSPROT Homolog: EC 2.5.1.47 Cysteine synthase
  misc_feature (113)..(113): Xaa is any aa, unknown, or other
MGEASPSIAKDVTELIGNTPLVYLNKVTEGCVGRVAAKLESMEPCSSVKDRIGYSMITDAEEKGLITPGVSVLIETTSGNTGIGLGFMAAAKGYKLTLTMPASMSMEREIILXAFGAELVLTDPLPGNERAVKKAEEIQQRHPTLTPFHN

SEQ ID NO: 19168 - DNA, 747 bp, Zea mays
  misc_feature: Ceres CLONE 1386188-F
  misc_feature: Encodes the peptide sequence at SEQ ID NO. 19169
  misc_feature (13)..(13): n is a, c, t, g, unknown, or other
  misc_feature (28)..(28): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (56)..(56): n is a, c, t, g, unknown, or other
ttttatttttttnccccccccccctccntcatatttttgtaatnnnnccgaatatnggtacaaactggagctccccgcggtggcggccgctctagaactagtggatcccccgggctgcaggaattcgcacgagaccattacctagaacatcctaatcgaaaaacaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccaccctccggtggatctcccaccgccggtccacctgggcgccgccgggtccacctgccaccgccgggccatgtgccgccgccggttcatcttgcgcccgcaccatgccactaccctacttcaccgccccgggcctcagcctcatccccaggccacacccttggcccggggcaaccggccgaaaaccaaaaccccggggcaagtttggaaggggaaccctgctgacgtttggccagacccccccgaaatccgggggccaagggggcctccaaggttccctggggggggatataagggggccagccccgaacgggggggaaggcccccaaagtgggttcgcccccctacgggggcgccaagtgcgcgttcgcg

SEQ ID NO: 19169 - protein, 122 aa, Zea mays
  misc_feature: Ceres CLONE 1386188-F
MRVLLVALALLALAASATSTHTSGGCGCQPPPPVHLPPPVHLPPPVHLPPSGGSPTAGPPGRRRVHLPPPGHVPPPVHLAPAPCHYPTSPPRASASSPGHTLGPGQPAENQNPGASLEGEPC

SEQ ID NO: 19170 - DNA, 641 bp, Zea mays
  misc_feature: Ceres CLONE 1386193-F
  misc_feature: Encodes the peptide sequence at SEQ ID NO. 19171
aaagctggagctccccgcggtggcggccgctctagaactagtggatcccccgggctgcaggaattcgcacgagaccattacctagaacatcctaatcgaaaaattccggccctctcgcccgtccgtctcctgcccccgtccctggtcggaccacgagagccccggactgcgttcacctctgccttttgttcacccctcttgtctcgtgcgtgcgacaacaactgggcgaccgccgccgccgccctacgccaggtgcgcaggtcttcgtcggatccttcgccggcgaggcgacgagcacccaccaggtgatgcccccggcttaattgaatgggctctcttctcaccaggactggcatcctgccatggctccagggcgagatcgttgatcccgtgctgcaggtcatcagaaggggagcagaacccaagcaactggccttctctgctgccctcggtgtcacgattgggatctttccgatatgtgggaccactgttattcttggtgctgttgttgtagcaatgttggggaagtcgttgcaatgctgttactcttatggttctaaatttgggcgccacttccatttgaactaagcttgatcggcccctttcttgcgtttgggtggaagccgtacctgggagggggc

SEQ ID NO: 19171 - protein, 86 aa, Zea mays
  misc_feature: Ceres CLONE 1386193-F
MGSLLTRTGILPWLQGEIVDPVLQVIRRGAEPKQLAFSAALGVTIGIFPICGTTVILGAVVVAMLGKSLQCCYSYGSKFGRHFHLN

SEQ ID NO: 19172 - DNA, 675 bp, Zea mays
  misc_feature: Ceres CLONE 1386195-F
  misc_feature: Translation starting site: 483
  misc_feature: SWISSPROT Homolog: EC 1.1.1.1 Alcohol dehydrogenase
aaagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagtagtagagagtgtcggtgaaggtgtgaccgagttccaagtcggtgaccacgttctcactgtcttcattggggaatgcaagagctgcaagcactgcgtctcagggaagagcaacatgtgccagaagctcggtctggaga

SEQ ID NO: 19173 - DNA, 675 bp, Zea mays
  misc_feature: Ceres CLONE 1386196-F
  misc_feature: Encodes the peptide sequence at SEQ ID NO. 19174
agagctggagctccccgcggtggcggccgctctagaactagtggatcccccgggctgcaggaattcgcacgagaccattacctagaacatcctaatcgaaaactctcctcccgtccgtatctctctcttgctcgcactcgcggagatcgaagagaagcgcaggaggccccagcactagcgccgccccgccgccgcatcagacatggcgctggccgctcgcctcgtctcgcgctcccgtcagctatattcggttcaagccactttggggaatggaggtgtcactcaagttcgctcctttgccaaggatgcagctccagctgaccgtcctcctgtcagtggggatgatctcctgaagggcatattctttgaggtaaagaagaagttcgagacagctcttggtgttcttaaaaaggaaaagatcactattgatccagatgacccagcgggagtttctcgttatgcccaagtcatgaagactgtaagggaaaaagggggatcttctctccgattctcaagggattaaatataccattgagacccttcaccaagggccatccctgatgccacggacttaacttggaatacctcttcaaacaggctcaggaaaaaaagaaggggcgcttaataaaaccatccttggaaattgggagccctttgggaggagggcaagcctcc

SEQ ID NO: 19174 - protein, 106 aa, Zea mays
  misc_feature: Ceres CLONE 1386196-F
MALAARLVSRSRQLYSVQATLGNGGVTQVRSFAKDAAPADRPPVSGDDLLKGIFFEVKKKFETALGVLKKEKITIDPDDPAGVSRYAQVMKTVREKGGSSLRFSRD

SEQ ID NO: 19175 - DNA, 912 bp, Zea mays
  misc_feature: Ceres CLONE 1386199-F
  misc_feature (35)..(35): n is a, c, t, g, unknown, or other
tccccccccccacctcccgcacaccgccccttacnttcacctataagagacaagctggaactccccgccggtggaggccgctctagaactagtggatcccccgggctgcaggaaggcgcacgagaccattacctagaacatcctaatcgaaaaaccaaaagttcaaaaccccatccaattccaaatcccacttctcgccagttcacctccgcctccgctcgtcccctccccctcccgtcctgccatgggcaccgcagcacgcgccctcgtcgccgcacgcccggcacggccggctgctgacgtcccgacgccaccccgcccccgtcttgcatcacgacagagtggacacgcgggggcgcggttggggcgaaccgcccgcatgggtcgccggccggggttccgggctaagtcaccccccgccctacgagactgggggcgcccccccgggcagccgccccgaaccgcgccctcgcggaatccaaagggcacccgcaatcgacgaagcggccgcgggctccgcgtaccaagccacaagccctgcgggagcgtcaaggacgtccacaaagaacgagcacagtcagagaaggaatttggctaactcgcaccgaagagcgccgggaacaacgcgcgtctgacgggacaactgaaccgcagtgtccgccgcacgacacaacggccacatacacatcgggcgcacgcgggagcaaggggcatcggttctcagggggatccggaatgcccgtacaactgcgaaaatggctgcgtcgccgcagcgcatgaccctcacgggacgctgcacgggtggagaagaccccgatctggagcctcgtccgggacgcggttaagccctccaggggcgcacggcgctattcgagtcaaagagcgcgcgcggaagaccaatgtcgtcgcaag

SEQ ID NO: 19176 - DNA, 857 bp, Zea mays
  misc_feature: Ceres CLONE 1386200-F
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (37)..(37): n is a, c, t, g, unknown, or other
  misc_feature (38)..(38): n is a, c, t, g, unknown, or other
ggttgtttttgggnnttggnttgggtggttttaaatnnaaaagaggcgggggcaaagctggggctccccgcggcggcggccgctctagaactagtggatcccccgggctgcaggaattcgcacgagaccattacctagaacatcctaatcgaaaaaggatccattaacacccctacgtacgcctttcctctggaaacccttctctcggctggctctcccccgccgcggcggcacttcgctctctcccggctactccggcttacgcgggaggcgggaggctagcgtgtggagttctcaaaacctgctgccacgaagatagacaaagcggagtaaaaactacaacggggaggaggctcgtggccctcgaccccctacgacccggccaccctctccgaccccccaacagctccgcccaacgacccaggtcttcatccacgcaaactaagagcctggatggaaaattccgaagacgcttccctcccccgggccacccggactggagcccccgaaacggcccgacgctaccaccggggtgggtcgggaccccactacaagtgcgaaataaggggccacccccacgcataacacgccccggggcccccttgggcggtaacgacataggctgggaaaagtgcgggtaaaagcctccttgaataattgaatataacactcgcaccgacacaaacccccaacgccgtgtgcgggatgacccaccaatcttttctaccactccctaggagcaaccgccctaccccccacaatccgaatctttgccggccaggcaagccataacaacaacacacgaccccccagataattagagaagatgacgagtacatgggatacggagagacagg

SEQ ID NO: 19177 - DNA, 676 bp, Zea mays
  misc_feature: Ceres CLONE 1386211-F
  misc_feature: Encodes the peptide sequence at SEQ ID NO. 19178
  misc_feature (293)..(293): n is a, c, t, g, unknown, or other
  misc_feature (485)..(485): n is a, c, t, g, unknown, or other
  misc_feature (510)..(510): n is a, c, t, g, unknown, or other
  misc_feature (543)..(543): n is a, c, t, g, unknown, or other
aaagctggagctccccgcggtggcggccgctctagaactagtggatcccccgggctgcaggaattcgcacgagaccattacctagaacatcctaatcgaaaagttctctctccctccccctttcctctggtcatcgcacccgtctccccgctctgactccgcccgcgccgccgactcccggcacggccccccaggcttcatctccgccgccgccgtcgccgccgcctcgctccgatcgacccccgaaacgccggaaaccgtgggcttcgcgaggttgcctctcttcgtccaangcggtagaaataacataacagtgcgacaggtgaattgcagagagaagggggggcatttggtcgctgcatgatggcggaaggccccaatttcgctggcatgattggtggccatgacaatggtggggatttctgcgacatggcatactaccggaagcttggtgagggctcaaacatgtcggtagacaccttaantaagatgcagaacagcacacatggntggctccattgcaatgtctgtggacaacagcancggaaggtcctgggactccaatactagatgctcaatcaccctggcctcaggggacctggccgtggaaataactcgggcgggggaacaggatttttcgccatggacgggtggctccccccctgaggaacaatgc

SEQ ID NO: 19178 - protein, 68 aa, Zea mays
  misc_feature: Ceres CLONE 1386211-F
  misc_feature (41)..(41): Xaa is any aa, unknown, or other
  misc_feature (60)..(60): Xaa is any aa, unknown, or other
MAEGPNFAGMIGGHDNGGDFCDMAYYRKLGEGSNMSVDTLXKMQNSTHGWLHCNVCGQQXRKVLGLQY

SEQ ID NO: 19179 - DNA, 690 bp, Zea mays
  misc_feature: Ceres CLONE 1386214-F
  misc_feature: Encodes the peptide sequence at SEQ ID NO. 19180
  misc_feature (460)..(460): n is a, c, t, g, unknown, or other
  misc_feature (462)..(462): n is a, c, t, g, unknown, or other
  misc_feature (465)..(465): n is a, c, t, g, unknown, or other
  misc_feature (474)..(474): n is a, c, t, g, unknown, or other
  misc_feature (482)..(482): n is a, c, t, g, unknown, or other
agagctggagctccccgcggtggcggccgctctagaactagtggatcccccgggctgcaggaattcgcacgagaccattacctagaacatcctaatcgaaaacccttggcttcgttccatccggcttctcggcggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacaaagaatgcaaaatttgtgcacgtccttttactgtattccggtggcgtcctgggcgagatgcaaggtacaagaagactgagatctgccagacatgttgcaagctaaagaatgtctgccaggtctgcctgctggatcttgaatatggtctgcctggtcaggtccgagatacagcactctctatcantnccnatgatgcanttccaggnagtgatgtcaatcggcgatattttgcagaagagcatgatagggagggccggagctggcatagactatggatccatcctatgggaaagctccgtcaaatgatacaattctggagctccggaggacggccccttattcccagagggacggagctccagggtggcggtttcttttgggcggggggatgggccaaaagggactgggtggccc

SEQ ID NO: 19180 - protein, 179 aa, Zea mays
  misc_feature: Ceres CLONE 1386214-F
  misc_feature (103)..(103): Xaa is any aa, unknown, or other
  misc_feature (104)..(104): Xaa is any aa, unknown, or other
  misc_feature (105)..(105): Xaa is any aa, unknown, or other
  misc_feature (108)..(108): Xaa is any aa, unknown, or other
MAHRLLRDAQADGWERSDFPIICESCLGDNPYVRMLRAEYDKECKICARPFTVFRWRPGRDARYKKTEICQTCCKLKNVCQVCLLDLEYGLPGQVRDTALSIXXXDAXPGSDVNRRYFAEEHDREGRSWHRLWIHPMGKLRQMIQFWSSGGRPLIPRGTELQGGGFFWAGGWAKRDWVA

SEQ ID NO: 19181 - DNA, 591 bp, Zea mays
  misc_feature: Ceres CLONE 1386216-F
  misc_feature: Encodes the peptide sequence at SEQ ID NO. 19182
  misc_feature (1)..(1): n is a, c, t, g, unknown, or other
  misc_feature (26)..(26): n is a, c, t, g, unknown, or other
  misc_feature (259)..(259): n is a, c, t, g, unknown, or other
  misc_feature (327)..(327): n is a, c, t, g, unknown, or other
  misc_feature (366)..(366): n is a, c, t, g, unknown, or other
  misc_feature (376)..(376): n is a, c, t, g, unknown, or other
nccgttaaagcaggctccccgcgggntgcgggaatacacacaacaccattgagctagaacatcctaatcgaaaaacatcgacccagccatctcctcaccctcgttcaccacacagtccggcactcctttagtagcttggggtttggacggcgacgagatcactggtcgggtggcggacgacgacacatggggaagggtagtgggggtgcatcatggtgggcgttcctcctgctcgccggcgtgctgctggtcgtagcanccacggccggggcggaggacggagtggtccaacgggaccgcaaggaggacctgcggtggtgcaaccangcgtgctagtggtattacggaaagggcgccgcggcgaanagggaatgcnagagcgagtggcgcgagcggcaccagcaagctgacgcgggcgaggacggcgacagcggcgtggacgcctacgtctcccgctcccgggaggggcgagtggccggccccagtgcctggccccccaccaggggccagcgtgggagaccccggagtgcatgaggcgggggccccgccccggactggccgtccacttgggacaacgagtaccgggccggg

SEQ ID NO: 19182 - protein, 49 aa, Zea mays
  misc_feature: Ceres CLONE 1386216-F
  misc_feature (25)..(25): Xaa is any aa, unknown, or other
  misc_feature (47)..(47): Xaa is any aa, unknown, or other
MGKGSGGASWWAFLLLAGVLLVVAXTAGAEDGVVQRDRKEDLRWCNXAC

SEQ ID NO: 19183 - DNA, 684 bp, Zea mays
  misc_feature: Ceres CLONE 1386220-F
  misc_feature (684)..(684): n is a, c, t, g, unknown, or other
aaagctggagctcccaccgcggtggcggccgctctataactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgctttcacccgtccgtcgcctctctctcggctgcctgattgatttggttgccccggttccagcaatggcggtccaggcgcattatcaccaccactaccacccgcgagtccccctttcctcgtcagggaacctgccgtgggccgctggtgcttcttcaaaacgcttcttcccgcgtcaatccgcaggcctgctggacccaattcgcaatgggggaattcaaaccccctcggtttgtcaagccgccccccccccaaaggcactacccggtttggtcgggtcggcccattggagacctccataccctcccggggggccaaaagagaggcgttttagggcgcccccaaaacagggggtaagaggcgccccccccccccctttccctggggaaacttttccccgccgtgggggggggaaatccccaatcaccaacacaaaaaggggcggcaccccctctgagccaccccgcgcagagaagaattatcccccccttcctttttggggagcaan

SEQ ID NO: 19184 - DNA, 686 bp, Zea mays
  misc_feature: Ceres CLONE 1386224-F
agagctggagctccccgcggtggcggccgctctagaactagtggatcccccgggctgcaggaattcgcacgagaccattacctagaacatcctaatcgaaaaaaatcttatagagtacttctattctcactttttttttatcacattctgcgaatgctacttgttgtcctttgaatctcagatccagcttctttctttgcctttgaacctcgaattcctgctaagccaaacaccaactatcgaagtcttgtcgcttgactcactacccgtggggaacagacttaatccaacgtacgggaagataatcctttactatctcctccataagatcaacatacgtgatgaacaactgatagttatccgacaggtctatatctccaaatcggagacgtggtgattcgcctcatttgtctgtgagaaagactacggacgcgcagtggctcttctgtctgttcaatataccataagtatcctatctaaggaatgatgaatcgagccacccttgctggctactgtaatgcgactggtaaacaccgtatggacaaaacaagcaagaagataattcgcagaaagaggactttagacttttacaaaaggcgtgctcctaaagggacacgtatctgttggattatgcacaagtaccgcactactaaccacaatcttgatagcattaattctgatcacta

SEQ ID NO: 19185 - DNA, 703 bp, Zea mays
  misc_feature: Ceres CLONE 1386226-F
  misc_feature: Encodes the peptide sequence at SEQ ID NO. 19186
  misc_feature (310)..(310): n is a, c, t, g, unknown, or other
  misc_feature (368)..(368): n is a, c, t, g, unknown, or other
aagctggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcangcgaagcagcacatgtgcacgttcgcgctgtacgcgcacgaccccaaaagcgcagtgnagacgcaccactacgtctcccgcctcaaacaggacttcctccagtgcgccgtctatgactccgaagagccggacggcggtttcatcgggggggagtacctcgggtccaggaaaatttccattcccctgcccggggaaaaacaacgggtttgggcctccccccccccccaaaatcaaattaggcttggggacaaaccccaccggggggggcttttttaaaaaagggaattttacccctggggccccctttttaaaatttttgggccccctggaggggaacccgggaacccccccgcccttggggcccccccctttttggggctcccccggccaccc

SEQ ID NO: 19186 - protein, 143 aa, Zea mays
  misc_feature: Ceres CLONE 1386226-F
  misc_feature (26)..(142): Pfam Name: DUF1264 Pfam Description: Protein of unknown function (DUF1264)
  misc_feature (52)..(52): Xaa is any aa, unknown, or other
  misc_feature (72)..(72): Xaa is any aa, unknown, or other
MASSDGKPLPTPASVGGGGGSSTAPPGQPTTVASKVLDMGAAAMQSLRPVKXAKQHMCTFALYAHDPKSAVXTHHYVSRLKQDFLQCAVYDSEEPDGGFIGGEYLGSRKISIPLPGEKQRVWASPPPQNQIRLGDKPHRGGLF

SEQ ID NO: 19187 - DNA, 697 bp, Zea mays
  misc_feature: Ceres CLONE 1386227-F
  misc_feature (388)..(388): n is a, c, t, g, unknown, or other
  misc_feature (396)..(396): n is a, c, t, g, unknown, or other
  misc_feature (398)..(398): n is a, c, t, g, unknown, or other
  misc_feature (404)..(404): n is a, c, t, g, unknown, or other
  misc_feature (405)..(405): n is a, c, t, g, unknown, or other
  misc_feature (409)..(409): n is a, c, t, g, unknown, or other
  misc_feature (443)..(443): n is a, c, t, g, unknown, or other
aagctggagctccccgcggtggcggccgctctagaactagtggatcccccgggctgcaggaattcgcacgagaccattacctagaacatcctaatcgaaaaaaaacgcagcgacctcgccccccctgccccgctcctccccttttcccggtagcagagacggagcaccgcagcccgccagaaaggaagacgaaacgcgccgcggcgcaacgcaccgcgtgctagtgaaagggcgcagcggaaggccgccgccgcgctgctatttagacaggaagcggggcgatcgaatcgcgtctctcaaccaatcgataaatctgccggtaggtcgatcaaggagagcgcggtccacgtctccgttccgttccgttgcggggaaggaagggaagagnagagagancnatggcnntccnggtaccgcgcggaggaggagtacgactacctggntcagggtggtgctgatcggggacagcggcgtggggaagtcaaacctgctggccgggttcgccaggaaccagttcagcctcgagacaggtccaccatcgggggcgaagtccccccaaagaccgccaggtcaaccacaaagttgtcaagggcacaaattgggaacccccccgggaaggaagggccccggcccttccagggggaataaaaccccggggggggggggccccttgtgggtgaacaacggagcaccccca

SEQ ID NO: 19188 - DNA, 654 bp, Zea mays
  misc_feature: Ceres CLONE 1386229-F
  misc_feature (259)..(259): n is a, c, t, g, unknown, or other
gctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtaacanccacggccggggcggaggacggagtggtcaaacggaaccgcagggaggactgcggtggtgcaagcaggcgtgcaagtggaataacgaaagggaccccccgcggaaaaaggaatggaaaaaccgagtgcccccaaagggcaccccacaagttgacccgggccgaagacggcaaacgggggcggtgggaacccttatttttcccgtgttccgggaagggggaagggccccgcccccttgtcttgtccccccccaaaaagggccccacgcgggggaaacaccccagaaggtgttttgtgggggggtgcccccccccccccggggaatgggtgcccccccccattggggaaaaaaaatatcccgggcccccccgcaaagaaaaaagcgggggggaaaaa

SEQ ID NO: 19189 - DNA, 643 bp, Zea mays
  misc_feature: Ceres CLONE 1386231-F
  misc_feature: Encodes the peptide sequence at SEQ ID NO. 19190
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtgggcgccaacggcgcgacgttctacttcctggtgttcagcatcctgggcggcgtggtgggcgcggcgtccgagctggcgggcgtgaacacgtgcgcggctggcgcccgacagcctggccacaacgccgggtctccctcatcgccggggccatcacgggcctcgccctcgg

SEQ ID NO: 19190 - protein, 100 aa, Zea mays
  misc_feature: Ceres CLONE 1386231-F
  misc_feature (14)..(100): Pfam Name: AWPM-19 Pfam Description: AWPM-19-like family
MAGIGRNMVAPLLVLNLIMYIIVIGFASWNLNHFINGQTNYPGVGANGATFYFLVFSILGGVVGAASELAGVNTCAAGARQPGHNAGSPSSPGPSRASPS

SEQ ID NO: 19191 - DNA, 664 bp, Zea mays
  misc_feature: Ceres CLONE 1386234-F
  misc_feature: Encodes the peptide sequence at SEQ ID NO. 19192
  misc_feature (662)..(662): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaattttctcgcgctcctaccgccgccgcttcgttctctaaccttggctcccgctccctccgcaggagcatctcaacaccgccttgagaaccccccaactcgccggctgcagccatggtaagatctccctcccccttactctctcgcctgttgcatcttcgctgccctgcagccatggatttggcgtcgcccttgcgaactcctgacgtgcaacgggccttgtttctggttccaggtgaaatattcgacggagccaaccaaccccaccaagtcaaccaaggccatgggccgtgacctacgtgttcacttcaagaacacccgtgagacagcttttgcccttaggaagttgtcactcaccaaggccaaaaggtaccttgaggatgtgattgcccacaagcaggccatcccgttccgcaggtattgtggcggtgttggacgtaccgctcaggctaagtctcgtcactcagatgggcagggacgctggcctgtcaaatctgctagattcattctagaccttctcaagaatgctgagagcaatgctgaggtaaaaggtcttgatgtcnan

SEQ ID NO: 19192 - protein, 93 aa, Zea mays
  misc_feature: Ceres CLONE 1386234-F
  misc_feature (1)..(94): Pfam Name: Ribosomal_L22 Pfam Description: Ribosomal protein L22p/L17e
MGRDLRVHFKNTRETAFALRKLSLTKAKRYLEDVIAHKQAIPFRRYCGGVGRTAQAKSRHSDGQGRWPVKSARFILDLLKNAESNAEVKGLDV

SEQ ID NO: 19193 - DNA, 685 bp, Zea mays
  misc_feature: Ceres CLONE 1386235-F
  misc_feature: Encodes the peptide sequence at SEQ ID NO. 19194
aagctggagctccccgcggtggcggccgctctagaactagtggatcccccgggctgcaggaattcgcacgagaccattacctagaacatcctaatcgaaaagtcacaaccaccgccaccgccacctcctcgcgcgggggcaactgtgaggtgagggcgaggcggggtgatgctggcgtggaaggagaaggtggcggaccgtctcgcccgcctcctcgccgactcccctgtctctccctcccctgctcaggccgccgtcgagccatcgcaggctaaatcttttccaccagaacattttactccccccaagacatcatcattatcttcgtatgtattttcccttctaccaacctcaaacaaggggcatgagcagaggtgggcgtggtcagagactttgagaccattacctcctgaatcacttcctaaaaaatggagatggaggtgatgtaacttggaaagttcctcccgtggaattgagtgaggagtctgggtctgaaagtgatagagatgaagggaatgggaattttggtaacgacccagtccttcagtcatatagggccataaataactcagatggcaatgaggaaacatcgacttcagattgtgtgggcactcttcggtatctaactgaagagtctatgtttgtgtctcccaaactatttggattctttcaatcttctctcccg

SEQ ID NO: 19194 - protein, 91 aa, Zea mays
  misc_feature: Ceres CLONE 1386235-F
MLAWKEKVADRLARLLADSPVSPSPAQAAVEPSQAKSFPPEHFTPPKTSSLSSYVFSLLPTSNKGHEQRWAWSETLRPLPPESLPKKWRWR

SEQ ID NO: 19195 - DNA, 753 bp, Zea mays
  misc_feature: Ceres CLONE 1386237-F
  misc_feature: Encodes the peptide sequence at SEQ ID NO. 19196
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nnnnnncccccccccccccccnnnnnccccggaaaaannnnnnnnnnaaggccagagctggagctccccgcggtggcggccgctctagaactagtggatcccccgggctgcaggaattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccctgccagggggggcggatcctgccgtcgtcggcagcgtcgcccgcccggttcctggggccaggggcgtcgaggttcctgaggcacccagtgcagccccgggcggcgacgcccctacgggctcgcccacaggggccaggggcgctgggggcgagcagggggtggccaccgagatccggggagggtgggagcccgcgtggcaccgggtaccaaggcgaacataacgcggggggggccctggcaggccctttccttggggcaggcaggccgcaggggggggaggctcccccggccccctgaagggccggcccccgaggaagggccgaagcacgctggcc

SEQ ID NO: 19196 - protein, 85 aa, Zea mays
  misc_feature: Ceres CLONE 1386237-F
MAIPHSTTAAKPLPGGADPAVVGSVARPVPGARGVEVPEAPSAAPGGDAPTGSPTGARGAGGEQGVATEIRGGWEPAWHRVPRRT

SEQ ID NO: 19197 - DNA, 674 bp, Zea mays
  misc_feature: Ceres CLONE 1386239-F
  misc_feature: Encodes the peptide sequence at SEQ ID NO. 19198
  misc_feature (272)..(272): n is a, c, t, g, unknown, or other
  misc_feature (327)..(327): n is a, c, t, g, unknown, or other
tggagctccccgcggtggcggccgctctagaactagtggatcccccgggctgcaggaattcgcacgagaccattacctagaacatcctaatcgaaaaaccagatctcgaggcagcggagtccggggacgccgttctttccgttgtgcttcctttgcctcttgctgccggtggccggtgattttcccgaggtctgtttgggcggcaggtagaggctattttcttggcggctggtgggatggatagccacgccgccgggtcgagctccggcggntccggggatggcggcgcgcagcccaggaggagctccaggaaacccacgtattccnagtttactcagcaggagcttccagcttgcaagccgattcttactcggggagtgggtatttcagtatccggttctgttggcgggatttttggctcgattgggattgtttcgctgcgagcttcacgacagggtggccagatcgttgatcggtatgaagatgcatgggcccctgctggggggactgacaacttggtaattccggaatggtagtatacccaaaggctgcccagggaatctggcgttaaccaggggattggggcgccccgattttggggattttcggggtggggggcttttaccaaatctttggggggttttcccagggcccaaaggggtgccccttaaaag

SEQ ID NO: 19198 - protein, 99 aa, Zea mays
  misc_feature: Ceres CLONE 1386239-F
  misc_feature (31)..(31): Xaa is any aa, unknown, or other
MDSHAAGSSSGGSGDGGAQPRRSSRKPTYSXFTQQELPACKPILTRGVGISVSGSVGGIFGSIGIVSLRASRQGGQIVDRYEDAWAPAGGTDNLVIPEW

SEQ ID NO: 19199 - DNA, 623 bp, Zea mays
  misc_feature: Ceres CLONE 1386240-F
  misc_feature: Encodes the peptide sequence at SEQ ID NO. 19200
  misc_feature (239)..(239): n is a, c, t, g, unknown, or other
  misc_feature (249)..(249): n is a, c, t, g, unknown, or other
  misc_feature (366)..(366): n is a, c, t, g, unknown, or other
aaagctggagctccccgcggtggcggccgctctagaactagtggatcccccgggctgcaggaattcgcacgagaccattacctagaacatcctaatcgaaaatctgcgctccgaataccccagacccccgatcctcccaatggccaccgcattttcgctgcgcgctgcggccccggccaccgctccccgcgccgtctcccgatccacctccgcggcgagggtcgtgcccgtggcctcgngcactggcgnggacgcggaaggcttggtggcgcgtgcagcagttacagcaaaggcggatgtaccatcgagcacgtccgacgggcatgaggtcttgctgtttgaagctcttcgtgagggccttaatgnaaaacatggaattaggaggggggcggggttttttaatttgggtggagaaagttggcccattaccggggggtcctaacaaggggacaaaagggttgggtggaaacctttgggaaactttcgaggtcctggaaccccctattgcggaaaaaaacccctttaatggatagtggaaatttgaaaggggaaaaggaaagggggttgaagccccccccccctttaaaagggctgggagaaagggggaatcccccgtggctccc

SEQ ID NO: 19200 - protein, 100 aa, Zea mays
  misc_feature: Ceres CLONE 1386240-F
  misc_feature (34)..(34): Xaa is any aa, unknown, or other
  misc_feature (37)..(37): Xaa is any aa, unknown, or other
  misc_feature (76)..(76): Xaa is any aa, unknown, or other
MATAFSLRAAAPATAPRAVSRSTSAARVVPVASXTGXDAEGLVARAAVTAKADVPSSTSDGHEVLLFEALREGLNXKHGIRRGAGFFNLGGESWPITGGS

SEQ ID NO: 19201 - DNA, 678 bp, Zea mays
  misc_feature: Ceres CLONE 1386241-F
  misc_feature: Translation starting site: 445
  misc_feature: Pfam Name: Sina Pfam Description: Seven in absentia protein family
aaagctggagctccccgcggtggcggccgctctagaactagtggatcccccgggctgcaggaattcgcacgagaccattacctagaacatcctaatcgaaaaattcgcccgttcgaattctctcgcctcgacctcctcctcacctgcctgctcggctgctcgccagaccaaccacagccgtcggcgctgcagagcgcggcgggcaggatcagcggtgcgtagtctgcccatttcgcgaggaccatataattccaagaccctgatgatggccacaactgcttatatcgatgattcctgttcggaggttattgatcccccgaagactgaggtgctggatgttgctgaactccctggtgaccatactcacaacccacgcgggggcggggggttgtggtgtctagcagtgtccgtgaacttctggaatgtccagtctgtttgagtgccatgtatcctcctattcatcagtgctctaatggtcatacattgtgttccggatgcaaaccaagggttcataatcgttgtccaacttgtaggcatgaactgggtaacataaggtggcttgctctcgagaagggggctgcatctcttgaacttccatgcaagtaccaggtgctttggggtgcccaggcatttatccttactacagcaagctggagcatgagtcgcagtgccaatata

SEQ ID NO: 19202 - DNA, 677 bp, Zea mays
  misc_feature: Ceres CLONE 1386242-F
  misc_feature: Translation starting site: 212
  misc_feature (362)..(362): n is a, c, t, g, unknown, or other
tggagctccccgcggtggcggccgctctagaactagtggatcccccgggctgcaggaattcgcacgagaccattacctagaacatcctaatcgaaaaacttcattcggtttccggatagcttacctcacatcgacggtcggtgagccgttcgtgagtggcgaggcagtgcgtgcgctgcagcctgcagggcaagaacaggcgacgaagaagatgagcacgctggacacgcggacgctcaaggacgagctgacgagcatggacaggaagtgcctcgtggaccttggccacccgctgctcaaccgcgtcgccgacagcttcatccgcgccgccggggtcggggcggccagggccgtctccaggnaggcctacggcgggggcggcgaagggctttcaggagactcgtccgggctggacgccgacggcggcaagcggagccatttctccagcatcagaggtgacgacggccagaggtcgctcgacgcagtggtaaaaacggccggcaaggaggcttcccaggtgggggttggcagccggagtctactctgggctcacgtacgcgctgcgggaggccaggggatgccacgactggaagaacgccgccatcgcaggcgcagtcgttgggggcggcggtagcgctcacgggtggacgccggcggccactccgagcagctcgtca

SEQ ID NO: 19203 - DNA, 615 bp, Zea mays
  misc_feature: Ceres CLONE 1386243-F
  misc_feature: Encodes the peptide sequence at SEQ ID NO. 19204
  misc_feature (457)..(457): n is a, c, t, g, unknown, or other
aaagctggagctccccgcggtggcggccgctctagaactagtggatcccccgggctgcaggaattcgcacgagaccattacctagaacatcctaatcgaaaaaaaaaacaatattatctcaaagctaaccaacaatggcgttcccaaaggtgttcttcgacataaacatcaacggccaggcagcgggaaggatcgtgatggagttgtatacggataagacgccgaagacggctgagaatttcagagctctgtgcactggagagaagggagtggggcgtaagggaaagcccctccacttcaagggatcttccttccaccgagtgatccccagtttcatgtgccagggaggtgatttcaccgcgggaaacgggacaggaggtgagtccatctacggtgataagttcgaggacgagaactttgagaggaagcacacgggtcctggcaacctttccatggncgacggcggagccaacaccaacggatctcagttcttcatctgcaccgtaaaaaccgattggcttgacggtaagcacgtggtgttcgggcaggtggtgaaaggttaaacgtggtgaaggccatccagaagtgggatcgtcgtcttgaaagccgtccagg

SEQ ID NO: 19204 - protein, 142 aa, Zea mays
  misc_feature: Ceres CLONE 1386243-F
  misc_feature (5)..(142): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
  misc_feature (108)..(108): Xaa is any aa, unknown, or other
MAFPKVFFDININGQAAGRIVMELYTDKTPKTAENFRALCTGEKGVGRKGKPLHFKGSSFHRVIPSFMCQGGDFTAGNGTGGESIYGDKFEDENFERKHTGPGNLSMXDGGANTNGSQFFICTVKTDWLDGKHVVFGQVVKG

SEQ ID NO: 19205 - DNA, 686 bp, Zea mays
  misc_feature: Ceres CLONE 1386245-F
  misc_feature: Encodes the peptide sequence at SEQ ID NO. 19206
  misc_feature (299)..(299): n is a, c, t, g, unknown, or other
  misc_feature (421)..(421): n is a, c, t, g, unknown, or other
aagctggagctccccgcggtggcggccgctctagaactagtggatcccccgggctgcaggaattcgcacgagaccattacctagaacatcctaatcgaaaaaaaaagtacccaagctgaaaggacaacacttgcagagttctgcctctcggtctcggaacctcactccttcctctcctagtccccagcttcaccgaggcatacggtataccataccggcaccggcaccggcagcgagcagtcgggagccatggctccgccgctcctgctcttcctcctcctcctccccctcctcacggncctcgctgacggacaccagcacctgtcctcctacggctcctccgcgctctccgattggcgccccgccaaggcatcctaggagggggccgaccccgaagacgccatcgggtggggcgtgcggnttcggggatctggggaaacacggctacgggatggcgacggtggggctgagcacggcgctgtttgagcggggcgcggcgtgcggcggctgctacgaggtcaagtgcgtcgagggcctcaagtactgcctccccgggacctccatcgtcggcacggaaacccaacttctgcgcccccagactacgggcttcccggcggaccgcggggggcactgggacccccccaaccaccattttcctcctcccccatccagtggtttggaggaga

SEQ ID NO: 19206 - protein, 78 aa, Zea mays
  misc_feature: Ceres CLONE 1386245-F
MATVGLSTALFERGAACGGCYEVKCVEGLKYCLPGTSIVGTETQLLRPQTTGFPADRGGHWDPPNHHFPPPPSSGLEE

SEQ ID NO: 19207 - DNA, 809 bp, Zea mays
  misc_feature: Ceres CLONE 1386251-F
  misc_feature (300)..(300): n is a, c, t, g, unknown, or other
  misc_feature (311)..(311): n is a, c, t, g, unknown, or other
  misc_feature (320)..(320): n is a, c, t, g, unknown, or other
aaagctggagctccccgcggtggcggccgctctagaactaagtggatcccccgggctgcaggaattcgcacgagaccattacctagaacatcctaatcgaaaaacgcagcagcgacgcgacgcccccgccccgcgtcttctactcttcttcatcttcactgctcaccaacccatccatcccccagtcctcctcactgctcacccgtctcccatccccacaccaccaccaccaccatcttccggtcttcccctccccacacccggcgggatccccaccatccccgccccccgatggagctngtcgcgcgcgncaaggtggntgcggctcaagaagccacacggacagttccctgtacgcgacgagggaccagcgcacgtgacccaagagcgggacgggtcgtccgccaaccgcgcgttgggcccgtggaacccggccccccaaaaaccgggggggccatccgcctgcggagccggaaaagcccactaccctccccgccttcggggaaacccctttcttgtttgggaataaccggcccccaaagggaaaacaaaaaagggcccccgccgcccccccccccccaaaaaattttttgggaaattggaaaccccgggggggaaaattttttaaaagcgcgccccccccccagaggggggcccccccttcctccccccccaaaggggggcgtcccccccccgggaaaaacactcccccccccaaagggtgccccaccccccccccccccagaggaggtggtgtttttgtgaaacaaaagaggtttctcatttttctcccggggggcgggcgcgac

SEQ ID NO: 19208 - DNA, 694 bp, Zea mays
  misc_feature: Ceres CLONE 1386255-F
  misc_feature: Encodes the peptide sequence at SEQ ID NO. 19209
  misc_feature (444)..(444): n is a, c, t, g, unknown, or other
  misc_feature (445)..(445): n is a, c, t, g, unknown, or other
  misc_feature (520)..(520): n is a, c, t, g, unknown, or other
  misc_feature (628)..(628): n is a, c, t, g, unknown, or other
  misc_feature (638)..(638): n is a, c, t, g, unknown, or other
aaagctggagctccccgcggtggcggccgctctagaactagtggatcccccgggctgcaggaattcgcacgagaccattacctagaacatcataatcgaaaatcggccctccccgcggaataaaagctttttctctggcctcccttcctccgaatccatccatccatccatctattgtctcccttccaattcgatgcctttgtagcgctgctgcctcgccgcgtcgtcgcgggtccccgatttccgcttgctgctgcgcttccaacaccatggacggcgggggatccggcaatgcctccggcggcagcggcggcgcatcgacgtgctgctactacgcgctcctcggcatccgcaagaacgcctccgccaccgacatacgcgccgcttaccggaggctcgcgatgaagtggcacccggaccggtgggccagcgaccccggcgcgnncggcgaggccaatcagcggttccagcggatccaggaggcatactccgttctgtcggacaagggggaagaaggccnatgtacgacgcccgggctcttcgacccccctcgacgacgacgaacagaagccggacaacgctggaggacctgcaaaagaatgctggaggacatcgtgaagggccacgncggggcgggnaaaaacgggaaaaagggggcgggggcccccaaaggaaggggtgctccaaggaacgc

SEQ ID NO: 19209 - protein, 141 aa, Zea mays
  misc_feature: Ceres CLONE 1386255-F
  misc_feature (20)..(84): Pfam Name: DnaJ Pfam Description: DnaJ domain
  misc_feature (59)..(59): Xaa is any aa, unknown, or other
  misc_feature (84)..(84): Xaa is any aa, unknown, or other
  misc_feature (120)..(120): Xaa is any aa, unknown, or other
MDGGGSGNASGGSGGASTCCYYALLGIRKNASATDIRAAYRRLAMKWHPDRWASDPGAXGEANQRFQRIQEAYSVLSDKGEEGXCTTPGLFDPPRRRRTEAGQRWRTCKRMLEDIVKGHXGAGKNGKKGAGAPKGRGAPRN

SEQ ID NO: 19210 - DNA, 695 bp, Zea mays
  misc_feature: Ceres CLONE 1386256-F
  misc_feature (375)..(375): n is a, c, t, g, unknown, or other
  misc_feature (380)..(380): n is a, c, t, g, unknown, or other
  misc_feature (381)..(381): n is a, c, t, g, unknown, or other
  misc_feature (393)..(393): n is a, c, t, g, unknown, or other
  misc_feature (395)..(395): n is a, c, t, g, unknown, or other
  misc_feature (398)..(398): n is a, c, t, g, unknown, or other
  misc_feature (424)..(424): n is a, c, t, g, unknown, or other
  misc_feature (589)..(589): n is a, c, t, g, unknown, or other
aaagctggagctccccgcggtggcggccgctctagaactagtggatcccccgggctgcaggaattcgcacgagaccattacctagaacatcctaatcgaaaaaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacacaaacccgcgttggatcctgtatcggttagtccttgccttcaggntcatnngtgtttgttttngnggncgagcatcgcatggtctgcttctggntcagatctggagaattttctagtcgtcgtcgtcgtcgtcgttcggtttcgagccgatctgaagcgacgatggctggagggcgcgaatctctgggtctgcagccctgtttcactcgatggatgaggctctggcctgaaaattatggatcatttccattatttttanaaattctttgaaattgccccctgaaaagaggaaggaaccttcacatggaaaacttgcggccccaccgcaaaaaaagaaaaaaatggcctcctaaaggggctttccg

SEQ ID NO: 19211 - DNA, 738 bp, Zea mays
  misc_feature: Ceres CLONE 1386258-F
  misc_feature (516)..(516): n is a, c, t, g, unknown, or other
  misc_feature (548)..(548): n is a, c, t, g, unknown, or other
  misc_feature (551)..(551): n is a, c, t, g, unknown, or other
  misc_feature (559)..(559): n is a, c, t, g, unknown, or other
  misc_feature (581)..(581): n is a, c, t, g, unknown, or other
aaagctggagctccccgcggtggcggccgctctagaactagtggatcccccgggcttgcaggatttcgcacgagaccattaccttaaacatcctaatcgaaaacctagccaccgcatcgtcgccctcaaattcgttccgtccaggcaaggaagaaatcgagcagccaaggagaggagaagatggctcgtacgaagcagaaccgcccgcaagtccaccggaggcaaggccccgcgcaagcagcttcgccaccaaggcggcgaggaagtcggcgccgacgaccggcggcgtgaagaagccccacaggtacaggcccgggacggtggcgctgcgcgagatccgcaagtaccagaagagcacggagctgctgatccggaagttgcccttccagcgcctggtccgtgagatcgctcaggacttcaagacggatctgcggttccagagccacgccgtcctgcccctccagggaagccgcgaggcctacctcgtcggcctgttcgaggacaccaacctctgcngcatccacgcaaagcgcgtcaccatcatgccnaangacatccngctcgcccgccgcatccgcggngagcgcgcgtaggcgtatctcgcgcccggccccagtggcggcgaaggaatggaggagtgcatttgtaactttatgctggttgtcgcttttagacggcgcgcgaagagtagtgtaaaaacgcttacagtctattttggcggtagtcgtgaagcgctcc

SEQ ID NO: 19212 - DNA, 675 bp, Zea mays
  misc_feature: Ceres CLONE 1386262-F
  misc_feature: Encodes the peptide sequence at SEQ ID NO. 19213
aaagctggagctccccgcggtggcggccgctctagaactagtggatcccccgggctgcaggaattcgcacgagaccattacctagaacatcctaatcgaaaaaccactctctccactgtgactccgtgacctgcctgccctgctgcacaagcacagcacacacaccccgcacaccgcaccagctcagcgcagctcaccaagacaatcaatcatggctcacccgcgcagtgtcgctgccgctgcccccctcctcctgctgctcgccgccgccgccgccgccgcagcggggctcgtgtccgccgcgtcgccggcagccagcgacttcgtccgcaagtcgtgccgcacgacgcagtacccgtcggtgtgcgagcagagcctggcgtcgtacggcggatcgccgccgccgcggagcccgcgggagctggcgcgcgccgcgctgtcggtgagcgcggaccgcgcgcgcgccgcgtcagaatacgtgggccgcctgtgcgtcgccagcaacgagaaaggcgcgaagaaggggtcgtgatcggcgtccgcgtcggcgtctccaggtcccgtgcgcgactgcctgaacaatctggcggacagcgtgggccacctccgcgacgcgtcgcaggagatggtcggcgccgttatgggccgcgcgggatacaccggcgttcaggtgga

SEQ ID NO: 19213 - protein, 106 aa, Zea mays
  misc_feature: Ceres CLONE 1386262-F
MAHPRSVAAAAPLLLLLAAAAAAAAGLVSAASPAASDFVRKSCRTTQYPSVCEQSLASYGGSPPPRSPRELARAALSVSADRARAASEYVGRLCVASNEKGAKKGS

SEQ ID NO: 19214 - DNA, 608 bp, Zea mays
  misc_feature: Ceres CLONE 1386264-F
  misc_feature: Encodes the peptide sequence at SEQ ID NO. 19215
  misc_feature (416)..(416): n is a, c, t, g, unknown, or other
  misc_feature (429)..(429): n is a, c, t, g, unknown, or other
aaagctggagctccaccgcggtggcggccgctctagaactagtggatcccccgggctgcaggaattcgcacgagaccattacctagaacatcctaatcgaaaaagcgacaccgcgtggttcgttaggaaaggaaatcgatccccatctgatctcttcggtgctaaagaaatataggccgccgccgcctcctcattcggtgaaaggtgggcggttagggttgggagatctcttgactcacgacacgagcagcagaatttgtcgagggccgctggttgctgcgagaggtccgtaccttcgtgggatcttgaaaattgaatggtctaatggagtccaagggtggcaagaagaagtctagcagtagtcggtcctccctgatgtacgaagctccccttggctacagcatcggagatatccngcctgcaggcggnatcaggaaagtctccgctgcttactcaaactgcgcgagggaagcatcctgaaatctctgtcggcatcccctcctaggaagggaaaaaccacctgctttttcattttgattcccctaaaccctccggtaaggttgttttccggggccaaaaaaatttcgaagccatttccggttttcccc

SEQ ID NO: 19215 - protein, 51 aa, Zea mays
  misc_feature: Ceres CLONE 1386264-F
  misc_feature (1)..(51): Pfam Name: AdoMetDC_leader Pfam Description: S-adenosyl-l-methionine decarboxylase leader peptide
  misc_feature (31)..(31): Xaa is any aa, unknown, or other
MESKGGKKKSSSSRSSLMYEAPLGYSIGDIXPAGGIRKVSAAYSNCAREAS

SEQ ID NO: 19216 - DNA, 565 bp, Zea mays
  misc_feature: Ceres CLONE 1386268-F
  misc_feature: Encodes the peptide sequence at SEQ ID NO. 19217
  misc_feature (261)..(261): n is a, c, t, g, unknown, or other
  misc_feature (401)..(401): n is a, c, t, g, unknown, or other
agagctggagctccccgcggtggcggccgctctagaactagtggatcccccgggctgcaggaattcgcacgagaccattacctagaacatcctaatcgaaaattcccctccctgcctcctcgtctcctcggtctcccctccctgtcttccagagacacagagcagggcgctcttcggtcggaggagaagcgcgaccacgaccatgggctttatctcgttcgtcggccgggttctcttcgcctccctcttcctcctctcggnctaccaagagttcattgaatttggaaatgacggtggacctgcagcgaagaccttgaagccaaagttcaatttgttcgtcaagctagtgtccagaatatggactggggctgccgcataggggataaaaactgtcattgganctaccatggtttcttaaagggtttgggggggcctttcggttcctaggcaggggggtccattgggggggtttcccccccggggaagcacccaagggattgggttttttcccggccaggcttaaaggggcttggggggaaaaaaaactaagggggggttaaagggg

SEQ ID NO: 19217 - protein, 58 aa, Zea mays
  misc_feature: Ceres CLONE 1386268-F
  misc_feature (1)..(56): Pfam Name: HR_lesion Pfam Description: HR-like lesion-inducing
  misc_feature (20)..(20): Xaa is any aa, unknown, or other
MGFISFVGRVLFASLFLLSXYQEFIEFGNDGGPAAKTLKPKFNLFVKLVSRIWTGAAA

SEQ ID NO: 19218 - DNA, 671 bp, Zea mays
  misc_feature: Ceres CLONE 1386273-F
  misc_feature: Encodes the peptide sequence at SEQ ID NO. 19219
aaagctggagctccccgcggtggcggccgctctagaactagtggatcccccgggctgcaggaattcgcacgagaccattacctagaacatcctaatcgaaaagaaaatatacgtcagaataaaccgcagcaaatcttctccggcaccggcagcgcccaaatccggcaatccgctgctccgaatggactcaggttacaatccccggacggtggaggaggtgttccgggacttcaagggccgtcgtgccgggataatccgcgcgctcaccactgatgcggaggatttcttcaagcaatgcgacccggaaaaagaaaacttgtgcctgtatgggtttcctaatgagagctgggaagtaaatttgcctgctgaagagggggcggctgacctcccagaaccagcattaggcataaactttgcaagagatggaatgcaggaaaaagagtggttgtccatggttgctgcacacagggatgcatggttactttctgttgcattttacttcggtgctcgattcggtttcaataaaatgacaggaagcgcctctacagtttgattgatgatctttccatggcttttgaaatggtagggggaagagtgaaacaagggcaccagcacacccagcagtagtaaccacggcatatccaagcgaaatctaacacagaaagaaggcc

SEQ ID NO: 19219 - protein, 123 aa, Zea mays
  misc_feature: Ceres CLONE 1386273-F
MDSGYNPRTVEEVFRDFKGRRAGIIRALTTDAEDFFKQCDPEKENLCLYGFPNESWEVNLPAEEGAADLPEPALGINFARDGMQEKEWLSMVAAHRDAWLLSVAFYFGARFGFNKMTGSASTV

SEQ ID NO: 19220 - DNA, 699 bp, Zea mays
  misc_feature: Ceres CLONE 1386274-F
  misc_feature (446)..(446): n is a, c, t, g, unknown, or other
  misc_feature (469)..(469): n is a, c, t, g, unknown, or other
  misc_feature (507)..(507): n is a, c, t, g, unknown, or other
  misc_feature (532)..(532): n is a, c, t, g, unknown, or other
agagctggagctccccgcggtggcggccgctctagaactagtggatcccccgggctgcaggaattcgcacgagaccattacctagaacatcctaatcgaaaaacctagcgcagcgaagccggcacaatgccagccgccgccgtagtctcccctctcctcctctcgctctcctcgtcctcctcccccttcctctcttcctcatccacctcctttttcccaccctcctccgctgccgtcactccacacgccgccgtcaggacgagggcggctgtctccgtcctccgcgcgctgcgcgccgaggcggccaccctccccgtgctctcattcaccggagagaaggtcggggaggtaaccctcgacctcaaatccgcgccaccctccaccgcgcgcgctgtcgtgcaccgcgctatcatcaccgaccgccagaacgcgcgccgagggacggnctccacgctcacccgcggcaggntcagaggcggagggaggaagccctatcagcaaaagaanaacgggaaaggccccgggcgggggntcccagcgtaccccgtgccgttcccggggggggggggggtcggggttcgggccccagggcccggggactgggcccatcaaggatcaaccggcaaggaagaaggccgctttgccaatctccacttggccatcggtgaggcgccggccaggaagaccccttccccttgg

SEQ ID NO: 19221 - DNA, 612 bp, Zea mays
  misc_feature: Ceres CLONE 1386275-F
  misc_feature: Encodes the peptide sequence at SEQ ID NO. 19222
  misc_feature (448)..(448): n is a, c, t, g, unknown, or other
  misc_feature (451)..(451): n is a, c, t, g, unknown, or other
  misc_feature (452)..(452): n is a, c, t, g, unknown, or other
  misc_feature (571)..(571): n is a, c, t, g, unknown, or other
caaagctggagctccaccgcggtggcggccgctctagaactagtggatcccccgggctgcaggaattcgcacgagaccattacctagaacatcctaatcgaaaaatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaggaaggtgaagagcagcaaacaggcggcggcggccaaaagtgacgtacagtacgtgtggagtgtaatggagcttccatgcatgagtgaatcatggcatggtatgaatctagccctccnttnnctgatctccaggggaccgggcgtgggcgtcccctcctggggggatgatgcccgaatgataaccacaaattagaacgttggtgggaaaaaaaaaaaaaaaaaagctttatcataccgccnaacccccgggggggggggcccggaaccaatttcccccataa

SEQ ID NO: 19222 - protein, 51 aa, Zea mays
  misc_feature: Ceres CLONE 1386275-F
MASLKAAKPSGVAAQGKEPAPKLSETATKPSAAKSGGVKKAEQKPRETKGR

SEQ ID NO: 19223 - DNA, 755 bp, Zea mays
  misc_feature: Ceres CLONE 1386276-F
  misc_feature: Encodes the peptide sequence at SEQ ID NO. 19224
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (40)..(40): n is a, c, t, g, unknown, or other
  misc_feature (53)..(53): n is a, c, t, g, unknown, or other
nccccccccnnnnnnnnnnnnnaaacccacccggacaacncggggcgggattntttttcaaagctggagctccaccgcggtggcggccgctctagaactagtggatcccccggggctgcaggaattcgcacgagaccattacctagaacatcctaatcgaaaactacgagattattttgaaatttcgacgagatttgtcggaacaatgcgactccacttcagcagtgcgcagcaagccgccgccgccatttcgaaactcccgatcgccgaccggtgctttctttcccctcagcctcgccacttcagagagagagagagagagagaagagagagagagagagagagctaacgatggcgtccaggagacgcgggcagcagccccaaatcagcgccgcgtcgccatgggccggcggcgcccaagaatggcgccgacctgctcagcccacgggttccggtcggctgccgcgctggccggctgggacgaggagtccgtcctccttgccgcgatggtcggcgacgacaccccaagtccgcggactcccggcggaagagggggggctccacctcctccgtcggggggagggccggatccaggaccaggaaaaggaggccgcgcaagctgtctccggccaaaatccccgccgggtggttttccgcgctcggcgacgaaagaggtcggagcgctgcggggagatagcaaatcgcgaaagggaaggcccgccaagggagggaggaagaagcctggtgcttggggg

SEQ ID NO: 19224 - protein, 111 aa, Zea mays
  misc_feature: Ceres CLONE 1386276-F
MAPTCSAHGFRSAAALAGWDEESVLLAAMVGDDTPSPRTPGGRGGAPPPPSGGGPDPGPGKGGRASCLRPKSPPGGFPRSATKEVGALRGDSKSRKGRPAKGGRKKPGAWG

SEQ ID NO: 19225 - DNA, 733 bp, Zea mays
  misc_feature: Ceres CLONE 1386277-F
  misc_feature: Encodes the peptide sequence at SEQ ID NO. 19226
  misc_feature (529)..(529): n is a, c, t, g, unknown, or other
  misc_feature (536)..(536): n is a, c, t, g, unknown, or other
  misc_feature (560)..(560): n is a, c, t, g, unknown, or other
  misc_feature (653)..(653): n is a, c, t, g, unknown, or other
  misc_feature (684)..(684): n is a, c, t, g, unknown, or other
aaagctggagctccccgcggtggcggccgctctagaactagtggatcccccgggctgcaggaattcgcacgagaccattacctagaacatcctaatcgaaaaccgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacgggcaaggagctggacggccgcaacatcaccgtcaacgaggcccagtcccgcggcggccgtggaggcggcggcggtgggttacacggtggtggcccgtggaggcggggcttacggncggtggncggcgccgtggatggcggtgcggnctaaccgcggtggcggcggctacggtggcgcggcggttaacggggggggggtgggcggggcttacggcggtggcaaccgtggccggcgctacngcaactccgacggggactggagggacttgancggtggggcccgcgcgccaagttatctggtcggctaccgggatgttacc

SEQ ID NO: 19226 - protein, 159 aa, Zea mays
  misc_feature: Ceres CLONE 1386277-F
  misc_feature (10)..(80): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (109)..(109): Xaa is any aa, unknown, or other
MAASDVEYRCFVGGLAWATDDHSLHNAFSTYGEVLESKIILDRETQRSRGFGFVTFSTEEAMRNAIEGMNGQGAGRPQHHRQRGPVPRRPWRRRRWVTRWWPVEAGLTXGGRRRGWRCGLTAVAAATVARRLTGGGWAGLTAVATVAGATATPTGTGGT

SEQ ID NO: 19227 - DNA, 647 bp, Zea mays
  misc_feature: Ceres CLONE 1386279-F
  misc_feature: Translation starting site: 246
  misc_feature: SWISSPROT Homolog: EC 5.5.1.4 Inositol-3-phosphate synthase
  misc_feature (228)..(228): n is a, c, t, g, unknown, or other
  misc_feature (269)..(269): n is a, c, t, g, unknown, or other
  misc_feature (283)..(283): n is a, c, t, g, unknown, or other
  misc_feature (333)..(333): n is a, c, t, g, unknown, or other
aaagctggagctccccgcggtggcggccgctctagaactagtggatcccccgggctgcaggaattcgcacgagaccattacctagaacatcctaatcgaaaaacacggtccacacagcccaacaaaggagcgcggcggcccctccttccttcctcccacttctctcgcgcggcgctcgcttacctcgcctcgcattccgttcgagcaggggagcggcagtgagaaggnaaggaattaaaggcaggatgtcatcgagagcttccgcgtcnagagccccacgtgncgtacggccggacggagatcgagtcggagtaccggtacgacacgaacganctggtgccgaggcccagggacgcccctccccgctgggccgggcgggccaaggtccgtaaggtaaaatttcgggacaagaacgcggggcccacaagtttggggtattgcgttgggggggggggagggaaaaaaggggcccccggtgagggggggggcctttgcccacgggggggggttttcttgggggcccaagggaaggggggaaaaagccatataaaagggtcccccaccccggtttccccccctaaggaagggccttccaggggggagaaaatttggccgctttaaaagccccccacctggggggaacccag

SEQ ID NO: 19228 - DNA, 689 bp, Zea mays
  misc_feature: Ceres CLONE 1386285-F
  misc_feature: Encodes the peptide sequence at SEQ ID NO. 19229
  misc_feature (370)..(370): n is a, c, t, g, unknown, or other
  misc_feature (390)..(390): n is a, c, t, g, unknown, or other
  misc_feature (536)..(536): n is a, c, t, g, unknown, or other
  misc_feature (615)..(615): n is a, c, t, g, unknown, or other
aaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtgntggacctctcggtgacgcgncgcgaggacctagtcgagcaggtgaggcacgcggccgggacggtgggcttcttctggctggtgaaccacggagtgccggaggagctgatgggcggcatgctccgcggggtgcgccagttcacgagggcccccgtggaagggcgaancaggcgcttctactcgagggacctcgctcgcaagctggcgcttcgcctccaacttcgacctctttcaggctgctgcggncgactggcgcacacgctccttctgcgagggtggctccgaacccgccgccggggggaggagctggcggaggcacc

SEQ ID NO: 19229 - protein, 180 aa, Zea mays
  misc_feature: Ceres CLONE 1386285-F
  misc_feature: SWISSPROT Homolog: EC 1.14.11.20 Desacetoxyvindoline 4-hydroxylase
  misc_feature (75)..(75): Xaa is any aa, unknown, or other
  misc_feature (130)..(130): Xaa is any aa, unknown, or other
MAPTTATKDDSGYGDERRRELQAFDDTKLGVKGLVDSGVKSIPSIFHHPPEALSDIISPAPLPPSPPSGAAIPVXDLSVTRREDLVEQVRHAAGTVGFFWLVNHGVPEELMGGMLRGVRQFTRAPVEGRXRRFYSRDLARKLALRLQLRPLSGCCGRLAHTLLLRGWLRTRRRGEELAEA

SEQ ID NO: 19230 - DNA, 694 bp, Zea mays
  misc_feature: Ceres CLONE 1386286-F
  misc_feature: Encodes the peptide sequence at SEQ ID NO. 19231
agagctggagctccccgcggtggcggccgctctagaactagtggatcccccgggctgcaggaattcgcacgagaccattacctagaacatcctaatcaaaaactttcggatcagctcagtcactggctttaaatagagaggcagccgagctggacgtctttttgtaggttcttcttggcacttggcaacggcgacattcaccactgtcgcgtcgacctttcgtgaccatcccagtcccattcttgcccttgttaattcggtccaggacttgagacacatgagcggggtactcgggcagaggccgtcgcggccgtggccgccgggggacgccgcgtccacgccgccgtcggagcccgccacagccggcgcggacgcgggcgcgaggggcgaggcgtccgcgctcagggacctgggcacgtccatggacgccatctccttcgggttcgcgggcacggccatcctcatctcggtctttctcctcatggccatcttcgagcacctcatcaaggcccgggcctttcccgcccgactccccccaacgacgggggcagccctggccgcacgctgaaccggcttgaacgggccgcctctccccctggggaaagttcccgagccccgcccattggtggaaggccctgctttcaagggggcgggaacctggccggggcttgatagcccgggcaggcggtaacca

SEQ ID NO: 19231 - protein, 96 aa, Zea mays
  misc_feature: Ceres CLONE 1386286-F
MSGVLGQRPSRPWPPGDAASTPPSEPATAGADAGARGEASALRDLGTSMDAISFGFAGTAILISVFLLMAIFEHLIKARAFPARLPPTTGAALAAR

SEQ ID NO: 19232 - DNA, 659 bp, Zea mays
  misc_feature: Ceres CLONE 1386290-F
  misc_feature: Encodes the peptide sequence at SEQ ID NO. 19233
gagggaattcgcacgagaccattacctagaacatcctaatcgaaaaacaccgcagacgcacgcacgaacgcgctcccaccccctcccgccgcaaacgccgccaaaaccccggcccgactcggcgtcctccgccaacctcctcctgggcagcgccggcggggggatatggcatcggaggacgtggtgggcaagagcaggggcgacacgggcgtcaccaccatcgtcaacctggcggaggaggccaagctcgcgcgcgagggggtcaaggcgcccggccaccagatcctcaccatctgcaagtcgctcgtcgccggggggggggggaggcgggagtgtctcctactgctggttgctccacttggaggattgaaaatattggcttcaggttcaaaatccggacggcatcggggagcagggggactggttcagggggctcaagtatatctgggaggacgggaggggcctccgggggactttgtcagggggcgatggtgaccaagttggcgagggattgggtcccgaattctggccggggaaggttttttagagtagggagggggggggcagaggggaatggctgggggggctaccgggcaaaaggagtggggggaaggaggaatggtcagcgttacgtcggggctttggcgccttggaggggg

SEQ ID NO: 19233 - protein, 109 aa, Zea mays
  misc_feature: Ceres CLONE 1386290-F
MASEDVVGKSRGDTGVTTIVNLAEEAKLAREGVKAPGHQILTICKSLVAGGGGRRECLLLLVAPLGGLKILASGSKSGRHRGAGGLVQGAQVYLGGREGPPGDFVRGRW

SEQ ID NO: 19234 - DNA, 739 bp, Zea mays
  misc_feature: Ceres CLONE 1386292-F
  misc_feature: Encodes the peptide sequence at SEQ ID NO. 19235
  misc_feature (600)..(600): n is a, c, t, g, unknown, or other
  misc_feature (631)..(631): n is a, c, t, g, unknown, or other
  misc_feature (632)..(632): n is a, c, t, g, unknown, or other
  misc_feature (635)..(635): n is a, c, t, g, unknown, or other
  misc_feature (636)..(636): n is a, c, t, g, unknown, or other
  misc_feature (701)..(701): n is a, c, t, g, unknown, or other
  misc_feature (702)..(702): n is a, c, t, g, unknown, or other
  misc_feature (705)..(705): n is a, c, t, g, unknown, or other
  misc_feature (710)..(710): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
aaagctggagctccccgcggtggcggccgctctagaactagtggatcccccgggctgcaggaattcgcacgagaccattacctagaacatcataatcgaaaatcggccctccccgcggaataaaagctttttctctggcctcccttcctccgaatccatccatccatccatctattgtctcccttccaattcgatgcctttgtagcgctgctgcctcgccgcgtcgtcgcgggtccccgatttccgcttgctgctgcgcttccaacaccatggacggcgggggatccggcaatgcctccggcggcagcggcggcgcatcgacgtgctgctactacgcgctcctcggcatccgcaagaacgcctccgccaccgacatacgcgccgcttaccggaggctcgcgatgaagtggcacccggaccggtgggccagcgaccccggcgcggccggcgaggccaatcagcggttccagcggatccaggaggcatactccgttctgtcggacaaggggaagaaggccatgtacgacgccgggctcttcgaccccctcgacgacgacgaccagaagccggacacgctggaggacctgcagaagatgctgnaggacatcgtgaaggggcgacggcgggcggnnaanncgggccaaggcggcgggcgccccaaggacgggtgcttcaacgggacccgcgttgcgccctaccgnnagncgcanggtggggggaaacgggggnnnnnnnnnnn

SEQ ID NO: 19235 - protein, 153 aa, Zea mays
  misc_feature: Ceres CLONE 1386292-F
  misc_feature (20)..(86): Pfam Name: DnaJ Pfam Description: DnaJ domain
  misc_feature (111)..(111): Xaa is any aa, unknown, or other
  misc_feature (121)..(121): Xaa is any aa, unknown, or other
  misc_feature (122)..(122): Xaa is any aa, unknown, or other
  misc_feature (123)..(123): Xaa is any aa, unknown, or other
  misc_feature (145)..(145): Xaa is any aa, unknown, or other
  misc_feature (146)..(146): Xaa is any aa, unknown, or other
  misc_feature (147)..(147): Xaa is any aa, unknown, or other
MDGGGSGNASGGSGGASTCCYYALLGIRKNASATDIRAAYRRLAMKWHPDRWASDPGAAGEANQRFQRIQEAYSVLSDKGKKAMYDAGLFDPLDDDDQKPDTLEDLQKMLXDIVKGRRRAXXXGQGGGRPKDGCFNGTRVAPYRXXXGGGKRG

SEQ ID NO: 19236 - DNA, 739 bp, Zea mays
  misc_feature: Ceres CLONE 1386293-F
  misc_feature: Encodes the peptide sequence at SEQ ID NO. 19237
  misc_feature (542)..(542): n is a, c, t, g, unknown, or other
aagctggagctccccgcggtggcggccgctctagaactagtggatcccccgggctgcaggaattcgcacgagaccattacctagaacatcctaatcgaaaaattcctcggagagggagaagccgccgccgcagcaatcacagcagcccggagaaagcccaggtccgacaagatgcagatcttcgtgaagacgctgacagggaagaccatcaccctcgaggtcgagagcagcgacaccatcgacaatgtcaaggccaagatccaggacaagaaagggatcccgccggaccagcagcggctgatctttgcccggaagcagctggaggatggccgcccccttgcggactataacatccaaaaggagtctacgcttcacctcgtgcttaggctccgcggtggcatcattgagccctcgctgcaggcgctcgctcgcaagtacaaccaggacaagatgatctgcccgcaaatgctatgcacgactgccccctagggctgtcaactgcccgcaaggaaaaagtgtgctcacagcacccagctgagggncaaaaaaaaatcaagaactgaggtgctgctcctaaccattttcaggaacaatgttgggctgaattggtggggggatggtgaaaccggtttgttacccacatttggggcctcctggttggtttaccctggcggccatggcccaatactttttgggaatagcaacttgggttttgggagtttgggccctggtcaaaaaa

SEQ ID NO: 19237 - protein, 105 aa, Zea mays
  misc_feature: Ceres CLONE 1386293-F
  misc_feature (6)..(74): Pfam Name: ubiquitin Pfam Description: Ubiquitin family
MQIFVKTLTGKTITLEVESSDTIDNVKAKIQDKKGIPPDQQRLIFARKQLEDGRPLADYNIQKESTLHLVLRLRGGIIEPSLQALARKYNQDKMICPQMLCTTAP

SEQ ID NO: 19238 - DNA, 694 bp, Zea mays
  misc_feature: Ceres CLONE 1386294-F
  misc_feature (422)..(422): n is a, c, t, g, unknown, or other
  misc_feature (490)..(490): n is a, c, t, g, unknown, or other
caaagctggagctccccgcggtggcggccgctctagaactagtggatcccccgggctgcaggaattcgcacgagaaccatttaacctaagaacattcctaatcgaaaaaaagaagaggtgccctagcttccctcccaatcccaccaggccgccgccaccacatcgcgccctcgcccgcttgccgccgaccctaaccggctgagcccctgaccagcttcgtccaggcggacagcggcctgcggcaagccagcgcccagccaacagcgactgcctgactggtgagaggtgcgcatggtatggccggcctgatcagcttgcgcgccggtccgaggagttcaccgtcacttgccccggtcgtcgtccgcctgggcatcaccatcaccggcttcacaggtgggcggttcgtttgcccagcccactgntttcgctgtgccaaaacttcctaggagccgtaagtctactggcagcagcactggaaatctctaaggancgtttccccgggggttctggcaaaaggctgctttcccaaggggtttcgaaacctgccggatgcccatgcaatattgtttcaagtttaacagcccgtcttcctgaacaaggcatttccaagttttttatttttcgggggggggaaaaaattttttctaaatggacttcaaaagccttaaacggactttttccctttttgggaggc

SEQ ID NO: 19239 - DNA, 742 bp, Zea mays
  misc_feature: Ceres CLONE 1386295-F
  misc_feature: Translation starting site: 174
  misc_feature: Pfam Name: Methyltransf_11 Pfam Description: Methyltransferase domain
  misc_feature (399)..(399): n is a, c, t, g, unknown, or other
  misc_feature (438)..(438): n is a, c, t, g, unknown, or other
aaagctggagctccccgcggtggcggccgctctagaactagtggatcccccgggctgcaggaattcgcacgagaccattacctagaacatcctaatcgaaaaagtcccaggagcgtggcctcactctcctcgtcgcatcccccctcctcatcttcgcagcgcgggcggcggcaatggcgatggcctccacctacgcgccgggcggaggcgcgcgggcgctcgcgcagggtagatgcagggtccgcggtcccgcggggctgggcttcctcggcccctccaaggccgccggcctcccccgccccctcgccctcgccagggggatgagcagccccgtcgcggtgggcgccaggctgcgatgcgcggcgtcgtcgtcccccgcggcggtgcgggccgccacgncgccgcgcttcatccagcacaagaaggaggccttctggntctacccgcttctctccatcgtgtacgaccacgtcatcaatccgggccactggaccgaggacatgcgcgacgacgcgctggaaccctgcgacctctttcagccgcacctcacggtcgtcgacgtcggcggcggaacggggtcaccacgctcggcatcgtcaagcacgtcaaccgggaggacgtcacgctggtcgaccagtccccgcaccagctcgacaaggcccggaagaaggaggccctcaaggggtcaacatcatggagggggacgcggaggacttcccgttcccaccgattccttcgacga

SEQ ID NO: 19240 - DNA, 740 bp, Zea mays
  misc_feature: Ceres CLONE 1386300-F
  misc_feature: Encodes the peptide sequence at SEQ ID NO. 19241
  misc_feature (481)..(481): n is a, c, t, g, unknown, or other
  misc_feature (498)..(498): n is a, c, t, g, unknown, or other
  misc_feature (621)..(621): n is a, c, t, g, unknown, or other
  misc_feature (638)..(638): n is a, c, t, g, unknown, or other
  misc_feature (654)..(654): n is a, c, t, g, unknown, or other
  misc_feature (705)..(705): n is a, c, t, g, unknown, or other
aaagctggagctccccgcggtggcggccgctctagaacaagtggatcccccgggctgcaggaattcgcacgagaccattacctaaaacatcctaatcgaaaagaagccagagaaaaggttactccgcagaaagcaaaaccctagcccactccggcgcgccaccggccgatggtttcgatgagcaccacgccgaagccgcttgactccgccgtcgtcagcgcagccgttgacggcggggatgagggtggtggtggaggcggtggcggaaagaagcaggcgcacggggcggtgatggcgccgccaccgatggtggtcccggccgcggcgcccgcggccgaggaggaggttcggaaggtcaggaagccgtacaccatcaccaagtcgcgggagagctggacggagccggagcacgacaagttcctcgaggccctgcagctttttgatcgtgattggaagaaaattgaagcatatgttggctcanagactgttatacagatnaggagccatgcacagaagtacttcctgaaggtcagaagaatggtacgggcgagcatctgcccccacccaggccaaaacgaaaggcagctcatccatatccacagaagcatctaaaaatgtttnctcagctattttatcancagaacacctaccagnaggggaagcaaggttctgtcatgcctatgaatactgctactgtgagaaacnaatgcgaaaatgttggcggtgctttcctgggacaa

SEQ ID NO: 19241 - protein, 147 aa, Zea mays
  misc_feature: Ceres CLONE 1386300-F
  misc_feature (73)..(118): Pfam Name: Myb_DNA-binding Pfam Description: Myb-like DNA-binding domain
  misc_feature (105)..(105): Xaa is any aa, unknown, or other
  misc_feature (110)..(110): Xaa is any aa, unknown, or other
MVSMSTTPKPLDSAVVSAAVDGGDEGGGGGGGGKKQAHGAVMAPPPMVVPAAAPAAEEEVRKVRKPYTITKSRESWTEPEHDKFLEALQLFDRDWKKIEAYVGSXTVIQXRSHAQKYFLKVRRMVRASICPHPGQNERQLIHIHRSI

SEQ ID NO: 19242 - DNA, 733 bp, Zea mays
  misc_feature: Ceres CLONE 1386302-F
  misc_feature: Encodes the peptide sequence at SEQ ID NO. 19243
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (23)..(23): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (39)..(39): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (68)..(68): n is a, c, t, g, unknown, or other
nnnnnnnnnnccccccccccccngctnnnnnnnnggggnaanannnatnnnnnnnnncccaagctggngctccaccgcggtggcggccgctctagaactagtggatcccccgggctgcaggaattcgcacgagaccattacctagaacatcctaatcgaaaaaccctacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctggggagcacgtcccccgtgctgtttttggtgaccttgagcccactgtcatcgatggagggagggactggaaccctaccggccggctcttccatcccggagcaggctcatcagggggcaaggagggatggagcccaacaaattttccgttcgggggcccctaacccccattggggaaaggaggattggtggaaccttggggcccttggacccggcttccagggaaagctttgggcaaaaataaattggccccgtgggcccctcccaggg

SEQ ID NO: 19243 - protein, 111 aa, Zea mays
  misc_feature: Ceres CLONE 1386302-F
MRECISIHIGQAGIQVGNACWELYCLEHGIQADGQMPGDKTIGGGDDAFNTFFSETGAGEHVPRAVFGDLEPTVIDGGRDWNPTGRLFHPGAGSSGGKEGWSPTNFPFGGP

SEQ ID NO: 19244 - DNA, 738 bp, Zea mays
  misc_feature: Ceres CLONE 1386303-F
  misc_feature: Translation starting site: 247
  misc_feature (630)..(630): n is a, c, t, g, unknown, or other
aagctggagctccccgcggtggcggccgctctagaactagtggatcccccgcgctgcaggaattctcacgaaaccattacctaccaaatcctaatcgaataacacttattaccttcctaatttctattattgcatttcacgtcagttgctaaatatcctcaaccttctcgcttaagttttgacgacgctcccttgaggacccatcgatggcctccttgaagaaccactgtgccgtggtggcagcagatgaactgtggatctgcttcatcggcctcgccgccgccctcccttcgcatgcttctacgcccggtggacgagtcggcgaagtatacccccagcagggcgccagcgccgtcccctgcatctgcatcatcatcctacgtcccgccgccggtccagcccgtgatcgtcgtccagggcgtcatctactgccccccctgcaagatcaaagggctacaacagcggcatggacgcgtcccctctccccaatgcgacggcgagcctggtgtgctacggcgacccccacagacatccccgcctgctgaaccagacgagcacggccaccgacacgaacggctacttcatcgtgatgcccgtacgacagaggccctgttcgacctgcgcaggtgnacgctgtactccgtttcttccccccgaagggatattatgaaacgaagacctttcatcccgtcaaaaccccgaagctggggcttcacccctcgtgaggaggacccgcgc

SEQ ID NO: 19245 - DNA, 714 bp, Zea mays
  misc_feature: Ceres CLONE 1386304-F
  misc_feature: Encodes the peptide sequence at SEQ ID NO. 19246
  misc_feature (383)..(383): n is a, c, t, g, unknown, or other
  misc_feature (415)..(415): n is a, c, t, g, unknown, or other
  misc_feature (443)..(443): n is a, c, t, g, unknown, or other
  misc_feature (470)..(470): n is a, c, t, g, unknown, or other
aaagctggagctccccgcggtggcggccgctctagaactagtggatcccccgggctgcaggaattcgcacgagaccattacctagaacatcctaatcgaaaaattccttccattttacccctccgtccgtctctcacactgtctctctccaccctctcgctctccgacaaggcgacgacgggtaggccaccgccgccggcgccgtcccactacgacaactgctgaggccttcatcgctttcttcgccggcgacgagcacccaccaactaaggtcatggaagagatgatagatctaacgggggatggaggtgttcttaagacagtagtgcggaaagcaaaagatgatgctatagcgccatccgagagcctgcccttggttgatngtcattacgaaggtacacttgctgagactggntgagttttcgataccacccatgaagatnactctattttctcatttgaaatgggancaggcgctgtcatcaaagcatgggatataggcttaagaactatgaagggttggcgagggtgcaaaaattacatgcaaatcaaaatatgcatatgggagctgcaggcttaccaccaggagaaccttcctaatgcaccccttatttttggaggggaagttaataactttgcagggccgaggaaggttccaggctttaagtagggaacctgaaggaaaaacgccacatttggaaacctttaaaaaga

SEQ ID NO: 19246 - protein, 47 aa, Zea mays
  misc_feature: Ceres CLONE 1386304-F
  misc_feature (37)..(37): Xaa is any aa, unknown, or other
MEEMIDLTGDGGVLKTVVRKAKDDAIAPSESLPLVDXHYEGTLAETG

SEQ ID NO: 19247 - DNA, 680 bp, Zea mays
  misc_feature: Ceres CLONE 1386305-F
  misc_feature: Encodes the peptide sequence at SEQ ID NO. 19248
aaagctggagctccccgcggtggcggccgctctagaactagtggatcccccgggctgcaggaattcgcacgagaccattacctagaacatcctaatcgaaaaaccttccgtcccccggcctccgctcgcctctctctttctctctcctcgctgagtcgccgccagccatgaacaacctcctcacggattcctttgagctcccccggcgggactcctcaagagatgcagacattgaaatgggaatgcatcaagctgatgcttcagactacttaaaagatttcttgaagaaggtcgatgcaattgagagtttaattgcaaagctgacaaatctattgaataagctacagactgcaaatgaggaatccaaagcagttacaaaagcaagttccatgaaagcaattaagcagcggatggagaaagatattgatgaagtggggaaaattgctcgtcaggcgaagaccaaaagtgatgaattggaaaaggacacttatcaataagcaaaaacctggatggtgaaaagggtctgccgtggaccgatcaggaaagcaactactggagcagggaaaaaaaattgaaagagcggatggatgactttcaaacctggagaaagcatcaggcagagtattccggaggttgttaaaaaaaggtttttaagggaaagggaaacccccctgagaaaa

SEQ ID NO: 19248 - protein, 109 aa, Zea mays
  misc_feature: Ceres CLONE 1386305-F
MNNLLTDSFELPRRDSSRDADIEMGMHQADASDYLKDFLKKVDAIESLIAKLTNLLNKLQTANEESKAVTKASSMKAIKQRMEKDIDEVGKIARQAKTKSDELEKDTYQ

SEQ ID NO: 19249 - DNA, 624 bp, Zea mays
  misc_feature: Ceres CLONE 1386307-F
  misc_feature: Encodes the peptide sequence at SEQ ID NO. 19250
  misc_feature (463)..(463): n is a, c, t, g, unknown, or other
  misc_feature (546)..(546): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaaatctagtcatctcgtctcaggttgcggccgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctgcttacaatgtgccccagaggtcatatcatgggatgaatggcactgctggactctcatctgtcatggcaccatctcctgtcntttgcttctgccccaaaagagaaaggcttttctgggattatgatcgactttatgatgggtggagtttctgctgctgcctcaanacgtgctcatgaggagttatcacatagcaggtacagtctgcatgcannnnnnnnnnnnnnnnnnnnnnnnnnnnnnnn

SEQ ID NO: 19250 - protein, 98 aa, Zea mays
  misc_feature: Ceres CLONE 1386307-F
  misc_feature (68)..(68): Xaa is any aa, unknown, or other
  misc_feature (95)..(95): Xaa is any aa, unknown, or other
MADELRSTSVGQKFHGQSVLLSRISSYSAMNNPVFNNAYSAYNVPQRSYHGMNGTAGLSSVMAPSPVXCFCPKRERLFWDYDRLYDGWSFCCCLXTCS

SEQ ID NO: 19251 - DNA, 724 bp, Zea mays
  misc_feature: Ceres CLONE 1386309-F
  misc_feature: Encodes the peptide sequence at SEQ ID NO. 19252
  misc_feature (413)..(413): n is a, c, t, g, unknown, or other
  misc_feature (447)..(447): n is a, c, t, g, unknown, or other
  misc_feature (550)..(550): n is a, c, t, g, unknown, or other
  misc_feature (551)..(551): n is a, c, t, g, unknown, or other
  misc_feature (634)..(634): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacggnctgccgctggtgcacccgcacagcatgctggtgntgaccatcaacggcaccggcatgctcatccagctcacctacgtggcgctcttcatctctgctccggcggggcggtgcgcccgcagggtcgtgctcctgtccgnnccgcgaggtcgccttcgtcgtcgccttggccgcgctggtgctcaccttggcgcaacgcacgagcgcaggtcatgctcgtcggnatcgtctccgtcttcttcggnaccggatgtacgctggccgctctcgtcatgaaaattgtgatccagacaagaggcgtgatactggccctt

SEQ ID NO: 19252 - protein, 151 aa, Zea mays
  misc_feature: Ceres CLONE 1386309-F
  misc_feature (9)..(98): Pfam Name: MtN3_slv Pfam Description: MtN3/saliva family
  misc_feature (73)..(73): Xaa is any aa, unknown, or other
  misc_feature (107)..(107): Xaa is any aa, unknown, or other
  misc_feature (135)..(135): Xaa is any aa, unknown, or other
  misc_feature (142)..(142): Xaa is any aa, unknown, or other
MVSADTIRTAIGVIGNGTALVLFLSPVPTFVGIWKKRAVEQYSPIPYVATLLNCMMWVLYGLPLVHPHSMLVXTINGTGMLIQLTYVALFISAPAGRCARRVVLLSXPRGRLRRRLGRAGAHLGATHERRSCSSXSSPSSSXPDVRWPLSS

SEQ ID NO: 19253 - DNA, 691 bp, Zea mays
  misc_feature: Ceres CLONE 1386313-F
  misc_feature: Translation starting site: 180
  misc_feature: SWISSPROT Homolog: EC 3.6.3.14 H(+)-transporting two-sector ATPase
  misc_feature (443)..(443): n is a, c, t, g, unknown, or other
  misc_feature (608)..(608): n is a, c, t, g, unknown, or other
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaaccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgtctacgcctccgccgccgcggcccaggcggagcccgccaccccgccgccagccaccggggaggacggggggcggtaagatcaccgacgagttcaccggcgccggcgccatcagccaggtgtgccaggnggatcgggccgtcgccgacgtgcgctacgagggaggccctcccgcccatcctcccggaggctcgaggggctcgacaaccaacatccgcctcgtgttaaagggggtgaagcaccttgaagaaaaaaatggggccccgcccttcccttgggccggcatggggggggnttcgcccccgggnaggcggggcccccctaacccggtggttcccacataacgggtggcgtggttggaaagccctttccccttgg

SEQ ID NO: 19254 - DNA, 699 bp, Zea mays
  misc_feature: Ceres CLONE 1386321-F
  misc_feature: Encodes the peptide sequence at SEQ ID NO. 19255
  misc_feature (409)..(409): n is a, c, t, g, unknown, or other
  misc_feature (435)..(435): n is a, c, t, g, unknown, or other
  misc_feature (502)..(502): n is a, c, t, g, unknown, or other
acaagctggagctccccgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggaccctcagtgcctgtgcggctacnagaactcgccgtggatgggcgtctancacatcgaccccagcgcgccatggagctttccggcaggtgcgcctcgcacgccggccgactggtagnagggtgcctagccaggccaacccaaggaggaaggcccccggaattggttacttgacgggcctggggggcatttgcacaagggtgggggaggggccccaaacaaaggggcccttttccctctcattttgccccggacctattaaaagggggggggccgaaaaaaaaaaagggttttgtggccccctcgggggatgagg

SEQ ID NO: 19255 - protein, 114 aa, Zea mays
  misc_feature: Ceres CLONE 1386321-F
  misc_feature (85)..(85): Xaa is any aa, unknown, or other
  misc_feature (93)..(93): Xaa is any aa, unknown, or other
MAATSSKSSSSSSSAQRAAAALLVAAAVAVSVLVVGAAAVCDMSNEQFMSCQPAAAKTTDPPAAPSQACCDALAGADPQCLCGYXNSPWMGVXHIDPSAPWSFPAGAPRTPADW

SEQ ID NO: 19256 - DNA, 718 bp, Zea mays
  misc_feature: Ceres CLONE 1386323-F
  misc_feature (401)..(401): n is a, c, t, g, unknown, or other
  misc_feature (431)..(431): n is a, c, t, g, unknown, or other
  misc_feature (471)..(471): n is a, c, t, g, unknown, or other
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaaactcctgttcttagacgtttctccagagcctgaagccaaatctagggggcttgcttcatctgctgtccgagcgtggtttggtttctcggggctggcgcggtcaagagctcacctgagttccaccgaaatctgccacggtagttcttgcctaggtgtgtcgttgcgttgtgacccttgcggattttcttgtttcttttgagttgcgatctttgcaggttagtctcccccccaatccgtagtcatccggcgtctaggaaattgcagtccagtttgcttatttgttcgtctagtggcttctcnacatcctggttagaaagaatatcggaaggngggatttttttttttttgcctgttcgtagacggagcagtngagacataattgttgcatctgataaagctcgggcgaaatacaagcaaatccttgcaatttgcatccctttgctggctctttttctgatcacagacccaatgggggatgtgtccttgaatgtacccgtnatggcgagcccactggccggtggattgccagggggaaccgagtctggacacgatggccgcccggtggaccgacgagagcacatgctgttataagctccatgaggcttctttcgtcgacc

SEQ ID NO: 19257 - DNA, 631 bp, Zea mays
  misc_feature: Ceres CLONE 1386331-F
  misc_feature (119)..(119): n is a, c, t, g, unknown, or other
  misc_feature (252)..(252): n is a, c, t, g, unknown, or other
  misc_feature (273)..(273): n is a, c, t, g, unknown, or other
  misc_feature (322)..(322): n is a, c, t, g, unknown, or other
  misc_feature (587)..(587): n is a, c, t, g, unknown, or other
aaagtggagctccccgcggtggcggccgctctagaactagtggatcccccgggctgcaggaattcgcacgagaccattacctagaacatcctaatcgaaaactcgagcacctgcagcgnccgccagacactttccgtagtctgtaccccaagcaccggcgcggcggcggcggctaccatggcagtcgggaagaacaagaggatctccaagggaaagaagggtggtaagaaaaagaccgtcgatcccttctcntagaaggactggtatgacatncaggccccatcggtcttcagtgtgcgcaacattgggaagactctcgtgntcaggacacagggtacccagattgcctctgatggtctgaagcacagagtctttgaggtttgtctagctgatcttcagggggacgaggatcaggcttacgggaaaaatcaggctcccgggcttaaaaatgggccaaggcaggaaatgggcctcccaaactttcgggggggatggaattttttccccccggaaaaggtccaaaattcctttgaaaaaaaaaggggggcaaaattttggttttgaagcccccctgtgtttgttgtttnaaaaagaagcccgaaaaaatttaaagggggggggggtgttgttt

SEQ ID NO: 19258 - DNA, 685 bp, Zea mays
  misc_feature: Ceres CLONE 1386336-F
  misc_feature: Encodes the peptide sequence at SEQ ID NO. 19259
  misc_feature (479)..(479): n is a, c, t, g, unknown, or other
  misc_feature (611)..(611): n is a, c, t, g, unknown, or other
  misc_feature (653)..(653): n is a, c, t, g, unknown, or other
aagctggagctccccgcggtggcggccgctctagaactagtggatcccccgggctgcaggaattcgcacgagaccattacctagaacatcctaatcgaaaaacggccacgttcacgcttcccccttctgcaagcaaacctaaccaagcctctgcggctcttcttcgaatccaactcctccccgatccccaaaatcgaacccaagtcgaaaccctaacctcggccttctcgatgtcggccgccacaaccgccccaacccctgcggtggccaccccgatggcgccgcctccgtcgtacccggcctcctccacgatctccgcctccgtggccgcgtcggtcgaggaagaggacgacctctatggccgcctcaagtcgctccagcgccacatggagttcgtcgagatccaggaggagtacgttaaagacgaacagaagaacctcaagcgcgaactcctccgtgcgcaggaggaggtcaagcgnatccagtccgtaccgctcgtcattggccagtttatggagatggtcgacggcaacaacggcatcgtgggttctactacgggcagcaactactatgtgcgggatctcagcacatcaaccgcgagctgctcaagncggcagaatctgtcgcggtgcatcgtcactccaggctttaancgaaggggtggccgccggaggcgaatcagaat

SEQ ID NO: 19259 - protein, 151 aa, Zea mays
  misc_feature: Ceres CLONE 1386336-F
  misc_feature (127)..(127): Xaa is any aa, unknown, or other
  misc_feature (141)..(141): Xaa is any aa, unknown, or other
MSAATTAPTPAVATPMAPPPSYPASSTISASVAASVEEEDDLYGRLKSLQRHMEFVEIQEEYVKDEQKNLKRELLRAQEEVKRIQSVPLVIGQFMEMVDGNNGIVGSTTGSNYYVRDLSTSTASCSXRQNLSRCIVTPGFXRRGGRRRRIR

SEQ ID NO: 19260 - DNA, 685 bp, Zea mays
  misc_feature: Ceres CLONE 1386340-F
  misc_feature: Encodes the peptide sequence at SEQ ID NO. 19261
  misc_feature (555)..(555): n is a, c, t, g, unknown, or other
  misc_feature (617)..(617): n is a, c, t, g, unknown, or other
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaaacctgcggcgttggcagcaccccgatcctgagccagntgcgtcgagtttctgaggcatcagtgcagccccgacggcgacgccctactgctcgcctcaantggncagtcgttgcggcaagcagtgttgccagcagctcaggcaaggtggagccgcaacactggtacca

SEQ ID NO: 19261 - protein, 132 aa, Zea mays
  misc_feature: Ceres CLONE 1386340-F
  misc_feature (128)..(128): Xaa is any aa, unknown, or other
MRVLLVALALLALAASATSTHTSGGCGCQPPPPVHLPPPVHLPPPVHLPPPVHLPPPVHLPPPVHLPPPVHVPPPVHLPPPPCHYPTQPPRPQPHPQPHPCPCQQPHPSPCQLQGNLRRWQHPDPEPXASSF

SEQ ID NO: 19262 - DNA, 680 bp, Zea mays
  misc_feature: Ceres CLONE 1386341-F
  misc_feature: Encodes the peptide sequence at SEQ ID NO. 19263
  misc_feature (393)..(393): n is a, c, t, g, unknown, or other
  misc_feature (434)..(434): n is a, c, t, g, unknown, or other
  misc_feature (481)..(481): n is a, c, t, g, unknown, or other
agagctggagctccccgcggtggcggccgctctagaactagtggatcccccgggctgcaggaattcgcacgagaccattacctagaacatcctaatcgaaaaagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggatggnaagagcgagtgccgcgagcggcaccagcaagctgacgcggngcgaggacggcgaccagcggcgtggacgcctacgtctcccgctcggnaaggggggcgagtgccggcgccagtgcctgcgccgccacgagggccagccgtgggagacccaggagtggatgaggcggtgcccgcgccgcgggactggccgtcgacatgtagggaagagtacggtcgcggcagcgagagcgcgggcagtggccgggagaggtgcgagcccaccaccgcggggacgggggggagaggcag

SEQ ID NO: 19263 - protein, 158 aa, Zea mays
  misc_feature: Ceres CLONE 1386341-F
  misc_feature (77)..(77): Xaa is any aa, unknown, or other
  misc_feature (93)..(93): Xaa is any aa, unknown, or other
MGKGSVGASWWAFLLLAGVLLVVAATAGAEDGVVERDRKEDLRWCKQACEWQYGKDTPRKRDGKSECRERHQQADAXRGRRPAAWTPTSPARXGGRVPAPVPAPPRGPAVGDPGVDEAVPAPRDWPSTCREEYGRGSESAGSGRERCEPTTAGTGGRG

SEQ ID NO: 19264 - DNA, 750 bp, Zea mays
  misc_feature: Ceres CLONE 1386343-F
  misc_feature: Encodes the peptide sequence at SEQ ID NO. 19265
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (26)..(26): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
nnncccccccccnnccccnnaccggnaannngnnnntttggnnnnnnnccaaagctggagctccaccgcggtggcggccgctctagaatagtggatcccccgggctgcaggaattcgcacgagaccattacctagaacatcctaatcgaaaaagatcatcgtccgtccaatccatccattcatctacacacgcagttgcagcacatacagctagctagctcgttactgtttttgcagctgatctgatcgaccgacgcgacccaccgatcacgatcatgagctaccaagcgggctacccaccgccgggccaacaggcctacggcgcgcctccgccggcgtacgtcgcgccaccgccggcgtacccgccaacggcccaggacgggggcgcggcgtactacggccagcagcagacaaccaccaccagcaggaggcgcggcggcgacggtttctggaaaggatgctgcgccgccatctgctggtgctgcggcctcgacatgtgcttctgaggacatatcgtcgatcgatcgacgacggccagggcatgctagctagctgatgaccggccgggtacgtgcggggttgatggtcaacatcatggcgctgctcctagaagctggctgggtcattatatattaccccttcgggtattacgttatataggtattacgggacgtacttcggacggtcttcgagattcattgccggggggttaattgtatttatacatatggcagggacacctttgggacc

SEQ ID NO: 19265 - protein, 76 aa, Zea mays
  misc_feature: Ceres CLONE 1386343-F
MSYQAGYPPPGQQAYGAPPPAYVAPPPAYPPTAQDGGAAYYGQQQTTTTSRRRGGDGFWKGCCAAICWCCGLDMCF

SEQ ID NO: 19266 - DNA, 694 bp, Zea mays
  misc_feature: Ceres CLONE 1386344-F
  misc_feature: Encodes the peptide sequence at SEQ ID NO. 19267
  misc_feature (520)..(520): n is a, c, t, g, unknown, or other
  misc_feature (609)..(609): n is a, c, t, g, unknown, or other
  misc_feature (640)..(640): n is a, c, t, g, unknown, or other
caaagctggagctccccgcggtggcggccgctctagaactagtggatcccccgggctgcaggaattcgcacgagaccattacctagaacatcctaatcgaaaaatcttccaagtcaccaacgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccagacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccggctgcccgcggaagntgcaaaaaggggattcgccgccaccctcgtcacgggaggccgagtgcaacctgtccaccatccagcgggggtcgccgaatgcccctggnatcctccggcggcggaacgatgccctccagntaactgcgaagagcatagtggcatgagggaatgagcttgtagctagcttcatat

SEQ ID NO: 19267 - protein, 156 aa, Zea mays
  misc_feature: Ceres CLONE 1386344-F
  misc_feature (34)..(135): Pfam Name: Tryp_alpha_amyl Pfam Description: Protease inhibitor/seed storage/LTP family
  misc_feature (117)..(117): Xaa is any aa, unknown, or other
  misc_feature (147)..(147): Xaa is any aa, unknown, or other
MASSSSSSHRRLILAAAVLLSVLAAASASAGTSCVPGWAIPHNPLPSCRWYVTSQTCGIGPRLPWPELKRRCCRELADIPAYCRCTALSILMDGAIPPGPDAQLEGRLEDLPAARGXCKKGIRRHPRHGRPSATCPPSSGGRRMPLXSSGGGTMPS

SEQ ID NO: 19268 - DNA, 684 bp, Zea mays
  misc_feature: Ceres CLONE 1386345-F
  misc_feature: Encodes the peptide sequence at SEQ ID NO. 19269
  misc_feature (531)..(531): n is a, c, t, g, unknown, or other
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaaatcacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgtaacgacgttgagctcggcaagctgctgtctggcgtcaccatcgcgcnacgggggtgtcctccccaacatcaacccggttctcctgcccaagaaagtggcgggaagaaagcgtccagcggcggcagcaagggagagcaagcccccctaagaaggcccgcnagtcccccaaagaaagggcagccaagtcccccgaagaaggg

SEQ ID NO: 19269 - protein, 166 aa, Zea mays
  misc_feature: Ceres CLONE 1386345-F
  misc_feature (29)..(102): Pfam Name: Histone Pfam Description: Core histone H2A/H2B/H3/H4
  misc_feature (116)..(116): Xaa is any aa, unknown, or other
MDASGAGSKAKKGAAGRKAGGPRKKSVSRSVKAGLQFPVGRIGRYLKKGRYAQRVGTGAPVYLAAVLEYLAAEVLELAGNAAKDNKKTRIVPRHLLLAIRNDVELGKLLSGVTIAXRGCPPQHQPGSPAQESGGKKASSGGSKGEQAPLRRPASPPKKGQPSPPKK

SEQ ID NO: 19270 - DNA, 674 bp, Zea mays
  misc_feature: Ceres CLONE 1386349-F
  misc_feature: Encodes the peptide sequence at SEQ ID NO. 19271
  misc_feature (574)..(574): n is a, c, t, g, unknown, or other
atagctggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggggagggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcacacgcgacgngggtgtgatgattgccgatggcaagtcgcggttttcaatcaatgggaggcctatctaccactttgttgggacttcaccttcagcgagtcccggcatgggg

SEQ ID NO: 19271 - protein, 155 aa, Zea mays
  misc_feature: Ceres CLONE 1386349-F
  misc_feature (34)..(135): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (122)..(122): Xaa is any aa, unknown, or other
MATAGKVIKCKAAVAWEAGKPLSIEEVEVAPPQAMEVRVKILFTSLCHTDVYFWEGRGQTPVFPRIFGHEAGGIIESVGEGVTDVAPGDHVLPVFTGECKECAHCKSAESNMCDLLRITRDXGVMIADGKSRFSINGRPIYHFVGTSPSASPGMG

SEQ ID NO: 19272 - DNA, 686 bp, Zea mays
  misc_feature: Ceres CLONE 1386354-F
  misc_feature: Encodes the peptide sequence at SEQ ID NO. 19273
  misc_feature (655)..(655): n is a, c, t, g, unknown, or other
  misc_feature (686)..(686): n is a, c, t, g, unknown, or other
aaagctggagctccccgcggtggcggccgctctagaactagtggatcccccgggctgcaggaattcgcacgagaccattacctagaacatcctaatcgaaaattcgggatcgggacgcggagaggggaaaggcgagtcgtcgactcgtcgtccgggcagcttccctccctctcctctccgcccccgcttacctaggccggccccgcctacgcccccctcccgccgccgcacgatgagcacttctcccgccgccgccgacgtttcgcctttgccgcctactgctgccgccgacgaggccgcgcgggcgacagagacggtggtggtcgatgagagggtcgcctcacacgtggacccgttcctcgtcgaggcgctcgacaaccctcgccaccgtctcatggttctacggatggaactggatatacaaaactttatgcagaaccctcagctgcaggagtttgaattccagaactttccgacttcttacctccgctgtgctgctcatcgtgttgcacaacattatggcttagagactatagtagcagatagtttagtagaaagctcagttagcaggattgttgccagaaaacagcagaaagcaggtatcctggcatttttttatcagaagttctaggcatcaagcaggaaatgatcatgnaacagctgagaaagctttaggttgtcatttn

SEQ ID NO: 19273 - protein, 132 aa, Zea mays
  misc_feature: Ceres CLONE 1386354-F
MSTSPAAADVSPLPPTAAADEAARATETVVVDERVASHVDPFLVEALDNPRHRLMVLRMELDIQNFMQNPQLQEFEFQNFPTSYLRCAAHRVAQHYGLETIVADSLVESSVSRIVARKQQKAGILAFFYQKF

SEQ ID NO: 19274 - DNA, 630 bp, Zea mays
  misc_feature: Ceres CLONE 1386356-F
  misc_feature: Encodes the peptide sequence at SEQ ID NO. 19275
  misc_feature (149)..(149): n is a, c, t, g, unknown, or other
aaagctggagctccccgcggtggcggccgctctagaactagtggatcccccgggctgcaggaattcgcacgagaccattacccagaacatcctaatcgaaaaatgcagcagcgaacaacacaaattaagtagtgggagtgtcagaactntgggaggcacaaattaagtacaaagcagtctaattaatgacgggcccgatggagattccggtgatcgatctcggcggcctcaacggcggcggcgaggagaggtcgcggaccttggcggagctccacgacgcctgcaaggactggggcttcttctgggtaagcagagcaccaacgaatgcttgcaattaatatttgacaacttctttccatatgcatgcgcgcgggcgtacgtacgtcattatgatgcgccggcgccgctcgcatccgcatcgcaggtggagaaccacggcgtggacgcgccgctgatggacgaggtcagcgcttcgtctacggcactacgaggagcacctggaggccagttctacgcctccggcctcgcatggacctccaggcgcccacagaggtgaactgatgaaagcccccccacgaggggggagtgggagtccacctaatttatcccggacacccccagaacaagggg

SEQ ID NO: 19275 - protein, 50 aa, Zea mays; identical to SEQ ID NO: 17970
  misc_feature: Ceres CLONE 1386356-F
  misc_feature: SWISSPROT Homolog: EC 1.14.17.4 Aminocyclopropanecarboxylate oxidase

SEQ ID NO: 19276 - DNA, 676 bp, Zea mays
  misc_feature: Ceres CLONE 1386360-F
  misc_feature: Encodes the peptide sequence at SEQ ID NO. 19277
  misc_feature (289)..(289): n is a, c, t, g, unknown, or other
aaagctggagctccccgcggtggcggccgctctagaactagtggatcccccgggctgcaggaattcgcacgagaccattacctagaacatcctaatcgaaaagacccttcacattcccagttccctctgcgccccgtaaaccctagccgcgattcatggcccgcaagcgccgcgcgccttcgcctcctccgcctccgcaggaggagtcgtcctctgaggaatctggctccgaagagttggaggagcctcctcgcctccccgagctccgtagtcccccgcaggccgcggncaacaacgccgactcgtcggaggcggacacggactccgacaccgacgctcaagctttccagatgcgccaggtgccccgctccctcactaagcatacgcatccagttccccagccagaatccgatcccgaagaggaggagggcgagtcatcggagtcggagcatgagaaccctgtgcctgtggttcaaaacaaggctgcggcggcggccgtgttgtccaaggcagagcaggaaaggaagagacccccctcggatcctgctcctaccgggaaggcaaaaaaaaggaaggctgtgcctacccctctttgcaaggcgaaaaaagggcaaggccgagctagaggaacccggcgctgaggccactccagcaggaaatgcaaagaagggcaaag

SEQ ID NO: 19277 - protein, 161 aa, Zea mays
  misc_feature: Ceres CLONE 1386360-F
  misc_feature (45)..(45): Xaa is any aa, unknown, or other
MARKRRAPSPPPPPQEESSSEESGSEELEEPPRLPELRSPPQAAXNNADSSEADTDSDTDAQAFQMRQVPRSLTKHTHPVPQPESDPEEEEGESSESEHENPVPVVQNKAAAAAVLSKAEQERKRPPSDPAPTGKAKKRKAVPTPLCKAKKGQGRARGTRR

SEQ ID NO: 19278 - DNA, 620 bp, Zea mays
  misc_feature: Ceres CLONE 1386363-F
  misc_feature: Encodes the peptide sequence at SEQ ID NO. 19279
  misc_feature (214)..(214): n is a, c, t, g, unknown, or other
  misc_feature (226)..(226): n is a, c, t, g, unknown, or other
  misc_feature (295)..(295): n is a, c, t, g, unknown, or other
  misc_feature (312)..(312): n is a, c, t, g, unknown, or other
aagctggagctccccgcggtggcggccgctctagaatagtggatcccccgggctgcaggaattcgcacgagaccattacctagaacatcctaatcgaaaagttttccaacacagcgaggcccacgttgtagggttttttgcttgcttcgcccggcggtaaagctgagcgcggcgagagccggagaccgaaaaacgccgcccgccgcgcgccggntcatggagatcngacagtaccccgcgagcggctgctccaaggagcaccagaagatctaccaggagtgggtcgcgctcgcgnacgcaaatggggatggncgcatcaccgggccccgatgcgatcaggtttttttggattgtcaaagctttccgggcttgacctcagggggggggggggtattgggggaacccaaaaagggaggggatacctgggtttccctggaatccgccccggggaattcaatttattttttttggggcaaaggggggaaagaagttaatccaaaatagcctttaagcggaatgattttgggcggtttttaaaccccctgggggtggaggggttgggaggccctatttgggaaatttaaagattttggggaagagggttttaacccaaaaggggg

SEQ ID NO: 19279 - protein, 95 aa, Zea mays
  misc_feature: Ceres CLONE 1386363-F
  misc_feature (4)..(4): Xaa is any aa, unknown, or other
  misc_feature (27)..(27): Xaa is any aa, unknown, or other
MEIXQYPASGCSKEHQKIYQEWVALAXANGDGRITGPRCDQVFLDCQSFPGLTSGGGGVLGEPKKGGDTWVSLESAPGNSIYFFWGKGGKEVNPK

SEQ ID NO: 19280 - DNA, 750 bp, Zea mays
  misc_feature: Ceres CLONE 1386368-F
  misc_feature: Encodes the peptide sequence at SEQ ID NO. 19281
  misc_feature (1)..(1): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ncccccccccccccnncncccccccccccgccnnntnttttannnnnnccacagctggagctccccgcggtggcggccgctctagaactagtggatcccccgggctgcaggaattcgcacgagaccattacctagaacatcctaatcgaaaagcctctgtatccgagcatactagcggatcctggcccgatccctcttcccacctacctccgcttctctccaagtgaggaaccccaagccctcgccatggcgtcgcggatcctggcccgatccaagtcccttcacctcgtcgccgccctcacccctgccgctgccaaagcagcaacgcctatcgccggagcccgcgcgctctcgtccctgccccgctacccgtctgccccgtcgccccatgggctcggcaaggttctgggatatgaaccaacatctcacctcagtggaccacaagttttacctcgttggttttcctctctagcatccaatggatctcaggtgcagaagtcacagatctctgagacatacaagtcaggtggtgaaatgaaacagtctgagacccggaaatcaagtgagggaaccacaccaaaaggtggtggcgttcagtccgctagaagcagctatcgctaaaccctagaagtaatccccctgacaaagggagaggttctacaggtaagggggaatcagagataggaacccccaggccaccctttttacaatgattccccagcccctggcttcctttgcgctcccaaagaa

SEQ ID NO: 19281 - protein, 124 aa, Zea mays
  misc_feature: Ceres CLONE 1386368-F
MASRILARSKSLHLVAALTPAAAKAATPIAGARALSSLPRYPSAPSPHGLGKVLGYEPTSHLSGPQVLPRWFSSLASNGSQVQKSQISETYKSGGEMKQSETRKSSEGTTPKGGGVQSARSSYR

SEQ ID NO: 19282 - DNA, 670 bp, Zea mays
  misc_feature: Ceres CLONE 1386369-F
  misc_feature: Translation starting site: 419
  misc_feature (504)..(504): n is a, c, t, g, unknown, or other
aaagctggagctccccgcggtggcggccgctctagaactagtggatcccccgggctgcaggaattcgcacgagaccattacctagaacatcctaatcgaaaacccaacctcatcttctctccctttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaagggaaggcattcccccggaccagcagcggctcatcttcgctggcaagcagctcgaggacgggcgcacacttgccgactacaacatccagaaggagagcaccctccaccttgttctcccgctcaggggagggatgcagatcttcgtcaagaccctcactggaaagactatcaccctcgaggtggagtcttctgacaccatcgaccacgtcaagggccngaatcaggacaaggagggcatccctccgggacagcagcgtttcatttttgctggcagcagctcgaggacgggcgcacgctggccgactcaacattcagaagaagacaccctcccttggtgttgcgccccagggcgggatgcaaatcttcggaaaaatctgatgggg

SEQ ID NO: 19283 - DNA, 673 bp, Zea mays
  misc_feature: Ceres CLONE 1386370-F
  misc_feature: Translation starting site: 175
  misc_feature (478)..(478): n is a, c, t, g, unknown, or other
aaagctggagctccccgcggtggcggccgctctagaactagtggatcccccgggctgcaggaattcgcacgagaccattacctagaacatcctaatcgaaaaatctctccccacctcccctgagcttctcccgacctttggtcaggcaaaggaggcggccaacaaggacgagcgatggtgaccaaggtcatctgcttcctggtgctcgcatccgtgctcctcgccgtcgcttttcccgtgtctgctctgcggcagcaggtgaagaagggcggcggcggtgaaggcggaggcggaggcagtgttagcggaagcggaggcggcaacctgaatccctgggagtgctcgcccaagtgcgggtcgcggtgctccaagacgcagtacagggaaggcctgcctcaccttatgcaacaagtgctgcgccaagtgcctctgcgtgccaccggggttctacggcaacaagggcgcctgcccctgctancacaactggaaaaccaaggaaggaggggcccagtgcccctagaagatccaccgcagctcccgtccgccattggtcccccttctccgaatctgggacgtggtgttcatctttcgacaccccctaggctgggcattttattactagtataatgctagtggcccgcccgttgcttaatctgggatgctaccaggcaga

SEQ ID NO: 19284 - DNA, 639 bp, Zea mays
  misc_feature: Ceres CLONE 1386371-F
  misc_feature (581)..(581): n is a, c, t, g, unknown, or other
  misc_feature (582)..(582): n is a, c, t, g, unknown, or other
  misc_feature (590)..(590): n is a, c, t, g, unknown, or other
  misc_feature (617)..(617): n is a, c, t, g, unknown, or other
  misc_feature (639)..(639): n is a, c, t, g, unknown, or other
aagctggagctccccgcggtggcggccgctctagaactagtggatcccccgggctgcaggaattcgcacgagaccattacctagaacatcctaatcgaaaacccccttccctctcttccgcctccgattgagtggctcaccttctttcccagccagcacgagcttgcaagcaagcgagctcctgagatttcagctcgcttctcctccagaggtcgagcagaccagactcctccgaccgaagctctaccacttcccagttagcctgtccaggaactgcttggccggagatccaaacaaacctctgtgttggggttctccggggttccttgcgctggagggaggtttcgttctcgctggccatggtttggctgagaagcagcagcggcagcatctttgatgcaaatctctgagctttatgaaagatcgcactcacctgcgccgctcctgcttcctcactccttctcgggtgtcttcctctactgggtttatgtgatctcataacttgccctccccgggatccgccattcccccgtgccctctctccgtcccttcaactttctccctcttttcttgctcccctnncacatcgncaaataacagcactaagcggcaggggnagaggaatctttttcgagggan

SEQ ID NO: 19285 - DNA, 625 bp, Zea mays
  misc_feature: Ceres CLONE 1386372-F
  misc_feature: Encodes the peptide sequence at SEQ ID NO. 19286
  misc_feature (12)..(12): n is a, c, t, g, unknown, or other
  misc_feature (230)..(230): n is a, c, t, g, unknown, or other
gctctagaacangtggatcccccgggctgcaggaattcgcacgagaccattacctagaacatcctaatcgaaaagccaaggaaacagtcacgtctcccagatctaactccccccgactcacgaatcccagagagcctccatggcgacgcaccgccactgcctcccactcctcctcgtggccgccgccctcgccctcgccgccgtccctgctcgcgcggcgctgggcggcnggcgcggcccgctgctgggcgggtggaacccgatccctgacgtgagcgactcgcacatccaggagctaggcgggtgggcgctggggcaggcgaagcaccagaagctggccgccgacgggctgcggttcccgcgcgtggtggccggcgagcacaaggtcgtgtccggatggactaccgcctctacgtcgacgccgccaaccccgccggccggaccgtggcctaacgtccccgcgggtacgagcaaggcttgaacccgcacccgccagttccgcctccttcacccgggggccccgggcccccctgaaacaaaagggaaccgggtgggcccgaaaccaacccccaaccatgttcccccggaaataacgggggggaggtaaaccttaattatttgtgtc

SEQ ID NO: 19286 - protein, 113 aa, Zea mays
  misc_feature: Ceres CLONE 1386372-F
  misc_feature (31)..(31): Xaa is any aa, unknown, or other
MATHRHCLPLLLVAAALALAAVPARAALGGXRGPLLGGWNPIPDVSDSHIQELGGWALGQAKHQKLAADGLRFPRVVAGEHKVVSGWTTASTSTPPTPPAGPWPNVPAGTSKA

SEQ ID NO: 19287 - DNA, 811 bp, Zea mays
  misc_feature: Ceres CLONE 1386374-F
  misc_feature (1)..(1): n is a, c, t, g, unknown, or other
  misc_feature (2)..(2): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (46)..(46): n is a, c, t, g, unknown, or other
  misc_feature (47)..(47): n is a, c, t, g, unknown, or other
nnccccccccccnnnnnnnnnntnnncgggggggnnnnntcggggnngggcaagactggagctccaccgcggtggcggccgctctagaactagtggatcccccgggctgcaggaattcgcacgagaccattacctagaactcctaatcgaaaaatctctctcttctcctcgcctcgccttggtgttcacgccgtcgctagcgcctgcccccggcgaagcttctgccctccccggcgccagctcgggtcggccgcgggcaagcagctgctacgcgtgaaacgggcacaccagtacgcaataccacccgaggggaacggggaaactcgggaaaaagaggccccccactggggaaaaccctaagggacggcggggtggtaccgggggaatttgtccccctcgggcccctccatccctgacgcaccccccccccgggggggggggggagcccccccctatttcgagaacaaagggccaatcttttgctgcccttggcgaggtttcaggccaaattcaagggcgcaggatggggggcagggcccgggaagtaagaggaaaccccaaaacccccttcaaagagaaggggaagaccttttggtaggaagcccccgaacccgggggcgggaacaacaggggggggggcattttcccctatgcgcggtgggcccctgggttgagccacgtgaggggtgggggggggcccacccgggccacgcggcaaaaaagtgggcgaattgcagggtggcccccttcttgaagcccccccccgggagggggaggggggtgtggccccgcccttttgcggcgggggccg

SEQ ID NO: 19288 - DNA, 671 bp, Zea mays
  misc_feature: Ceres CLONE 1386378-F
  misc_feature: Translation starting site: 203
  misc_feature: SWISSPROT Homolog: EC 2.5.1.47 Cysteine synthase
  misc_feature (314)..(314): n is a, c, t, g, unknown, or other
  misc_feature (360)..(360): n is a, c, t, g, unknown, or other
aagctggagctccccgcggtggcggccgctctagaactagtggatcccccgggctgcaggaattcgcacgagaccattacctagaacatcctaatcgaaaaatctccagcagcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccnagctcgagtccatggagccctgctccagcgtcaaggataggattgnctacagcatgatcacggacgcagaggagaaagggctgattactccaggcgtgagtgttctgattgaacccactagcgcaacacaggcattggactggccttttatgctgctgccaaggctacaaacttacactcacaatgcctgcctccatgagcatggagaggaggatcatatggaaggcttttggtgctgaactttgtcttactgacccacctctgggatggaaagagctgtcaagaaagcggaagagatacagcaaagaacccaactcttacatcctcaacattttgaaatccagctaacccaaggat

SEQ ID NO: 19289 - DNA, 722 bp, Zea mays
  misc_feature: Ceres CLONE 1386380-F
  misc_feature (442)..(442): n is a, c, t, g, unknown, or other
tggagctccccgcggtggcggccgctctagaactagtggatcccccgggctgcaggaattcgcacgagaccattacctagaacatcctaatcgaaaaccacaaaaaattagggagttttcttctcccgtccaccttgcgtgctcgcgcgcgagctctcgtggcgcagccacaactaggcgaccgccgccgcccctacgccacgtgctcgagtctagcctcgtcgattgcttccccagtttaattgatctacaagcttcagaacatgttccagaatacatttcaggctgggttcctggtcattctttatagccttcgggaccaagcagtggcagatatggggataagggaggttgggaatgggcacattaaaaggggcccggggaggagaaattccaatcttaagggactttggaattggttggaaaaatgggaagggcaacntaacatcaaatgtgccaggtgaaccccttcggcaaaccctggggaataaacctccccattctcggggtattaatggggaaaaatcttaaaaaaaaaacttccccgtttggaaaacccagagtttggggaaaaaaaaaaaggcccacaccccatttttccggcactaaaattttcccgggggttcttgtccacgggggggaaaaccataaatctggcggagggccccgaaaaaacccgcggagggggggggaaaacaaccccgcgggggacctgtggtggg

SEQ ID NO: 19290 - DNA, 675 bp, Zea mays
  misc_feature: Ceres CLONE 1386382-F
  misc_feature: Encodes the peptide sequence at SEQ ID NO. 19291
  misc_feature (365)..(365): n is a, c, t, g, unknown, or other
aaagctggagctccccgcggtggcggccgctctagaactagtggatcccccgggctgcaggaattcgcacgagaccattacctagaacatcctaatcgaaaattcgggatcgggacgcggagaggggaaaggcgagtcgtcgactcgtcgtccgggcagcttccctccctctcctctccgcccccgcttacctaggccggccccgcctacgcccccctcccgccgccgcacgatgagcacttctcccgccgccgccgacgtttcgcctttgccgcctactgctgccgccgacgaggccgcgcgggcgacagagacgggggtggtcgatgagaggggtccctcacacgtggacccgttcctcgtcnaggcgctggagaggcgtgcgcaccgtctcatgggtctacggatgggactggatatacaaaactttatggagaaccctcagctgcaggagtttgaatccagaactttccgacttcttacctccgctgtgctgctcatcgtggtggcacaactttatggtttagagactatagtagcagatagtttaggaaaagggtcagtttagcagattggttcaagaaaaacagcaaaaaggaggtatcccggaattttttttatcaggaagttcctaggcatccaagcaggaaatggtcctggaaacagctgaaaaac

SEQ ID NO: 19291 - protein, 111 aa, Zea mays
  misc_feature: Ceres CLONE 1386382-F
  misc_feature (45)..(45): Xaa is any aa, unknown, or other
MSTSPAAADVSPLPPTAAADEAARATETGVVDERGPSHVDPFLVXALERRAHRLMGLRMGLDIQNFMENPQLQEFESRTFRLLTSAVLLIVVAQLYGLETIVADSLGKGSV

SEQ ID NO: 19292 - DNA, 730 bp, Zea mays
  misc_feature: Ceres CLONE 1386389-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (28)..(28): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (730)..(730): n is a, c, t, g, unknown, or other
nnnnnnnnnnnnnnnnnnnccccacctnccctccgcgggnnnnnnnnngggcaaagctggagctccccgcggtggcggccgctctagaatagtggatcccccgggctgcaggaattcgcacgagaccattacctagaacatcctaatcgagaagcaaactcgaccagatgtttgaataattctactttacaacatgtgaaccttaattttaagttaagcccccttctctctcacctcgatgcgggttgccaaccgccgatctgcccggccaaggattgttgagctcgccgcgggctaggtttccttccgtccaccatgacggggccaggctcagctccgacccaaacaccccctccagaacccaagcataacggccggccgcccccgtcctcctcctgggggcggcactcctaagccgccgcccggtgggggtcgttttgggggtatcccacaacccggttgccccgccgctttcattcggcctttctcctttgggaacaggggcccttcattttttcgggtccttcggccacctcctggaggccagcttaaccaaagcgaccccggggggggaaacccaacaacccgggggggttccaatgggggtggggcccctttccgccctcccggggggggggggggaaccggggtccccgaagggatgggggggccctaaagggttctccccggggggtttggagacggggaaacgcccgcccccgcgccgggn

SEQ ID NO: 19293 - DNA, 665 bp, Zea mays
  misc_feature: Ceres CLONE 1386396-F
  misc_feature: Encodes the peptide sequence at SEQ ID NO. 19294
  misc_feature (190)..(190): n is a, c, t, g, unknown, or other
  misc_feature (223)..(223): n is a, c, t, g, unknown, or other
aagctggagctccccgcggtggcggccgctctagaatagtggatcccccgggctgcaggaattcgcacgagaccattacctagaacatcctaatcgaaaaagatctagggttctctcgtgctctgttctcatcttctgctcgctggtgtcccctccctctcacccatggcttcggcggcggcggcactcnaggtgggacttacttcctgcggactactacaanctgctgcaacaacccccgatgtcgtccaccagttctacagcgaagccagcaccatggtccgcgtcgacaacctcaccggcacgacccgcgctgccaacaacatgatggacatacactcactcatcatgtctttgaacttcacccaaattgagatcaagactgccaattttgtgaactcatggggcgatggggtgctagttatggtctctggtctagtgcagaccaaggagtacagccaccaaggaaaattatccagatgttcttccttgcccctcaggagagggttactttgtcctcaacattactttcacttcgattacaaaaacatgtgcagcctgccgcagtgattgctcaggaggatacgagaggaattggcaaccaacacaattgttgaaccgctcctgagaacgttcacgagaagaactcaacaatagagctggag

SEQ ID NO: 19294 - protein, 134 aa, Zea mays
  misc_feature: Ceres CLONE 1386396-F
  misc_feature (9)..(9): Xaa is any aa, unknown, or other
  misc_feature (20)..(20): Xaa is any aa, unknown, or other
MASAAAALXVGLTSCGLLQXAATTPDVVHQFYSEASTMVRVDNLTGTTRAANNMMDIHSLIMSLNFTQIEIKTANFVNSWGDGVLVMVSGLVQTKEYSHQGKLSRCSSLPLRRGLLCPQHYFHFDYKNMCSLPQ

SEQ ID NO: 19295 - DNA, 667 bp, Zea mays
  misc_feature: Ceres CLONE 1386397-F
  misc_feature: Encodes the peptide sequence at SEQ ID NO. 19296
  misc_feature (353)..(353): n is a, c, t, g, unknown, or other
  misc_feature (407)..(407): n is a, c, t, g, unknown, or other
aaagctggagctccccgcggtggcggccgctctagaactagtggatcccccgggctgcaggaattcgcacgagaccattacctagaacatcctaatcgaaaaatacctcctcaaggcacgttcaccacagtcctctctttccccggcaccaccaccaccacccaggctaacaggactggaccgagtgttgaacaacactgcagtgagtgacggcaggcatggtgagccgtgaaaatttgcacctggtgctggacccggcgtctctgggcgcgccttgggccgacccgtccgccgcagagatcccgccgcagctcctcgccgcgctgggagagtacctctcctccgcccgcggngacgtcaagacggaggcgcacgacgagttcatgatgcacgagttcaaggtgcgncgttgcgcgcgcgcgcgaagccactactggacggcgtgcccctacgcgcacccgggagatgccgcgctgtcgtcggacccgcgccgcgtggactactcaggtggaccagtgcccgtactttccgcgacggccggatcccgtcctcgcaagacccggtggggccggctgccccgtaaaccaatgaaacttttgagtttgggtaccatccgggccgataccaatggcgacattgcccgtggtttgttgaacaactgcgtcat

SEQ ID NO: 19296 - protein, 149 aa, Zea mays
  misc_feature: Ceres CLONE 1386397-F
MVSRENLHLVLDPASLGAPWADPSAAEIPPQLLAALGEYLSSARGDVKTEAHDEFMMHEFKVRRCARARSHYWTACPYAHPGDAALSSDPRRVDYSGGPVPVLSATAGSRPRKTRWGRLPRKPMKLLSLGTIRADTNGDIARGLLNNCV

SEQ ID NO: 19297 - DNA, 787 bp, Zea mays
  misc_feature: Ceres CLONE 1386399-F
  misc_feature (263)..(263): n is a, c, t, g, unknown, or other
  misc_feature (340)..(340): n is a, c, t, g, unknown, or other
  misc_feature (343)..(343): n is a, c, t, g, unknown, or other
aaagctggagctccccgcggtggcggccgctctagaactagtggatcccccgggctgcaggaattcgcacgagaccattacctagaacatcctaatcgaaaaaagaacaaaccattgttggacgcgttcccctcctgcacgcaacctcatctcgtcctccagatcctggatggccgtcctccttgataccttgcctcgcgagtgctctcggtgagctactttgttttgatttatcagaaatccgtttgctttcatgtatgcangctcagatctgattgctggattcggcatcttacgggcttgaatagagctaggactgggagaaaaacacaacccgcgntgnatcctgaatcgggtagtcctttgccttcagggtcatgttgttttgtttttgggggccaacaatcccatgttctgcttccgggttccaatttggaaaaatttcaaagcccccccccccccccccctttcgttctgaaaggattttggagcaaaaatggttgggaggggggaaaactttttgggggaaacccctgttccccccaaaggaaagagccccccgccccaaaattttggccccctcccaaaaatttttaaaaacctttaaaaccccccccccaaaaaaagggaaaaatctcccaaaaaaaaacccgccggccccccaaaacaaaaaaaaaaaaaaaaagtgcctccccaaaagggccctttctatatgggggggccccccggccgcccccaaaaaaaaaaaaaaaaattattatgcgggggggaaaaaaacccccttttt

SEQ ID NO: 19298 - DNA, 735 bp, Zea mays
  misc_feature: Ceres CLONE 1386400-F
  misc_feature (530)..(530): n is a, c, t, g, unknown, or other
  misc_feature (559)..(559): n is a, c, t, g, unknown, or other
aaagctggagctccccgcggtggcggccgctctagaactagtggatcccccgggctgcaggaattcgcacgagaccattacctagaacatcctaatcgaaaaagatcatcgtccgtccaatccatccattcatctacacacgcagttgcagcacatacagctagctagctcgttactgtttttgcagctgatctgatcgaccgacgcgacccaccgatcacgatcatgagctaccaagcgggctacccaccgccgggccaacaggcctacggcgcgcctccgccggcgtacgtcgcgccaccgccggcgtacccgccaacggccccaggacggcggcgcggcgtactacggccagcagcagacaaccaccaccagcagcagccgcggcggcgacggtttctggaaaggatgctgcgccgccatctgctgctgctgcgtcctcgacatgtgcttctgaggacatatcgtcgatcgatcgacgacggccagggcatgctagctaactgatgaccggccggtacgtgcgtggntgataatcaccatcatgtgctgctcaagnagctggtggggcattataatatacccatcctgaatacatatatacgtatacgaacctactcggacgtcttcaatttacttcctgggggtattggaataaacaaatgccgccaccttttgactccgaccccggggctggggccggggattcaattggcaagaaatttcttttaacat

SEQ ID NO: 19299 - DNA, 670 bp, Zea mays
  misc_feature: Ceres CLONE 1386401-F
  misc_feature: Translation starting site: 168
  misc_feature: SWISSPROT Homolog: EC 4.1.3.27 Anthranilate synthase
atagctggagctccccgcggtggcggccgctctagaactagtggatcccccgggctgcaggaattcgcacgagaccattacctagaacatcctaatcgaaaaaacacgtgacaccccgcgcgcgcgcctccgccgcacgcccccactctctcaccgccaccgccgagatggccgcctgctcccacctcgccgccgcgggtggctcttcccctgccgccgccgcagtggttcgttccccggcgcattcctcagccgccgccgccttcgcgcgcctccggtcgacgctgcgtttctcgagcgccggcctgtcggttaagggaagcagggcgactttcccgtgggtcgccgccgcggggccggccgcggcggcgccggtgggcgacctggacggccgcccagccacggagaagcagcccatcattgtcatcgataactacgacagcttcacctacaacctctgccagtatatgggggagcttggattgaacttcgaagtataccgcaatgatgaactgaccatagaagatggtaagaggaggaaccaaggaggatacttatttctccagggcctggtgaaccaccagattcagggatatcattgcagactgttctttgaataaggcccaccatcccaattttccgaatttgcatggccctgcagggcattggg

SEQ ID NO: 19300 - DNA, 703 bp, Zea mays
  misc_feature: Ceres CLONE 1386404-F
  misc_feature: Encodes the peptide sequence at SEQ ID NO. 19301
  misc_feature (324)..(324): n is a, c, t, g, unknown, or other
  misc_feature (398)..(398): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (666)..(666): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (684)..(684): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
aaagctggagctccccgcggtggcggccgctctagaactagtggatcccccgggctgcaggaattcgcacgagaccattacctagaacatcctaatcgaaaaatcacactcgccaaccccgtcatcgatctcgtttcaaatccatccatcctcgtttcctccgtcccgcagcatctcaaccccatggccaagatcaagatcgggatcaatgggttcggcaggatcggaaggctggtggccagggtggctctgcagagtgacgatgtcgagctcgtcgccgtgaacgaccccttcatcagcaccgactacatgacctacatgttncagtacgacactgtacacggacagtggaagcaccatgaaagtcaggtgaaggactccccaaacctttctcttgntgagaaaagagttgctgtgtttggctgcaggaacccctgagagatcccgtggggtcggttggtgctgaatatgttggtgaggctactggtgttttcactgaccaggagaaagttgcagctcccttgaggggtgtggcaagaaaggttccatttctggtcctaacaggatgcccccatgtttggcttgggggcaacaaaaaggataaaagcctgaaattaaattggccccaagggtaggtggccaaccaattgccctnnnnnnnnnncnccccctccctnnnnnttntnnnnntnnnnntttttgt

SEQ ID NO: 19301 - protein, 84 aa, Zea mays
  misc_feature: Ceres CLONE 1386404-F
  misc_feature (4)..(85): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (47)..(47): Xaa is any aa, unknown, or other
  misc_feature (72)..(72): Xaa is any aa, unknown, or other
MAKIKIGINGFGRIGRLVARVALQSDDVELVAVNDPFISTDYMTYMXQYDTVHGQWKHHESQVKDSPNLSLXEKRVAVFGCRNP

SEQ ID NO: 19302 - DNA, 669 bp, Zea mays
  misc_feature: Ceres CLONE 1386405-F
  misc_feature: Encodes the peptide sequence at SEQ ID NO. 19303
  misc_feature (312)..(312): n is a, c, t, g, unknown, or other
  misc_feature (422)..(422): n is a, c, t, g, unknown, or other
  misc_feature (475)..(475): n is a, c, t, g, unknown, or other
aagctggagctccccgcggtggcggccgctctagaactagtggatcccccgggctgcaggaattcgcacgagaccattacctagaacatcctaatcgaaaacttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattgntgccaatccatccgccgagggtggtgaggacgaaagcgttgatgacacagctgtgaaggtggttgatattgttgacacattccgtctacaggagcaacctccttttgacnagaaatcatttgtgtcttacatcaaaaaatacatcaagaatctcactgctgtngtggagccagagaaagcggatgagttcaaaaagggtgtcgagggtgcacccaagtttctccttagcaagctggagggactccaatttttttggtgggagcccatgaaggatgatgcgtctggggtattcgcctattacgagggagggggcactaatccgacatccctctatttctctcatggtcttagggagaa

SEQ ID NO: 19303 - protein, 164 aa, Zea mays
  misc_feature: Ceres CLONE 1386405-F
  misc_feature (1)..(164): Pfam Name: TCTP Pfam Description: Translationally controlled tumour protein
  misc_feature (46)..(46): Xaa is any aa, unknown, or other
  misc_feature (83)..(83): Xaa is any aa, unknown, or other
MLVYQDLLSGDELLSDSFTYKELENGVLWEVEGKWVTQGPVDVDIXANPSAEGGEDESVDDTAVKVVDIVDTFRLQEQPPFDXKSFVSYIKKYIKNLTAVVEPEKADEFKKGVEGAPKFLLSKLEGLQFFWWEPMKDDASGVFAYYEGGGTNPTSLYFSHGLRE

SEQ ID NO: 19304 - DNA, 589 bp, Zea mays
  misc_feature: Ceres CLONE 1386406-F
  misc_feature (155)..(155): n is a, c, t, g, unknown, or other
  misc_feature (156)..(156): n is a, c, t, g, unknown, or other
  misc_feature (187)..(187): n is a, c, t, g, unknown, or other
  misc_feature (188)..(188): n is a, c, t, g, unknown, or other
  misc_feature (245)..(245): n is a, c, t, g, unknown, or other
  misc_feature (397)..(397): n is a, c, t, g, unknown, or other
  misc_feature (398)..(398): n is a, c, t, g, unknown, or other
aaagtggagctcaccgcggtggcggccgctctagaatagtggatcccccgggctgcaggaattcgcacgagaccattacctagaacatcctatcgaaaaagccacgcgcccacgcgccccaagttcacgccggaactgctccctctcgacggggnnatcggcttcgtgctccgctacttccccaggnngtcaagcccgcgcccgcccaggcacgaggtggacgaccgactccgcaactcatcagntctacggggatgggactcccggctgatccctactaatccttcaaaaagttcgggggcaaatcaaaaaatcgggaaaatggggggcctttctgaaggggaaaaaactttttcccgcggggatttgggagaaaccttccaattagggaaaaaannggttaaaattcgggcccttcccgccaaaaggggattttcccgagggaaggggctcccgggggttaaattgtgggccaccaaaaaaaaacgtggggggggggggggaaaaaaaaaaaaaaaaaaatttttttccccggggaaaaaaaaaaaaggcgcttttttttgggggggggaaacacccccggttgggt

SEQ ID NO: 19305 - DNA, 695 bp, Zea mays
  misc_feature: Ceres CLONE 1386410-F
  misc_feature (295)..(295): n is a, c, t, g, unknown, or other
aaagctggagctccccgcggtggcggccgctctagaactagtggatcccccgggctgcaggaattcgcacgagaccattacctagaacatcctaatcgaaaaatctcattctgaatcaaacagcagcttcttgctcccgagtcggccagcacgcgccgccgggccgcatctcgtctccctcctcgaagcacctcctctccctggctccacgacgcggcggcctgctagctctctgggcgggctactaattctccggatggtgtcgactgctacttctccgatgccgcgcgcgcgncccgtgcggtccgctgcgcctccgtcgaatgcccaagcaggaggcggacgcgcgccccgttgtgcctcttgcggccccatcgccggaggaaaacgtcgggctcccctggtccatccggcccggggggaggagtctctttcccggggtccgccccgtttttgggttccatgggggggggggtggtccttgggcgggggcccaaaaaccatgggatttttccccgggaaggccacacggcgggggggtgtttccctatatccaccccttttccggaattttattgggggtggggagaaaaaaaaaaaaaggggggttcctaaaacacaatattgttttttctttttttttaaaaaacaccccgttgggaaaccccccccccggggggtgttttgtaaaaaaa

SEQ ID NO: 19306 - DNA, 718 bp, Zea mays
  misc_feature: Ceres CLONE 1386412-F
  misc_feature: Encodes the peptide sequence at SEQ ID NO. 19307
  misc_feature (504)..(504): n is a, c, t, g, unknown, or other
  misc_feature (715)..(715): n is a, c, t, g, unknown, or other
aaagctggagctcaccgcggtggcggccgctctagaactagtggatcccccgggctgcaggaattcgcacgagaccattacctagaacatcctaatcgaaaacttccgaaatctcgtgcggcggccggcaagttcgcacttcgcagcgcattcaccaccagcttcactcccaactaccgctgatctcactcacgctcaccccagccggccagccccgtccccatccggctagaggttcacatcacctgcgtgacgataaacatcctcttccaaatcgtagtctagcccgtgcccaaaaccctagcgaccgccggagagctcgtccgaatcgaggccaccgaggggaaattagatcgcggcggacgatggagagccctgcgaaagaggggagccggggagagctggcaatggagatcgagtcgtcggtcacggcggaggactggcgccgcgcgctttctcgcgtcgtgccgtccgtcgtcgtcctcccgcacactgcgccgcgcngctttgacaccgaggtcgcgggcgccagctacgccacgggtttcgtcgttgacaagtcccgcggcataatcctcactaacccgcatgtcgtcaagccaggacctgtggtcgcggaggccatggtcgtgaacaggggagagatccctgtgacccactgtacagagatctgaacatgattttggtttttttcgctatgaccaggtggcataangtt

SEQ ID NO: 19307 - protein, 102 aa, Zea mays
  misc_feature: Ceres CLONE 1386412-F
  misc_feature (47)..(47): Xaa is any aa, unknown, or other
MESPAKEGSRGELAMEIESSVTAEDWRRALSRVVPSVVVLPHTAPRXFDTEVAGASYATGFVVDKSRGIILTNPHVVKPGPVVAEAMVVNRGEIPVTHCTEI

SEQ ID NO: 19308 - DNA, 658 bp, Zea mays
  misc_feature: Ceres CLONE 1386414-F
  misc_feature: Encodes the peptide sequence at SEQ ID NO. 19309
  misc_feature (1)..(1): n is a, c, t, g, unknown, or other
  misc_feature (252)..(252): n is a, c, t, g, unknown, or other
  misc_feature (272)..(272): n is a, c, t, g, unknown, or other
  misc_feature (368)..(368): n is a, c, t, g, unknown, or other
  misc_feature (419)..(419): n is a, c, t, g, unknown, or other
  misc_feature (420)..(420): n is a, c, t, g, unknown, or other
  misc_feature (455)..(455): n is a, c, t, g, unknown, or other
  misc_feature (457)..(457): n is a, c, t, g, unknown, or other
  misc_feature (458)..(458): n is a, c, t, g, unknown, or other
  misc_feature (478)..(478): n is a, c, t, g, unknown, or other
  misc_feature (490)..(490): n is a, c, t, g, unknown, or other
  misc_feature (515)..(515): n is a, c, t, g, unknown, or other
naaagctggagctccccgcggtggcggccgctctagaactagtggatcccccgggctgcaggaattcgcacgagaccattacctagaacatcctaatcgaaaaaaaccctcacagcgaaggacacaaaaacacaggtagggttaggcgacgcggcggcgagagcgcgagagtaggaggaggcgtcggccatgacggggaaggcgaagccgaagaagcacacggcgaaggagatcgccgcgaagatcgacgcnggcgacgacgaaccggggcnggcggcaaggtcgggcaggcggatcggctagggcaggacaggggcgggcacgcgaagctggcgtgcccgctctgccgcaccccggcgcccgacatncagtccatgcagatccaccacgaggcgcgccatccccagctccctttcganngcgagagctcgtcaacctggactccctcaccccgncnngcgcgagggcaccacctccnagccaaagcccngggtccgcgcagcctcaaaaagtanctggctggcttgcctgctgactgcctggggaaatcccctcgattccaatccctccacccgaccgatttaaatcattcaaggacggccgccttcggcctggggggaacgtaaaccggccgcggcgcttctaaccggggaaaatg

SEQ ID NO: 19309 - protein, 37 aa, Zea mays
  misc_feature: Ceres CLONE 1386414-F
  misc_feature (28)..(28): Xaa is any aa, unknown, or other
MTGKAKPKKHTAKEIAAKIDAGDDEPGXAARSGRRIG

SEQ ID NO: 19310 - DNA, 808 bp, Zea mays
  misc_feature: Ceres CLONE 1386416-F
  misc_feature: Encodes the peptide sequence at SEQ ID NO. 19311
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (34)..(34): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (700)..(700): n is a, c, t, g, unknown, or other
  misc_feature (808)..(808): n is a, c, t, g, unknown, or other
tggggcccnnnnnnnnnntnttggtggggggggnnccccaccnnnnnnccaaagctggagctccccgcggtggcggccgctctagaatagtggatcccccgggctgcaggaattcgcacgagaccattacctagaacatcctaatcgaaaaattatacccctccgtttcccacccttacctccccactccggcagtccccgtcccaccactacagccactgctgcccggccggccgcgtccctcttcctccgccaggcgccagccgcccgctctccagcaatggcgtctgcctcgcacgccccgacgccgctgctcaaggacgagctggacatcgtcatcccgacgatccgcaacctcgacttcctggagatggggaggcccttcttccagccctaccacctcatcatcgtgcaggaggggggggcggggggaagaccattccgcggccccgagggctttcgactacggagcttctacaacgggaacggacattcaaccggcatggttgggggcccaaagggagtcccggcatcctcctttcaagggacttccgccctgcccgttggcttcccgcttaactggggccttcccaaagaaggaaagtaccttcctaaccccaatcggagggaggaacgggctttcgtttggccaggggatcccagtcgaggggaaaggaacattgcagatggccctttggangcagggagcttccggggaagcctcgccggggagggcccgttccacctcccgatttttttctttcgaatacctcgtggtaatgaaccccttaacccgcgtggtgggggn

SEQ ID NO: 19311 - protein, 176 aa, Zea mays
  misc_feature: Ceres CLONE 1386416-F
  misc_feature (140)..(140): Xaa is any aa, unknown, or other
MASASHAPTPLLKDELDIVIPTIRNLDFLEMGRPFFQPYHLIIVQEGGAGGRPFRGPEGFRLRSFYNGNGHSTGMVGGPKGVPASSFQGTSALPVGFPLNWGLPKEGKYLPNPNRREERAFVWPGDPSRGERNIADGPLXAGSFRGSLAGEGPFHLPIFFFRIPRGNEPLNPRGGG

SEQ ID NO: 19312 - DNA, 713 bp, Zea mays
  misc_feature: Ceres CLONE 1386419-F
  misc_feature: Encodes the peptide sequence at SEQ ID NO. 19313
  misc_feature (529)..(529): n is a, c, t, g, unknown, or other
aaagctggagctccccgcggtggcggccgctctagaactagtggatcccccgggctgcaggaattcgcacgagaccattacctagaacatcctaatcgaaaagagagaagtcttctctgtcacagcgccgacgcttcccaattccttccaatcggcacctcgccgtcctcgtgtgcaatccccagctctcctcgcccctccctcccaaactccagcggccccccctgaccaagctccggggacggatggacggaggagccggctttccgggcacgcagccggtctcccgctcgccggaggacgtcttccgggactaccgcgcgcgccaggccggcctgatcagggcgctcaccaccgatgtggagaagttctacgtgatgtgcgacccagagaaggagaacttatgtttatatggacttcctaatgagacatgggaaataaacttgcctgctgaagaggtccctcctgaactgccagagccagctcttggaattaattttgctcgtgatgggatggatgaaaagattgnctatcacttgttgcagtgcatagtgattcttggctaatgtctgttgcattttattttggagcagggttggattcgataagaatccagggaacgtctcttcacatgatcaataaccttccagcatatatgaggttgtcacagaaacagcaagaagagccaaagaaaaactcctaaaagaacagta

SEQ ID NO: 19313 - protein, 106 aa, Zea mays
  misc_feature: Ceres CLONE 1386419-F
  misc_feature (95)..(95): Xaa is any aa, unknown, or other
MDGGAGFPGTQPVSRSPEDVFRDYRARQAGLIRALTTDVEKFYVMCDPEKENLCLYGLPNETWEINLPAEEVPPELPEPALGINFARDGMDEKIXYHLLQCIVILG

SEQ ID NO: 19314 - DNA, 697 bp, Zea mays
  misc_feature: Ceres CLONE 1386421-F
  misc_feature (347)..(347): n is a, c, t, g, unknown, or other
aaagctggagctccccgcggtggcggccgctctagaactagtggatcccccgggctgcaggaattcgcacgagaccattacctagaacatcctaatcgaaaaaatgcagcagtagccgtctgcctcctcgctttccctttcgtccgtacgccgccgcctcgcaccgccgacagtcctcagtccagaactccagatcgagcctccctctccccagatcgggtcctaggctacagcagccgccgcatccgtcaccttcacaccgcgtgcgtgctctctctccccctccccctctccgtgggaacgactgggtgggctaccgccgccctacgcaaggtgccgagaacttncccgatatctgcccccgagaagagggggcggcagataggggcttaaaaggcgcgctggccgggggattgacaatggcggggggcggggaactgaaccggtctttcttccagggggcagctgccccccccaaagcttgtttgaaagatttctgggagccggttccttttttaaatgggccaagggggggagttgggagcccttccaaggggaatccctgttcccggtgggagaaggggccccctggtttctataaaggaaacaccccggttgaaaaaaaacccccagcctcaagggccccttcccttttaagggagcttcccttttccccccaggggtaaaaaggtggggc

SEQ ID NO: 19315 - DNA, 729 bp, Zea mays
  misc_feature: Ceres CLONE 1386423-F
  misc_feature: Encodes the peptide sequence at SEQ ID NO. 19316
  misc_feature (557)..(557): n is a, c, t, g, unknown, or other
  misc_feature (590)..(590): n is a, c, t, g, unknown, or other
  misc_feature (626)..(626): n is a, c, t, g, unknown, or other
  misc_feature (627)..(627): n is a, c, t, g, unknown, or other
  misc_feature (645)..(645): n is a, c, t, g, unknown, or other
  misc_feature (678)..(678): n is a, c, t, g, unknown, or other
caaagctggagctccccgcggtggcggccgctctagaactagtggatcccccgggctgcaggaattcgcacgagaccattacctagaacatcctaatcgaaaaacagcgacgccgccagccagacccgatcccctccctcgctagggttttcgtccccgcgccgccgcgctcccggatcccaccgaaacaaccatggccggcggtcccgcggcggtgtcgttcctgaccaacatcgcgaaggtggctgcggggctcggagccgcggcctcgctcgcctccgcgtcgctctacaccgtcgacggcggcgagcgcgccgtcatcttcgaccgtttccgcggggtgctcccggagaccgtcggcgagggcacccatttcctcgtgccctggctgcagaagcccttcatcttcgacatccgcacgcgcccgcacaacttctcctccaactcggggaccaaggacctgcagatggtcaacctcacgctccgtctcctctcccgccccgacgtccagcacctccccaccatcttcacctccctcggactcgagtacgacgacnaagtgctcccctccatcgggcacgaggtgctcnagggcgtcgtcgcccagttcatggcgaccagctccnntcacgaccgccccacgtntccggcctcgtccgcgacgctctcatccgccgngcccgggagttcacatcatccctcgacgacgtcgccatcacccacctctcc

SEQ ID NO: 19316 - protein, 178 aa, Zea mays
  misc_feature: Ceres CLONE 1386423-F
  misc_feature (122)..(122): Xaa is any aa, unknown, or other
  misc_feature (133)..(133): Xaa is any aa, unknown, or other
  misc_feature (145)..(145): Xaa is any aa, unknown, or other
  misc_feature (151)..(151): Xaa is any aa, unknown, or other
  misc_feature (162)..(162): Xaa is any aa, unknown, or other
MAGGPAAVSFLTNIAKVAAGLGAAASLASASLYTVDGGERAVIFDRFRGVLPETVGEGTHFLVPWLQKPFIFDIRTRPHNFSSNSGTKDLQMVNLTLRLLSRPDVQHLPTIFTSLGLEYDDXVLPSIGHEVLXGVVAQFMATSSXHDRPTXPASSATLSSAXPGSSHHPSTTSPSPTS

SEQ ID NO: 19317 - DNA, 674 bp, Zea mays
  misc_feature: Ceres CLONE 1386424-F
  misc_feature: Encodes the peptide sequence at SEQ ID NO. 19318
  misc_feature (301)..(301): n is a, c, t, g, unknown, or other
  misc_feature (520)..(520): n is a, c, t, g, unknown, or other
aagctggagctccccgcggtggcggccgctctagaactagtggatcccccgggctgcaggaattcgcacgagaccattacctagaacatcctaatcgaaaaatctccagcggcttcttccaaagctccaactccgacgagaaccgccactcctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggncgcgtcgccgccaagctcgagtccatggagccctgctccagcgtcaaggataggattggctacagcatgatcacggacggagaggagaaagggctgattactccaggcgtgagtgttctgattgaaccaactagcgcacacaggcattggactggcctttatggctgctaccaggggctacaaacttacactcacgatggctgcctccatgagcatggnagaggagatcatattggaggggttttggtggtggacttggccttactggcccactcttgggaatgaagggactgtcaagaaggcgaagagatacaagcaagacacccaactcggacattctcaggagttggaaaccgggtaacccaagattcct

SEQ ID NO: 19318 - protein, 127 aa, Zea mays
  misc_feature: Ceres CLONE 1386424-F
  misc_feature: SWISSPROT Homolog: EC 2.5.1.47 Cysteine synthase
MGEASPSIAKDVTELIGNTPLVYLNKVTDGCVGRVAAKLESMEPCSSVKDRIGYSMITDGEEKGLITPGVSVLIEPTSAHRHWTGLYGCYQGLQTYTHDGCLHEHGRGDHIGGVLVVDLALLAHSWE

SEQ ID NO: 19319 - DNA, 699 bp, Zea mays
  misc_feature: Ceres CLONE 1386427-F
  misc_feature: Encodes the peptide sequence at SEQ ID NO. 19320
  misc_feature (332)..(332): n is a, c, t, g, unknown, or other
  misc_feature (558)..(558): n is a, c, t, g, unknown, or other
  misc_feature (572)..(572): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (640)..(640): n is a, c, t, g, unknown, or other
  misc_feature (641)..(641): n is a, c, t, g, unknown, or other
  misc_feature (648)..(648): n is a, c, t, g, unknown, or other
  misc_feature (649)..(649): n is a, c, t, g, unknown, or other
  misc_feature (670)..(670): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (678)..(678): n is a, c, t, g, unknown, or other
  misc_feature (684)..(684): n is a, c, t, g, unknown, or other
atagctggagctccaccgcggtggcggccgctctagaactagtggatcccccgggctgcaggaattcgcacgagaccattacctagaacatcctaatcgaaaaagagggaggatttcagccattcaggagggccaccgtacgcagcgagaccagccagcaggcggcgatgttcgcgacggcggtgcggtgggcggcgaagaaggggaagcccaagatggcgccgatcgagctgacggcgccgccggagcaggcgcagtccatcacgcgcgccatcttcgacgccgtccgggagcacggcccgctcaccgtctccgacgtctgggaccacgtncaggatgtcgggcttcgagggtctggcagcaagaggcagatgaagatcatgctgcggtggatgagggagcgccagaagcttaagctcatctgcgaccacgacggcccgcacaagcagttcctctacaccacctggttttaccaaccccaggaacccggcccccgcaaaggcccccttcccgagaacccccctggtggttaaaggggggatatttttctcccccccncttttttttttccnctnnnaaaccaaaaaagaaaagaggtgtggtggggggggaggcttttttttttttttttttttctttnnctccccnnccctccttctccccttctttntnnnnntnttgtgngcgtgcggcccgcct

SEQ ID NO: 19320 - protein, 121 aa, Zea mays
  misc_feature: Ceres CLONE 1386427-F
MFATAVRWAAKKGKPKMAPIELTAPPEQAQSITRAIFDAVREHGPLTVSDVWDHVQDVGLRGSGSKRQMKIMLRWMRERQKLKLICDHDGPHKQFLYTTWFYQPQEPGPRKGPLPENPPGG

SEQ ID NO: 19321 - DNA, 733 bp, Zea mays
  misc_feature: Ceres CLONE 1386428-F
  misc_feature: Pfam Name: MCM Pfam Description: MCM2/3/5 family
aaagctggagctccccgcggtggcggccgctctagaactagtggatcccccgggctgcaggaattcgcacgagaccattacctagaacatcctaatcgaaaactctcgacgacgactcgtaattgatacaatttgctacagaggctggatgtgtatgccaagctctgctcaatgattggtcctacaattaatggccattctgatgtttacagaggtataggatgattgctatctgcgccgcctaagaacaggctacctgatgccgcacattcgacaagcgatattcatgccttgcttctgtgtgacccatccacaacaaaatcacagttcctcatatttgtatagaacactgcccctattgcatgctatacatctgacgacagatacatctgcagatgctcttacagaatctgtcacctcccatactacatcgcgagagctttatttaggagagagacccatgctgcttggtgatgcggcagtaattagcatcaataaatttgacaagtatgcacctgatacactactgacgtatactgataccttggatccatggactatatctatatgcgaagctgcgatgacgactacactcgagtcgaggcactatcgatcttgcagctgacatgtccagtgcagcatctatgatgacctctagactgcacaagataaatatgatctacacgacaccatttatttcagagttgatcacatcgttattgtcaagatagca

SEQ ID NO: 19322 - DNA, 729 bp, Zea mays
  misc_feature: Ceres CLONE 1386433-F
  misc_feature: Encodes the peptide sequence at SEQ ID NO. 19323
  misc_feature (263)..(263): n is a, c, t, g, unknown, or other
  misc_feature (284)..(284): n is a, c, t, g, unknown, or other
  misc_feature (309)..(309): n is a, c, t, g, unknown, or other
  misc_feature (343)..(343): n is a, c, t, g, unknown, or other
  misc_feature (346)..(346): n is a, c, t, g, unknown, or other
  misc_feature (391)..(391): n is a, c, t, g, unknown, or other
  misc_feature (393)..(393): n is a, c, t, g, unknown, or other
  misc_feature (394)..(394): n is a, c, t, g, unknown, or other
  misc_feature (397)..(397): n is a, c, t, g, unknown, or other
  misc_feature (423)..(423): n is a, c, t, g, unknown, or other
  misc_feature (456)..(456): n is a, c, t, g, unknown, or other
  misc_feature (460)..(460): n is a, c, t, g, unknown, or other
  misc_feature (461)..(461): n is a, c, t, g, unknown, or other
  misc_feature (699)..(699): n is a, c, t, g, unknown, or other
  misc_feature (700)..(700): n is a, c, t, g, unknown, or other
  misc_feature (703)..(703): n is a, c, t, g, unknown, or other
  misc_feature (705)..(705): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcngcggcgtgctgctggtcgtancagccacggccggggcggaggacgnagtggtcgaaacggaccgcaaggaggacctgcgntgntgcaagcaggcgtgcgagtggcagtacggaaaggacaccccgcgnannagnaatgcaagagcgagtgccgcgagcgncacagcaagctgacccggccgaggacggcaacngcgnntgaacgcctacgttcccgctccgaaaggggaagtggcgcgcacatgcctggcccccccagggccacccgggaaaaaccaggtggtttgaggggggcccccccccgggatggggcctaaattgggaaaaaaaacggcccgggaaaaaaaggggggaaaggcccggaaaaggggggaggccccccccccgggattgggggaaaaaaacttttcttgagctaaaaaaaagggggggggggnnaanancccccccccccccccccccccccg

SEQ ID NO: 19323 - protein, 73 aa, Zea mays
  misc_feature: Ceres CLONE 1386433-F
  misc_feature (17)..(17): Xaa is any aa, unknown, or other
  misc_feature (24)..(24): Xaa is any aa, unknown, or other
  misc_feature (32)..(32): Xaa is any aa, unknown, or other
  misc_feature (44)..(44): Xaa is any aa, unknown, or other
  misc_feature (60)..(60): Xaa is any aa, unknown, or other
  misc_feature (61)..(61): Xaa is any aa, unknown, or other
  misc_feature (70)..(70): Xaa is any aa, unknown, or other
MGKGSVGASWWAFLLLXGVLLVVXATAGAEDXVVETDRKEDLRXCKQACEWQYGKDTPRXXNARASAASXTAS

SEQ ID NO: 19324 - DNA, 680 bp, Zea mays
  misc_feature: Ceres CLONE 1386438-F
  misc_feature: Encodes the peptide sequence at SEQ ID NO. 19325
  misc_feature (318)..(318): n is a, c, t, g, unknown, or other
  misc_feature (348)..(348): n is a, c, t, g, unknown, or other
  misc_feature (424)..(424): n is a, c, t, g, unknown, or other
aagctggagctccccgcggtggcggccgctctagaactagtggatcccccgggctgcaggaattcgcacgagaccattacctagaacatcctaatcgaaaaatcacactcgcgaaccccgtcatcgatctcgtttcaatccatccatcctcgtttcctccgtcccgcagcatctcaaccccatggccaaatcaagatcgggatcaatgggttcggcaggatcggaaggctggtggccagggtggccctgcagagtgacgatgtcgagctcgtcgccgtgaacgaccccttcatcagcaccgactacatgacctacatnggtcagtacgacactgtgcacggacagtgnaagcaccatgaaagtcaggtgaaggactgcaaagccttctctttggtgagaagggaggtgctgtgttttgctgcangaaccctgaggagatcccggggggttccgttggggctgaatattgttgtgaagccaacggggggtttccctgaccaggaaaaggctgcagttcacttgaaggggggtggccaaaaaggtgtccttctctgttcctaaaagggtgccccccttgtttgttctttggggccaaccaaaaaggaaaaaaagttgaaattaaaatttggccccaggggaagtggaaaaacaggggttgttttcccttttttaagagaaaa

SEQ ID NO: 19325 - protein, 84 aa, Zea mays
  misc_feature: Ceres CLONE 1386438-F
  misc_feature: SWISSPROT Homolog: EC 1.2.1.12 Glyceraldehyde-3-phosphate dehydrogenase (phosphorylating)
  misc_feature (4)..(4): Xaa is any aa, unknown, or other
  misc_feature (14)..(14): Xaa is any aa, unknown, or other
  misc_feature (40)..(40): Xaa is any aa, unknown, or other
MTYXGQYDTVHGQXKHHESQVKDCKAFSLVRREVLCFAAXTLRRSRGVPLGLNIVVKPTGGFPDQEKAAVHLKGGGQKGVLLCS

SEQ ID NO: 19326 - DNA, 731 bp, Zea mays
  misc_feature: Ceres CLONE 1386440-F
  misc_feature: Encodes the peptide sequence at SEQ ID NO. 19327
  misc_feature (566)..(566): n is a, c, t, g, unknown, or other
  misc_feature (613)..(613): n is a, c, t, g, unknown, or other
  misc_feature (615)..(615): n is a, c, t, g, unknown, or other
  misc_feature (636)..(636): n is a, c, t, g, unknown, or other
  misc_feature (661)..(661): n is a, c, t, g, unknown, or other
  misc_feature (662)..(662): n is a, c, t, g, unknown, or other
  misc_feature (681)..(681): n is a, c, t, g, unknown, or other
caaagctggagctccccgcggtggcggccgctctagaactagtggatcccccgggctgcaggaattcgcacgagaccattacctagaacatcctaatcgaaaactccaccagtccaccatcgccacctacgcccaaccaaacccaactccatctcttccgactataaacgcaacccaccaccgctgccgcgaacctctgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggccatgaggtcttgctgtttgaagctcttcgtgaggccttgatggaagagatggaattagatccaacagtgtgtgtatttggtgaagatgttgggcattacggtggttcttacaaggtgacaaaaggtttggctgatacgtttggagaccttcgangtctggacacccctattgcggagaactcgtttactggcatgggagtngnagcgggaatgaaagggctgangcccgtcgttgaggcatgaacatgnngatcctgctccttgcttancacagatctcaaatactgtgggatgcttcattacactcccggcggcagtc

SEQ ID NO: 19327 - protein, 140 aa, Zea mays
  misc_feature: Ceres CLONE 1386440-F
  misc_feature: SWISSPROT Homolog: EC 1.2.4.1 Pyruvate dehydrogenase (acetyl-transferring)
  misc_feature (112)..(112): Xaa is any aa, unknown, or other
  misc_feature (128)..(128): Xaa is any aa, unknown, or other
  misc_feature (135)..(135): Xaa is any aa, unknown, or other
MATAFSLRAAAPATAPRAVSRSTSAARVVPVASALAGRGRLVARAAVTAKADVPSSTSDGHEVLLFEALREALMEEMELDPTVCVFGEDVGHYGGSYKVTKGLADTFGDLRXLDTPIAENSFTGMGVXAGMKGLXPVVEA

SEQ ID NO: 19328 - DNA, 738 bp, Zea mays
  misc_feature: Ceres CLONE 1386441-F
  misc_feature: Encodes the peptide sequence at SEQ ID NO. 19329
  misc_feature (366)..(366): n is a, c, t, g, unknown, or other
  misc_feature (369)..(369): n is a, c, t, g, unknown, or other
  misc_feature (376)..(376): n is a, c, t, g, unknown, or other
  misc_feature (377)..(377): n is a, c, t, g, unknown, or other
  misc_feature (394)..(394): n is a, c, t, g, unknown, or other
  misc_feature (395)..(395): n is a, c, t, g, unknown, or other
  misc_feature (486)..(486): n is a, c, t, g, unknown, or other
  misc_feature (505)..(505): n is a, c, t, g, unknown, or other
  misc_feature (506)..(506): n is a, c, t, g, unknown, or other
  misc_feature (517)..(517): n is a, c, t, g, unknown, or other
  misc_feature (538)..(538): n is a, c, t, g, unknown, or other
  misc_feature (595)..(595): n is a, c, t, g, unknown, or other
  misc_feature (729)..(729): n is a, c, t, g, unknown, or other
  misc_feature (731)..(731): n is a, c, t, g, unknown, or other
caaagctggagctccccgcggtggcggccgctctagaactagtggatcccccgggctgcaggaattcgcacgagaccattacctagaacatcctaatcgaaaactcttccagagtaccgcggtctcatctcctcccgggacgggcatgcagagcacggctgccatcggtctcgttcggccatgcgccgcgcggccactccccacctaccctagcccacggcgcggcgccggcgcgtgcagcggcgccgcacagccgatcctcgcgccccgcggcctctgcctctccgcccgcgccagcctactgccggactcgccgctggaggaggagtaccggagatgcagggccggccggcacgtggccgcggncgnaaaggtnngcgcggctgatgggcgnnaaaaggaagcggggggagggctcgtcaagacgctgcagctggggtcgctcttcgggctctggtacctcttcacatctacttcacatctacnacaagcaggttctgaaggnntctgcataccntataacatcaccacagtgcangttggccgtggaaagtgcattgctttggttatgtggatcaccggtatccttaaaggncaaagatttctggtgcccagctttttgctatccttcctctagctatcgttcatacatgggcaatcttttcacaacatgagccttggaaaggtgtgcgttgcatttacacatactatcagggcatggaacctttntnctcagtt

SEQ ID NO: 19329 - protein, 163 aa, Zea mays
  misc_feature: Ceres CLONE 1386441-F
  misc_feature (74)..(74): Xaa is any aa, unknown, or other
  misc_feature (75)..(75): Xaa is any aa, unknown, or other
  misc_feature (78)..(78): Xaa is any aa, unknown, or other
  misc_feature (84)..(84): Xaa is any aa, unknown, or other
  misc_feature (114)..(114): Xaa is any aa, unknown, or other
  misc_feature (121)..(121): Xaa is any aa, unknown, or other
  misc_feature (131)..(131): Xaa is any aa, unknown, or other
MQSTAAIGLVRPCAARPLPTYPSPRRGAGACSGAAQPILAPRGLCLSARASLLPDSPLEEEYRRCRAGRHVAAXXKVXAADGRXKEAGGGLVKTLQLGSLFGLWYLFTSTSHLXQAGSEGXCIPYNITTVXVGRGKCIALVMWITGILKGQRFLVPSFLLSFL

SEQ ID NO: 19330 - DNA, 676 bp, Zea mays
  misc_feature: Ceres CLONE 1386442-F
  misc_feature: Translation starting site: 221
  misc_feature: SWISSPROT Homolog: EC 5.5.1.4 Inositol-3-phosphate synthase
  misc_feature (409)..(409): n is a, c, t, g, unknown, or other
  misc_feature (423)..(423): n is a, c, t, g, unknown, or other
  misc_feature (428)..(428): n is a, c, t, g, unknown, or other
  misc_feature (477)..(477): n is a, c, t, g, unknown, or other
  misc_feature (560)..(560): n is a, c, t, g, unknown, or other
  misc_feature (570)..(570): n is a, c, t, g, unknown, or other
  misc_feature (577)..(577): n is a, c, t, g, unknown, or other
  misc_feature (618)..(618): n is a, c, t, g, unknown, or other
  misc_feature (637)..(637): n is a, c, t, g, unknown, or other
aaagctggagctccccgcggtggcggccgctctagaactagtggatcccccgggctgcaggaattcgcacgagaccattacctagaacatcctaatcgaaaaacacaacccaaagcagccacagcagcctccttcctcctctcactctcgctcgtgctgcgctcgctacctcgcttcgcattccattcgaggagagcggtgagaggggaggaaaggcaagatgttcatcgagagcttccgcgtcgagagcccccacgtgcggtacggcccgacggagatcgagtcggagtaccggtacgacacgacggagctggtacacgagggcaaggacggcgcctcacgctgggtcgtccgccccaagtccgtcaagtacaacttccggaccagaaccgccgtccccaagctcggngtgatgcttgtggngtggngaggcaacaacgggtccacgctgacggctggggtcattggccacagggnaggggatctcatgggcgaccaagggacaggtgcagcaagccaactactacggctccctcacccaggcctccaccatcagagtncgcagctacnacggggnaggagatctatgcgcccgttcagagcctccttcccatggtnggaccagacgacattgtgntcgggaggctgggacattagcaacatggaactgggcgag

SEQ ID NO: 19331 - DNA, 746 bp, Zea mays
  misc_feature: Ceres CLONE 1386446-F
  misc_feature: Encodes the peptide sequence at SEQ ID NO. 19332
  misc_feature (475)..(475): n is a, c, t, g, unknown, or other
  misc_feature (509)..(509): n is a, c, t, g, unknown, or other
  misc_feature (689)..(689): n is a, c, t, g, unknown, or other
aaaagctggagctccccgcggtggcggccgctctagaactagtggatcccccgggctgcaggaattcgcacgagaccattacctagaacatcctaatcgaaaaaccgccaccgggatggccggagttcccgccaccttctcctcagccaccgctcagatcgggggcttcctctcgaagaagccttacgcgccgccgttgtgggccacgcacctctcccccatgccttgccataccttctcgctcggccatttcccaacaccgattcacaagtggaatctgcccaatttgccggaaggaacggaagtgtggatcaagcgagacgatttatcaggcatgcagttgagtggaaacaaggtccggaagctggagttcttgatggcagatgccgtagcacaaggcgcggactgcgttattactgttgggggtatacagagtaaccactgccgtggcacagccgtggctgctaagtatctncatcttgattgctacctgatactacgtacctccnagcttcttgtggataaggaccctggtttgtttggcaatcttcttgtcgagagactagttggggcacacgttgatcttgtgtcaaaaagaagatatggaaaaatgggcagtgtggctttagctgacctgctgaaaaaaaggcttctggaagaagggaggaaagcgtatgtgatttcctggntggtggatccaactcattggggacttgggggatatattgaggcaataaggaagattg

SEQ ID NO: 19332 - protein, 210 aa, Zea mays
  misc_feature: Ceres CLONE 1386446-F
  misc_feature: SWISSPROT Homolog: EC 3.5.99.7 1-aminocyclopropane-1-carboxylate deaminase
  misc_feature (132)..(132): Xaa is any aa, unknown, or other
  misc_feature (192)..(192): Xaa is any aa, unknown, or other
MAGVPATFSSATAQIGGFLSKKPYAPPLWATHLSPMPCHTFSLGHFPTPIHKWNLPNLPEGTEVWIKRDDLSGMQLSGNKVRKLEFLMADAVAQGADCVITVGGIQSNHCRGTAVAAKYLHLDCYLILRTSXLLVDKDPGLFGNLLVERLVGAHVDLVSKRRYGKMGSVALADLLKKRLLEEGRKAYVISWXVDPTHWGLGGYIEAIRKI

SEQ ID NO: 19333 - DNA, 742 bp, Zea mays
  misc_feature: Ceres CLONE 1386448-F
  misc_feature: Encodes the peptide sequence at SEQ ID NO. 19334
  misc_feature (359)..(359): n is a, c, t, g, unknown, or other
  misc_feature (590)..(590): n is a, c, t, g, unknown, or other
aaagctggagctccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggncttaccgcttcagacgatgccagtgatgatgccacagatgatgacgcctaacatgatgtcaccattgatgatgccgagcatgatgtcaccaatggtctttgcgagcatgatgtcgcaaatgatgatgccacaatgtcactgcgacgccgtctcgcagattatgctgcaacagcagtttacattcatggtccaccccatggccatgacgattccaccccatggtcttacagnaacccctttggttggggctgcattctaaataaaaaaaatttggggttggaccaaaaaaaggagttgacctggcccccccggggggctcctttttaaacaataaaaacaagttttccctttttttccccaaaaaaaaaaaaaaaatgttctca

SEQ ID NO: 19334 - protein, 151 aa, Zea mays
  misc_feature: Ceres CLONE 1386448-F
  misc_feature (66)..(66): Xaa is any aa, unknown, or other
  misc_feature (143)..(143): Xaa is any aa, unknown, or other
MAAKMLALFALLALCASATSATHIPGHLPPVMPLGTMNPCMQYCMMQQGLASLMACPSLMLQQLLXLPLQTMPVMMPQMMTPNMMSPLMMPSMMSPMVFASMMSQMMMPQCHCDAVSQIMLQQQFTFMVHPMAMTIPPHGLTXTPLVGAAF

SEQ ID NO: 19335 - DNA, 698 bp, Zea mays
  misc_feature: Ceres CLONE 1386450-F
  misc_feature: Encodes the peptide sequence at SEQ ID NO. 19336
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcgaaaaaagtttaggaaaggaagcaccggagcaggcgatacggcgccgacgacaatggcagcaacaagggcttccccagtgcttctcttgctgctcaccgtccagctcagcttgctcttccgcctccccgactccccctccaccctcgccctcgccctcgccgcggaaccagagcaacagaacgccaagcagcatcgccagcccgcgctgctggtgcagtcgacgtgcaactccaccagcttctacgacctctgcatcgccgcgctcgccgccgaccccgccagctccaccgccgacgtcccgggcctcggcgccatcgccgtgtccgccgccgcaaacaacgcctccggcacggccgccttcctcggcaacgccagcgacgccgcggccaccccgcaggcggaccgcgcgctcctccgcgcctggcgcgggaagtacgccgccgcccgcgacgcgctcgtgcaggcgcgcgcgtccctcggcgagcaggcctacgactacgccttcgtgcacgtgagcgccgccggcgaataccccgcgttgtgccgcacgctgntccgggcgccgaagcagcagcagcggtggggcgagtaggcctgcga

SEQ ID NO: 19336 - protein, 179 aa, Zea mays
  misc_feature: Ceres CLONE 1386450-F
  misc_feature (168)..(168): Xaa is any aa, unknown, or other
MAATRASPVLLLLLTVQLSLLFRLPDSPSTLALALAAEPEQQNAKQHRQPALLVQSTCNSTSFYDLCIAALAADPASSTADVPGLGAIAVSAAANNASGTAAFLGNASDAAATPQADRALLRAWRGKYAAARDALVQARASLGEQAYDYAFVHVSAAGEYPALCRTLXRAPKQQQRWGE

SEQ ID NO: 19337 - DNA, 777 bp, Zea mays
  misc_feature: Ceres CLONE 1386453-F
  misc_feature (107)..(107): n is a, c, t, g, unknown, or other
  misc_feature (148)..(148): n is a, c, t, g, unknown, or other
  misc_feature (236)..(236): n is a, c, t, g, unknown, or other
  misc_feature (259)..(259): n is a, c, t, g, unknown, or other
  misc_feature (270)..(270): n is a, c, t, g, unknown, or other
  misc_feature (312)..(312): n is a, c, t, g, unknown, or other
  misc_feature (326)..(326): n is a, c, t, g, unknown, or other
  misc_feature (343)..(343): n is a, c, t, g, unknown, or other
  misc_feature (440)..(440): n is a, c, t, g, unknown, or other
aaagctggagctccccgcggtggcggccgctctagaactagtggatcccccgggctgcaggaattcgcacgagaccattacctagaacatcctaatcgaaaactcanacggttaaacccatgccgctaatcgacgccgccgcctcggnggtcgcgccgcccccaccccggcgagtggctcaactccgcttcttcagcactcgcagacccggaatccctatcctaactgggcacagntggtcccccctcccctcgccccnggtcgctgcgnaggtgcctgcgcccgcacaggaagcgaagtcgaaagcgaggnccacggcgtacccngaagcagtaccccgccnagtcggtggcccgtgctgaagaaatagccttttgtccgcatggcgctgggtaaccccaagcgaccaccataaaaaacaaatcggaacggaggaaccnaacccccggggcggggggttcaaagggcaaagtttaagaaaacacccggggcgggtaaaggggaaccccggggggggggtggggggactccaagaaggggaaagggcccccccagtgggggggttccgggaaaacccggggggaaaaaattcttttctgaaaaccgaaggggggggggggggaaccccccggtggccttttttttttctaaaaaaaggggggggggggccccccaacctcaaaaaaaagggggggggggaaaaaaagaggggtgtttccccccagggtgttttgtgaaaataatttggttttttgggggggggggggggaagacccc

SEQ ID NO: 19338 - DNA, 806 bp, Zea mays
  misc_feature: Ceres CLONE 1386455-F
  misc_feature: Encodes the peptide sequence at SEQ ID NO. 19339
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (806)..(806): n is a, c, t, g, unknown, or other
tttctcccccctcaccccttttcctaagtatgatccnnnntctaattttttcaatactggtgctccccgcggtggcggccgctctagaactagtggatcccccgggctgcaggaattcgcacgagaccattacctagaacatgataaacaactcgcagatcgagtccatgcattcaccggagaatcccaaatcacactctccagtaaccgtccgctactccagccgcatctctagccgagtctatctcctcctcctccaccgccgcagctatcctaatggctcgcttcgccgtggtcgccgccatcgtcgccctcctcgccgtcgtcgcggcggcgcaggccccggccgccaccccgaccacggctcccaaggccgcgcccaggatggccccgctgccgcctccccctgtttggtccccggcccacagccccggggccggccgccaagccgccgacaggccggcgggccggcccccgctggactctcctccggccccgcccaacgagggcccccgcggcctcttgcgccgtccgggaaaggccccgacctcagaccgtattccgaaaaccccggcacgggcgccccccaccgatcgcgcccttccaggtagcagggggctcgacctcgcggcgccctccgagcctctggttttcttcccaccgtatacccggccgggggtcgtcaaaccgcatcctctattgttcttaaaaacgcccccccacccggactcccgtcactaaccagagaaagatagctcatgtcatatatacaccacacgccgtgtgtacttcacccaaccgtgggn

SEQ ID NO: 19339 - protein, 154 aa, Zea mays
  misc_feature: Ceres CLONE 1386455-F
  misc_feature: SWISSPROT Homolog: EC 2.4.1.244 N-acetyl-beta-glucosaminyl-glycoprotein 4-beta-N-acetylgalactosaminyltransferase
MARFAVVAAIVALLAVVAAAQAPAATPTTAPKAAPRMAPLPPPPVWSPAHSPGAGRQAADRPAGRPPLDSPPAPPNEGPRGLLRRPGKAPTSDRIPKTPARAPPTDRALPGSRGLDLAAPSEPLVFFPPYTRPGVVKPHPLLFLKTPPHPDSRH

SEQ ID NO: 19340 - DNA, 645 bp, Zea mays
  misc_feature: Ceres CLONE 1386457-F
  misc_feature (193)..(193): n is a, c, t, g, unknown, or other
  misc_feature (196)..(196): n is a, c, t, g, unknown, or other
  misc_feature (206)..(206): n is a, c, t, g, unknown, or other
  misc_feature (207)..(207): n is a, c, t, g, unknown, or other
  misc_feature (220)..(220): n is a, c, t, g, unknown, or other
  misc_feature (223)..(223): n is a, c, t, g, unknown, or other
  misc_feature (224)..(224): n is a, c, t, g, unknown, or other
  misc_feature (255)..(255): n is a, c, t, g, unknown, or other
  misc_feature (288)..(288): n is a, c, t, g, unknown, or other
  misc_feature (334)..(334): n is a, c, t, g, unknown, or other
  misc_feature (340)..(340): n is a, c, t, g, unknown, or other
  misc_feature (372)..(372): n is a, c, t, g, unknown, or other
caaagctggagctccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaacaccaaaagcatgccgccgnccngtcgcaaggnngcaccccgcgcgncgnncgcgcgagggacgacatgtccccccgcgagnccagctgcgatgatggactgcgaacatgtgtcngtgccatgcgcttgcgccggatccgctggcgtgccgccggtggggngggggnccaacggccatgcagggcgactcctccggggncaccgaacgtcggctggaggtgtccctgttggtcgcgggtttcaaacacgagaccccccccggggggattcctccccggggcccccggggcggcccccggggctataacaaaaggtagaccaaagcgggggggggggggcccccagagggggtgtcccccggggcaaatttttcggcaaaaatttttcctttcttttaaagagaagagccacccgggggtgcccgcggggggggggaaattctgtggggcgccccaaataagggggggggggt

SEQ ID NO: 19341 - DNA, 638 bp, Zea mays
  misc_feature: Ceres CLONE 1386496-F
  misc_feature: Translation starting site: 196
  misc_feature (433)..(433): n is a, c, t, g, unknown, or other
  misc_feature (447)..(447): n is a, c, t, g, unknown, or other
aagctggagctccccgcggtggcggccgctctagaactagtggatcccccgggctgcaggaattcgcacgagaccattacctagaacatcctaatcgaaaactttttcctagggtttcgtcgcttccagccgccgccgcgtccgcctcgccaagcgcagcagccgccgcagcacatctctctctcgatctcagccatggcggaggtggagcagcaacaggacacgccgaagctgctcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaaggcgcagtgcccgatcgtcgagcgcctcactaactccctcatgatgcacgggcgcaacaacgtnaagaaggtaatggntggccgcatcatcaagaataccctggagattcttcacctggtcaccgatggcaaccccatcaaaggcgtcggctacggaaaaataaccaggggaaccggtgaggaagcccaccccaatgggttccccttgggggttggagagaagaaaaccccgggaaatttccaccccggggaggggggaacccagcccc

SEQ ID NO: 19342 - DNA, 639 bp, Zea mays
  misc_feature: Ceres CLONE 1386506-F
  misc_feature: Encodes the peptide sequence at SEQ ID NO. 19343
  misc_feature (571)..(571): n is a, c, t, g, unknown, or other
  misc_feature (633)..(633): n is a, c, t, g, unknown, or other
aagctggagctccccgcggtggcggccgctctagaactagtggatcccccgggctgcaggaattcgcacgagaccatacctagaacatcctaatcggaactccaaagtttcgtccaccatttcgctcccgcaagcaccgatttgtttactgctctctccgacgcgcggcggcggagctccctacgacgactgaaccatgtgcggcggcgcgatccttgccaaccttcgcgagccggcgccgcgccggctcacagagcgggacatctggcagcagaaaaagaagctcaagaggggcggcggcggcgggaggcgctcgttcgcggcggaggacgatgaggacttcgaggccgactttgaggtcttcgaggccgactccagtgattcagatttggagctcagggaggggactgacgacgacgtcgtcgagatcaagcccttcactgccaagaggactttctccagcgatggcttaagcaccatgactagtgctgtagcaaggtcagccaagaggaagagaaagaatctatacaggggtatccgccagcggccttgggggcaagtgggctgctgnagatcagagatcttcagaagggggggggccgggggtttggcttggaacttttcatagttccntgagga

SEQ ID NO: 19343 - protein, 143 aa, Zea mays
  misc_feature: Ceres CLONE 1386506-F
  misc_feature (125)..(125): Xaa is any aa, unknown, or other
MCGGAILANLREPAPRRLTERDIWQQKKKLKRGGGGGRRSFAAEDDEDFEADFEVFEADSSDSDLELREGTDDDVVEIKPFTAKRTFSSDGLSTMTSAVARSAKRKRKNLYRGIRQRPWGQVGCXRSEIFRRGGAGGLAWNFS

SEQ ID NO: 19344 - DNA, 651 bp, Zea mays
  misc_feature: Ceres CLONE 1386513-F
  misc_feature: Encodes the peptide sequence at SEQ ID NO. 19345
  misc_feature (269)..(269): n is a, c, t, g, unknown, or other
  misc_feature (651)..(651): n is a, c, t, g, unknown, or other
aagctggagctccccgcggtggcggccgctctagaactagtggatcccccgggctgcaggaattcgcacgagaccattacctagaacatcctaatcgaaaattttacacgcccccttctctctcgatttctcgcggagcggccctccacctttatcgccgccgccgccgttgctgtgttccgtctcttcgccgatggcttcggccaagttcggtgctgcccagcaggtggagaaccgaggcgcgctgtccaaaaggtcacgtaacgagntgtctgtaagggagggggactggaattgtcctcagtgtggtaatgtcaacttcagttttagaaatgtttgcaaccgtggagcctgtggtgcaccccgtccatcaccgagtccaagtccaagaatgatgtcaggacctcctgcttctggatatgaccggcactcatttacgggggggggggggggggggggcgccccaccctccaattccgcttggaactggttagctatggtgctccatatccacaccttgggatgcgataatggctatggtccaccagagggacctctgggttccatacggtcttttctcttcatatggtccactgggccaatgggatggaaatggggatatggcccaggacctgagctaggcgatattan

SEQ ID NO: 19345 - protein, 152 aa, Zea mays
  misc_feature: Ceres CLONE 1386513-F
  misc_feature (29)..(60): Pfam Name: zf-RanBP Pfam Description: Zn-finger in Ran binding protein and others
  misc_feature (26)..(26): Xaa is any aa, unknown, or other
MASAKFGAAQQVENRGALSKRSRNEXSVREGDWNCPQCGNVNFSFRNVCNRGACGAPRPSPSPSPRMMSGPPASGYDRHSFTGGGGGGGAPPSNSAWNWLAMVLHIHTLGCDNGYGPPEGPLGSIRSFLFIWSTGPMGWKWGYGPGPELGDI

SEQ ID NO: 19346 - DNA, 631 bp, Zea mays
  misc_feature: Ceres CLONE 1386514-F
  misc_feature: Encodes the peptide sequence at SEQ ID NO. 19347
  misc_feature (524)..(524): n is a, c, t, g, unknown, or other
  misc_feature (525)..(525): n is a, c, t, g, unknown, or other
  misc_feature (574)..(574): n is a, c, t, g, unknown, or other
  misc_feature (575)..(575): n is a, c, t, g, unknown, or other
  misc_feature (631)..(631): n is a, c, t, g, unknown, or other
tggagctccccgcggtggcggccgctctagaactagtggatcccccgggctgcaggaattcgcacgagaccattacctagaacatcctaatcgaaaactttcctctccgatccggatctccccacccgctccggcgagccatcgccgcgtcgcctccacgcgaccgactacttctcatatcaatctatctatccggcttacccgccgccgcacgcaccaaggttgcgttcaccatattacctgtttgcttatcttctcccgagcccagcaaaccctagccgccgccacccatggacatagaggccgacggacgattcggcaacaaacgagtgcacaatcgcctaggcccgggctccggcggcgctccaccatctaccaacggaaaggtctgcaactactggcgtgccggtcggtgcaaccgctttccgtgccccttcctccacagcgagctccccgaggctgcgccgcccaagcgccccactggacccgggggggaacgtatggcgcaaccccaacaccggagnngacgaggaggtggcatcacatagaaatgggggaagggcccaggaggggnncagcgggattgcgagccacaagccgcctgagagggcctggcagacttttctcgcgn

SEQ ID NO: 19347 - protein, 85 aa, Zea mays
  misc_feature: Ceres CLONE 1386514-F
  misc_feature (78)..(78): Xaa is any aa, unknown, or other
  misc_feature (79)..(79): Xaa is any aa, unknown, or other
MDIEADGRFGNKRVHNRLGPGSGGAPPSTNGKVCNYWRAGRCNRFPCPFLHSELPEAAPPKRPTGPGGERMAQPQHRXXRGGGIT

SEQ ID NO: 19348 - DNA, 666 bp, Zea mays
  misc_feature: Ceres CLONE 1386532-F
  misc_feature: Encodes the peptide sequence at SEQ ID NO. 19349
  misc_feature (388)..(388): n is a, c, t, g, unknown, or other
  misc_feature (400)..(400): n is a, c, t, g, unknown, or other
  misc_feature (401)..(401): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (456)..(456): n is a, c, t, g, unknown, or other
  misc_feature (485)..(485): n is a, c, t, g, unknown, or other
  misc_feature (490)..(490): n is a, c, t, g, unknown, or other
  misc_feature (568)..(568): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagggacggagtggtcgaacgggaccgcaaggaggacctgcggtggtgcaagcaggcgtggcgagtggcagtacggaaaggacaccccgcgnaagagggatgcnnaagagcgagtgccgcgagcggcaccagcaagctgacgcgnnncgaggacggcganaagcgggcgtgggacgcctacgctccgcntcggnaaggggggggggaggtggccggcgccagtgcctgcgcccgccacgagggccaaggccgtgggagaaccccaggagggnctttgaggcgggtgccgccgcccgcgaactggccgtcgacattggaaccaagaagtaacggtcgcggcagcgaagagcgcggccaagtggccgggaaa

SEQ ID NO: 19349 - protein, 138 aa, Zea mays
  misc_feature: Ceres CLONE 1386532-F
  misc_feature (60)..(60): Xaa is any aa, unknown, or other
  misc_feature (64)..(64): Xaa is any aa, unknown, or other
  misc_feature (78)..(78): Xaa is any aa, unknown, or other
  misc_feature (83)..(83): Xaa is any aa, unknown, or other
  misc_feature (94)..(94): Xaa is any aa, unknown, or other
  misc_feature (120)..(120): Xaa is any aa, unknown, or other
MGKGSVGASWWAFLLLAGVLLVVAATAGAEGRSGRTGPQGGPAVVQAGVASGSTERTPRXRGMXKSECRERHQQADAXRGRRXAGVGRLRSASXRGGGGGRRQCLRPPRGPRPWENPRRXFEAGAAARELAVDIGTKK

SEQ ID NO: 19350 - DNA, 637 bp, Zea mays
  misc_feature: Ceres CLONE 1386533-F
  misc_feature: Encodes the peptide sequence at SEQ ID NO. 19351
  misc_feature (370)..(370): n is a, c, t, g, unknown, or other
  misc_feature (465)..(465): n is a, c, t, g, unknown, or other
  misc_feature (496)..(496): n is a, c, t, g, unknown, or other
  misc_feature (501)..(501): n is a, c, t, g, unknown, or other
  misc_feature (502)..(502): n is a, c, t, g, unknown, or other
aaagctggagctccccgcggtggcggccgctctagaactagtggatcccccgggctgcaggaattcgcacgagaccattacctagaacatcctaatcgaaaaattccgcttgcttgattgctccaggtacctccattcgcagtcggccgtgtcctcggagccgcgggagatggcggatcaggagaccgtagctgtggttgaggcaccaaccccggttcttggggaaccgatggacctgatgactgccctgcagctcgtcatgaagaagtcaggtgctcacgatggccttgtgaagggtcttcgtgaggctgccaaagccatcgagaagcatgccgctcagctctgcgtgcttgccgaggactgcgaccancctgattatgtcaaggctggtgaaggctctctgcgctgagcacaatgtccaccctggttactgtgcctagcgcaaaactctttggagaaggtggnctgggcttttgcaagatcgactctgaggcanggggnnagggaaaggttggagcctgctcctttgggggttgtttggcaaggacttacggcgaaaaaatctgaaagccttaaactaagggggcgaggagtacgtcaaatcgactaagaaccaagtgtgcgaaaattttggggg

SEQ ID NO: 19351 - protein, 79 aa, Zea mays
  misc_feature: Ceres CLONE 1386533-F
  misc_feature (67)..(67): Xaa is any aa, unknown, or other
MADQETVAVVEAPTPVLGEPMDLMTALQLVMKKSGAHDGLVKGLREAAKAIEKHAAQLCVLAEDCDXPDYVKAGEGSLR

SEQ ID NO: 19352 - DNA, 568 bp, Zea mays
  misc_feature: Ceres CLONE 1386534-F
  misc_feature (96)..(96): n is a, c, t, g, unknown, or other
  misc_feature (412)..(412): n is a, c, t, g, unknown, or other
  misc_feature (417)..(417): n is a, c, t, g, unknown, or other
tggagctccccgcggtggcggccgctctagaactagtggatcccccgggctgcaggaattcgcacgagaccattacctagaacatcctaatcgaanaatcaaccatattattgagaccaacaagcaacatagaaggtggaatccagtagcaacaacagagcaacaatggcgaccaagatattttccctccttatgctccttgctctttctgcatggtgtgctaacgcgaccatttcccctcatgctcaccagctcctatagcttccttcttcccccatacttccatcaatgaagcctcaggatgtgaaaaacaggtctttcagcctatatggtcccaacaagcatcgcagcaagcacataaccttataacccctggtgggtcacaaacgccacgcccatcttttggggaggnctttngaccaaacaactagggacaagaagatgtgaaaaatcgtggtaaacgggagaaaacccagaaatcttgggaaacttttttcccaaacttcaggaaaaaaaattttctccatttcaccaaatgggtaaacgggaacctgggggggttattttg

SEQ ID NO: 19353 - DNA, 647 bp, Zea mays
  misc_feature: Ceres CLONE 1386540-F
  misc_feature: Encodes the peptide sequence at SEQ ID NO. 19354
  misc_feature (419)..(419): n is a, c, t, g, unknown, or other
  misc_feature (523)..(523): n is a, c, t, g, unknown, or other
  misc_feature (530)..(530): n is a, c, t, g, unknown, or other
  misc_feature (541)..(541): n is a, c, t, g, unknown, or other
  misc_feature (562)..(562): n is a, c, t, g, unknown, or other
  misc_feature (588)..(588): n is a, c, t, g, unknown, or other
  misc_feature (636)..(636): n is a, c, t, g, unknown, or other
aaagctggagctccccgcggtggcggccgctctagaactagtggatcccccgggctgcaggaattcgcacgagaccatttacctagaacatcctaatcaaaaatcatctccagcggcttcttccaaagctccaactacgacgagaaccgccactcctcgaaatctccaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccaagctcgagtccatggagccctgctccagcgtcaaggataggattggctacagcatgatcacggacgcagaggagaaagggctgattactcagggccgtgangtgttctgattgaaccaactagcggcaacacaggcattggacttggcctttatggctgctgccaagggctacaaacttacactcacaatgcctgcctcctgagncatgggnagaggagatcnatattgaaaagggtttttggnggctgaacttgtccttactgaccccntcctggggatgggaaaaggagctggtcaggaaagcgggaagagatacnagcaaagacac

SEQ ID NO: 19354 - protein, 73 aa, Zea mays
  misc_feature: Ceres CLONE 1386540-F
  misc_feature: SWISSPROT Homolog: EC 2.5.1.47 Cysteine synthase
  misc_feature (71)..(71): Xaa is any aa, unknown, or other
MGEASPSIAKDVTELIGNTPLVYLNKVTDGCVGRVAAKLESMEPCSSVKDRIGYSMITDAEEKGLITQGRXVF

SEQ ID NO: 19355 - DNA, 627 bp, Zea mays
  misc_feature: Ceres CLONE 1386541-F
  misc_feature: Translation starting site: 226
  misc_feature: SWISSPROT Homolog: EC 2.4.1.207 Xyloglucan:xyloglucosyl transferase
  misc_feature (518)..(518): n is a, c, t, g, unknown, or other
aagctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcggtcgcgggctggacctgacgctggaccgcacgtccggctccggggtcagtccaagagcgagtacctgttcggcagaatcgacatgcagatcaagctggtgccaggcaactcccgtggcacggtcaccaccttctacctgtcgtcccagggcgacggncacgacgagatcggacttcgagttcctgggcaacggtgagcggggagccctacacgctgcacaccaacgtgttcacgcgcggacggggccaggggggagcagcagttcc

SEQ ID NO: 19356 - DNA, 634 bp, Zea mays
  misc_feature: Ceres CLONE 1386543-F
  misc_feature: Encodes the peptide sequence at SEQ ID NO. 19357
  misc_feature (176)..(176): n is a, c, t, g, unknown, or other
  misc_feature (259)..(259): n is a, c, t, g, unknown, or other
  misc_feature (356)..(356): n is a, c, t, g, unknown, or other
gctggagctccccgcggtggcggccgctctagtactagtggatcccccgggctgcaggaattcgcacgagaccattacctagaacatcctaatcgaaaaacctagaagtctccaccctcctgcgcctccaccctcctcgccgcctcactccctctgaggtcgcagatccgcccggntagacgaaggcgcccgcacccatggcctccggggagatcgactgcacctacgccgccctcatcctcagtgactacggcatcgnaatgaccgccgataagatcgcctccatcgtgaaggcgtccaacatcaaggtcgagtcctactggtcgccgctcttcgctaagctcctggagaagagnagtgttgagcatccaatcctctccgttggatctggaggtggcgctgctccagttgctgctgccgccccagctggaggcgctgcagctgctgatgcccctgctgcagaggaaaacaaggaagagcccaagcaggagtctgatgacgacatgggcttcagcctggttcactgaggagggcctcgctaaccaggcattaagaaactcccctatgctcgccaagacttatcctacgctatgcccggagccttttggtattaccaggactccaggtttgagtt

SEQ ID NO: 19357 - protein, 109 aa, Zea mays
  misc_feature: Ceres CLONE 1386543-F
  misc_feature (21)..(108): Pfam Name: Ribosomal_60s Pfam Description: 60s Acidic ribosomal protein
  misc_feature (21)..(21): Xaa is any aa, unknown, or other
  misc_feature (53)..(53): Xaa is any aa, unknown, or other
MASGEIDCTYAALILSDYGIXMTADKIASIVKASNIKVESYWSPLFAKLLEKXSVEHPILSVGSGGGAAPVAAAAPAGGAAAADAPAAEENKEEPKQESDDDMGFSLVH

SEQ ID NO: 19358 - DNA, 650 bp, Zea mays
  misc_feature: Ceres CLONE 1386555-F
  misc_feature (398)..(398): n is a, c, t, g, unknown, or other
  misc_feature (519)..(519): n is a, c, t, g, unknown, or other
  misc_feature (625)..(625): n is a, c, t, g, unknown, or other
  misc_feature (632)..(632): n is a, c, t, g, unknown, or other
aaagctggagctccccgcggtggcggccgctctagaactagtggatcccccgggctgcaggaattcgcacgagaccattacctagaacatcctaatcgaaaagggagaaaatctccaaacgcagcagagcccctcgcgccgccggcctcttcagccttgcagcacaccgccgccagcccgagtgaccgctgcagcctaggtttccggcgcgttgggcgggtaagggagggaagggtctgctggcggccaagacgacggcggccaagagcaccgacaaggacaaggacaggaagaaggcccccgtgtcgcgctcttcccgcgccggcctccagttcccggtgggtcgcatccaccgccagctcaagtcgcgtgcctctgcgcacggccgcgtcggcgcnaccgccgccgtctattccgccgccatcctcgagtaccaaaccgccgaggtcctcgagctggccggcaacgctagcaaggacctcaaggtcaagcgcatcaccccgcgccacctgcagtcgncatcccgcggggggacgaggagctcgacaccctcatcagggcaccatcgggcgggggggcggcgtcatcccgcacatccacaagtcgctcatcaacagacccgccnaggaggnaaatcaaaggccgtgctg

SEQ ID NO: 19359 - DNA, 871 bp, Zea mays
  misc_feature: Ceres CLONE 1386557-F
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
gaggtcccccatcccccctttggcgaccccctgtcgcccgccgcgagggtgggtgccggcgggcgtttattnnnnnnnnnnnnnnaaaagctggagctccaccgcggtggcggccgctctataactagtggatcccccgggctgcaggaattcgcacgagaccatacctaaaacattctaatcgaaaagtctcaggttgcggccgaaccagagccccgtcccaactcccccacctctcttctctacggcgcgagcaagggcggcgccggccgcgacgtagacgaaaaccgggcctcgctctccccatctctccgatcacttctgtcctgtgaaaatggcggatgaactacgctcaacgcctgcgggtaagaagttccatgggccagtccgcgcctgttgaacacaaatgtctttcccattgcggcgatggaaaaaccctggaattccacaaatgggctaatttctggtttaagaaaggtggccgcgaggaggccccttaatccctggccacctgaatcggcacccgggcctcggacctcctgacatccggggtaattggggaaaccaattgctccccgtggctcttttggctctttctcgcgccccccaagagaacagcaaccgcggcctttttttctggcgcatttttaccggcatgcccaagttttatatggaacggccccgcggcagtcttacctgggtggcgcgggcgcgcgcaaaaaagcacggtttgccctccttccgtgaatctgcgagggcggtgccaacggcttttttgccccccccggaacacccggcggagcgcacttgggtctcttcaactcggggacgcccatttatcccgcacaccccctccagccggggcaaccag

SEQ ID NO: 19360 - DNA, 648 bp, Zea mays
  misc_feature: Ceres CLONE 1386560-F
  misc_feature: Translation starting site: 205
  misc_feature: SWISSPROT Homolog: EC 5.3.3.2 Isopentenyl-diphosphate Delta-isomerase
  misc_feature (393)..(393): n is a, c, t, g, unknown, or other
  misc_feature (460)..(460): n is a, c, t, g, unknown, or other
  misc_feature (526)..(526): n is a, c, t, g, unknown, or other
  misc_feature (592)..(592): n is a, c, t, g, unknown, or other
  misc_feature (624)..(624): n is a, c, t, g, unknown, or other
aagctggagctccccgcggtggcggccgctctagaactagtggatcccccgggctgcaggaattcgcacgagaccattacctagaacatcctaatcgaaaaacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttccttttncactcaaaatatgagctgctacttcagcaaaggtccgcgacaaaggttaccttttcctttagtttgnaccaatacctgctgcagccaccctctgtaccgtgagtctgagcttatccaggagaactaccttggntgtgagaaatgcagcacagaggaagctactggatgagctgggcatcccagcagaagatgccccagntgaccatttcaccctctgggccgatgctttancagcacatctgacggggaatgggg

SEQ ID NO: 19361 - DNA, 641 bp, Zea mays
  misc_feature: Ceres CLONE 1386561-F
  misc_feature: Translation starting site: 471
  misc_feature (358)..(358): n is a, c, t, g, unknown, or other
  misc_feature (359)..(359): n is a, c, t, g, unknown, or other
  misc_feature (376)..(376): n is a, c, t, g, unknown, or other
  misc_feature (409)..(409): n is a, c, t, g, unknown, or other
  misc_feature (433)..(433): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgnncggtcacctgccaccgncggtccatgtgccgcccgcggttcatctgccgncgccaccatggcactaccctactncaccgccccgggctcagcctcatccccagccacacccatgccccgtgccacagccgcatccaagccccgtgcagctgcagggaaccctgcggcgttgcagcaccccgatcctgggccagtgcgtcgagttccctgagcatcagtgcagcccgacggcgacgccctactgctcgcctcagtggcagtcgttgcgggcagcagtgttgcc

SEQ ID NO: 19362 - DNA, 607 bp, Zea mays
  misc_feature: Ceres CLONE 1386562-F
  misc_feature: Encodes the peptide sequence at SEQ ID NO. 19363
  misc_feature (255)..(255): n is a, c, t, g, unknown, or other
  misc_feature (294)..(294): n is a, c, t, g, unknown, or other
  misc_feature (295)..(295): n is a, c, t, g, unknown, or other
  misc_feature (301)..(301): n is a, c, t, g, unknown, or other
ggagctccccgcggtggcggccgctctagaactagtggatcccccgggctgcaggaattcgcacgagaccattacctagaacatcctaatcgaaaactctcgatgaggaaatggaattcaaagaatttgcacagaggccagatgcatatgccaagctctgctcaatgattggtccttcaatttatggtcattctgatgtcaagaaagctattgcatgcttgttatttggggggtctaagaagagctacctgatgntgtacgtttgagaagggacattcatgtcttgcttctggnngacccnatccacagcaaaatcacagttcctcaaatttgtaaagaagactgcccctattgcagtctatacctctggcaaaggttcatctgcagctgggcttaaggaatcggaacttcggataaaacttcccgccaggtttttttggaaaggagaaccatggttttggctggggggggagaattttggtcccagaatttgaaaaatgcgccctgaaaacaaggggggatttccgggggccgggggccccaaaaaaatttttttgccaaaaggggggtttaaaaaaggccccctttttggggttttctttttttg

SEQ ID NO: 19363 - protein, 51 aa, Zea mays
  misc_feature: Ceres CLONE 1386562-F
  misc_feature (49)..(49): Xaa is any aa, unknown, or other
MEFKEFAQRPDAYAKLCSMIGPSIYGHSDVKKAIACLLFGGSKKSYLMXYV

SEQ ID NO: 19364 - DNA, 639 bp, Zea mays
  misc_feature: Ceres CLONE 1386563-F
  misc_feature: Encodes the peptide sequence at SEQ ID NO. 19365
  misc_feature (175)..(175): n is a, c, t, g, unknown, or other
  misc_feature (176)..(176): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (199)..(199): n is a, c, t, g, unknown, or other
  misc_feature (203)..(203): n is a, c, t, g, unknown, or other
  misc_feature (308)..(308): n is a, c, t, g, unknown, or other
  misc_feature (459)..(459): n is a, c, t, g, unknown, or other
tggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctnnagcctagcnnncttttagttcgntcgnagggaggagcaagaagggcgcgcacgcaagcaggcaagcaagagagagcgatcgacgagagctagcacgcgatggcgaggccttccaagatgaatggtggggggncagcctctcggctgggccctttgggccccggggcgcggtgttttccccggccgggggggggaaattttgagacccccccccccccccaaaaaaaaggcccccccccggggggggtgaaaacccaaaaaaaaatttttcccccccgtctttnccgcagcgccggggagggggggggccccccccggggggtggggggcccccccccggggggtatatttcctggggaaaaaattttccccggttaaaaaggggccccggggggggggaaaacccaccccccctttttgttttgccggggagggggcgccccttctttttttggggggggcct

SEQ ID NO: 19365 - protein, 92 aa, Zea mays
  misc_feature: Ceres CLONE 1386563-F
  misc_feature (12)..(12): Xaa is any aa, unknown, or other
  misc_feature (62)..(62): Xaa is any aa, unknown, or other
MARPSKMNGGGXASRLGPLGPGARCFPRPGGGNFETPPPPQKKGPPPGGVKTQKKIFPPRLXRSAGEGGGPPRGVGGPPPGGIFPGEKIFPG

SEQ ID NO: 19366 - DNA, 627 bp, Zea mays
  misc_feature: Ceres CLONE 1386564-F
  misc_feature: Translation starting site: 287
  misc_feature (376)..(376): n is a, c, t, g, unknown, or other
  misc_feature (379)..(379): n is a, c, t, g, unknown, or other
  misc_feature (388)..(388): n is a, c, t, g, unknown, or other
  misc_feature (393)..(393): n is a, c, t, g, unknown, or other
  misc_feature (396)..(396): n is a, c, t, g, unknown, or other
  misc_feature (397)..(397): n is a, c, t, g, unknown, or other
  misc_feature (399)..(399): n is a, c, t, g, unknown, or other
  misc_feature (422)..(422): n is a, c, t, g, unknown, or other
  misc_feature (428)..(428): n is a, c, t, g, unknown, or other
  misc_feature (491)..(491): n is a, c, t, g, unknown, or other
  misc_feature (497)..(497): n is a, c, t, g, unknown, or other
gctggagctccccgcggtggcggccgctctagaactagtggatcccccgggctgcaggaattcgcacgagaccattacctagaacatcctaatcgaaaaatatgagtcgttgcctcgcagtttatatccctactgtttcggactttcgggttttggccgacacccgacaatcttaacatcaaactcgtcgtccacgcctcctcggcaaggttgcgtacggcgtggccctaaggcataccagcgggatcaagctattttgctggccaaccgaacggtcaagccgacgatgacgctcggatcggcggcacacaagatcccgctggaggttgcgcacaccctcgtcgagatcgccgaggtcgcgcgctacgcctaccancancgccccggncgccntgnnanccacgaggggggacccgactgcngcgccngcaggggctgatagcaacggggggcacaaccaagatgccgccgcgcctgctggaagaaaaagncatgcntcgcgcccgaatcgaaaatgacctcgcggtcctggggggagtccccggggcggcctggggtttccaagggaggggcccttctgaactataaaaccgattggttgggggggggccacaaggttaactttct

SEQ ID NO: 19367 - DNA, 640 bp, Zea mays
  misc_feature: Ceres CLONE 1386565-F
  misc_feature: Translation starting site: 309
  misc_feature (426)..(426): n is a, c, t, g, unknown, or other
  misc_feature (453)..(453): n is a, c, t, g, unknown, or other
  misc_feature (569)..(569): n is a, c, t, g, unknown, or other
aagctggagctccccgcggtggcggccgctctagaactagtggatcccccgggctgcaggaattcgcacgagaccattacctagaacatcctaatcgaaaaacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggcaatgggaccgccctggtgctcttcctctcgccggtgcctacgttcatccgcatctggaaagaagggtcggtgnagcagtactcgccgatcccgtacgtgncgacgctgctgactgcatgaatgtggtgttgtacgggctgccgctggtgcaccgcacagcatgctggtgatcaccatcaacggcaccggcatgctcatccagctgacctacgtggngctcttctcgctactcccgcgggggcgcgcggcccgcaggtgtcctctgtggggccgcgaggtcgcttttt

SEQ ID NO: 19368 - DNA, 641 bp, Zea mays
  misc_feature: Ceres CLONE 1386568-F
  misc_feature: Encodes the peptide sequence at SEQ ID NO. 19369
  misc_feature (600)..(600): n is a, c, t, g, unknown, or other
aaagctggagctccccgcggtggcggccgctctagaactagtggatcccccgggctgcaggaattcgcacgagaccattacctagaacatcctaatcgaaaacaactcccccggccgtcctgctcgccggcttctggctggcccctgcatccgcccagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcggggcggcatcaccgtcttcgtgcccaaggactcggcgttcgcggcgctgaagcagaccacgttcgccaacctcacccaggaccagctcaggtcgctgctgctgtgccacgcgctggccagtactactcgnctggccgagttcgaccggctgagcgcgcttcggcccggtgc

SEQ ID NO: 19369 - protein, 146 aa, Zea mays
  misc_feature: Ceres CLONE 1386568-F
  misc_feature (64)..(145): Pfam Name: Fasciclin Pfam Description: Fasciclin domain
MEFKAGVFTVAMLAIVVLSTPAAPQKPKSPPAPRSPVVLAPAPAPAPAAPHHVDLADLLSVAGPFHTFLDYLQKTGVIETFQSQANDTKRGGITVFVPKDSAFAALKQTTFANLTQDQLRSLLLCHALASTTRLAEFDRLSALRPG

SEQ ID NO: 19370 - DNA, 622 bp, Zea mays
  misc_feature: Ceres CLONE 1386579-F
  misc_feature (201)..(201): n is a, c, t, g, unknown, or other
  misc_feature (228)..(228): n is a, c, t, g, unknown, or other
  misc_feature (237)..(237): n is a, c, t, g, unknown, or other
aagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattcccgcccacgatcgaccttcacgncagtctcggtctcttccgaaagcgtcncgcgccggntgtttgaaaggaaaggaggaaatgagggagggcatctcccggccaatcggggaaggccggaatccaagtcgggaaggggtgcctgggaaatttactggctcgaggacgggatccaacctggaagggaaggtggcctggaaataaaaccgggggaattacccatgaaggccttaagaaccttttttaagcaaaatgggggtggggaaaaaacttttccccgggaaactttggttgagtaaaaaccccctggggaaccaaagagggggggcattgggaaaatacccccccggttttttcccccgggggaaagtttccacggggggaagggggggtgcgccgtaaaatattttcgcccgggggggccataaacaattggggaggggga

SEQ ID NO: 19371 - DNA, 666 bp, Zea mays
  misc_feature: Ceres CLONE 1386589-F
  misc_feature: Encodes the peptide sequence at SEQ ID NO. 19372
  misc_feature (537)..(537): n is a, c, t, g, unknown, or other
  misc_feature (547)..(547): n is a, c, t, g, unknown, or other
  misc_feature (556)..(556): n is a, c, t, g, unknown, or other
aaagctggagctccccgcggtggcggccgctctagaactagtggatcccccgggctgcaggaattcgcacgagaccattacctagaacatcctaatcgaaaaaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtgggggggaatgctgcgacttggccgtatgcgtcaagacgtacccgctaacttgctcgtgcttttgatcgggttgagcgctgctccgacgcctgtaaaggagtgcgtgggaaacggaggactcgcgccacgtctgcgtcgacaggtaccgtggcgacccggggccagntgccaccaanaaggaacgnaaaggagcggcggaccgctgacgaccaaacgctgggtggcaaagcgaccccaaacggcagggggatggcagatggacagaaaagcagcggcgggcgagaccaaaaaaaaa

SEQ ID NO: 19372 - protein, 162 aa, Zea mays
  misc_feature: Ceres CLONE 1386589-F
  misc_feature (119)..(119): Xaa is any aa, unknown, or other
  misc_feature (123)..(123): Xaa is any aa, unknown, or other
  misc_feature (126)..(126): Xaa is any aa, unknown, or other
MAMGAASILLMMVSLEALLLAAAAGGGTIRLPSDVGGVAADLVTAMARARARAKHQLRDEERPWGGMLRLGRMRQDVPANLLVLLIGLSAAPTPVKECVGNGGLAPRLRRQVPWRPGAXCHQXGTXRSGGPLTTKRWVAKRPQTAGGWQMDRKAAAGETKKK

SEQ ID NO: 19373 - DNA, 630 bp, Zea mays
  misc_feature: Ceres CLONE 1386602-F
  misc_feature: Encodes the peptide sequence at SEQ ID NO. 19374
aaagctggagctccccgcggtggcggccgctctagaactagtggatcccccgggctgcaggaattcgcacgagaccattacctagaacatcctaatcaaaaatactccctcagattcttaccaaaacacaggagcccgtcggccgtcgcaaaaaaacaaaacaagaccaccgcaccatggaatcgctgacgcttcgcgcttcgacggccgcctcgccgctgcagcgacgccggctgctccccgggcggcagcgcgcgacgtacgtccgcgccacggcctccgccggcgagccggacctctccgtgcgcgtgaacgggctgcagatgcccaacccgttcgtgatcgggtcggggccaccgggcaccaactacaccgtcatgaagcgcgccttcgacgagggctggggcgccgtcatcgccaagactgtgtcattggatgctgaaaaagttatcaacgttactcctcgttatgcaaagcttcgggcagaacaaaatggggctgccatggggcgcatcattggctggcagaacatggaactcatcagtgacaggcctctggagacctggctgaagaagttcaagcagttggaagaaagatatcctgaaggaaaacttatcggtcaatttaatg

SEQ ID NO: 19374 - protein, 151 aa, Zea mays
  misc_feature: Ceres CLONE 1386602-F
  misc_feature: SWISSPROT Homolog: EC 1.3.1.2 Dihydropyrimidine dehydrogenase (NADP(+))
MESLTLRASTAASPLQRRRLLPGRQRATYVRATASAGEPDLSVRVNGLQMPNPFVIGSGPPGTNYTVMKRAFDEGWGAVIAKTVSLDAEKVINVTPRYAKLRAEQNGAAMGRIIGWQNMELISDRPLETWLKKFKQLEERYPEGKLIGQFN

SEQ ID NO: 19375 - DNA, 642 bp, Zea mays
  misc_feature: Ceres CLONE 1386604-F
  misc_feature: Encodes the peptide sequence at SEQ ID NO. 19376
aaagtggagctccccgcggtggcggccgctctagattagtggatcccccgggctgcaggaattcgcacgagaccattacctagaacatcctaatcgaaaaactcaaccctgcgtctctctcccgttcacttacagattatgttctattccatcgatcgtcagagagagtaatcgagtaggcgaccatggtggtgcacctggtccttctcaccgccgatgaggtccgctctgactctttcccgtacaatgagattgagaatgggacgctccggcagcctgaaggaaagtgcactactaagggatgtgtagaggttaagattggtgccaacccatctgctgaggaaggtgacgaggacgaggctgttgaacactctgttgacaaggttgttgacattgtccacagtttcaggcttcaggagcagcccaattacgagaagagggtggtcatcgcctatatcaagaagtacatcaagtctttggaactcccacggtcacccctgaacagcaagaaaaggttaagaaggggtattgaaggaagctacaaagtacttggctcccccagctcaaggtactcccaaattctttgttgggcgaggggcacggacgatggacagcaccaacggccgttggctaacaaaaaag

SEQ ID NO: 19376 - protein, 152 aa, Zea mays
  misc_feature: Ceres CLONE 1386604-F
  misc_feature (1)..(141): Pfam Name: TCTP Pfam Description: Translationally controlled tumour protein
MVVHLVLLTADEVRSDSFPYNEIENGTLRQPEGKCTTKGCVEVKIGANPSAEEGDEDEAVEHSVDKVVDIVHSFRLQEQPNYEKRVVIAYIKKYIKSLELPRSPLNSKKRLRRGIEGSYKVLGSPSSRYSQILCWARGTDDGQHQRPLANKK

SEQ ID NO: 19377 - DNA, 624 bp, Zea mays
  misc_feature: Ceres CLONE 1386605-F
  misc_feature: Encodes the peptide sequence at SEQ ID NO. 19378
aaagctggagctccccgcggtggcggccgctctagaactagtggatcccccgggctgcaggaattcgcacgagaccattacctagaacatcctaatcgaaaaagatctagggttctctcgtgctctgttctcatcttctgctcgctggtgtcccctccctctcacccatggcttcggcggcggcggcaactcaggtggggacttacttcctgcggaactactacaacctgctgcaacaaacccccgatgtcgtccaccagttctacagcgaagccagcaccatggtccgcgtcgacgacctcaccggcacgaccgcggctggcaacaacatgatggacatacactcactcatcatgtctttgaacttcacccacatgagatcaagactgaccattttgtgaactcatggggcgatggggtgctagttatggtctctggtctagtgcagaccaggagtacagccaccaaaggaaatttatccagatggtcttccttgccccctcagagaaggttactttgccctcaacgatactttcactccgttgaccagaaactgtgcagcctgcgccagggatgctcaggagactacgagagcatttggcacccacacagttgttgaaccgc

SEQ ID NO: 19378 - protein, 77 aa, Zea mays
  misc_feature: Ceres CLONE 1386605-F
MASAAAATQVGTYFLRNYYNLLQQTPDVVHQFYSEASTMVRVDDLTGTTAAGNNMMDIHSLIMSLNFTHMRSRLTIL

SEQ ID NO: 19379 - DNA, 633 bp, Zea mays
  misc_feature: Ceres CLONE 1386611-F
  misc_feature: Encodes the peptide sequence at SEQ ID NO. 19380
  misc_feature (360)..(360): n is a, c, t, g, unknown, or other
  misc_feature (532)..(532): n is a, c, t, g, unknown, or other
  misc_feature (633)..(633): n is a, c, t, g, unknown, or other
aaagctggagctccccgcggtggcggccgctctagaactagtggatcccccgggctgcaggaattcgcacgagaccattacctagaacatcctaatcgaaaaattttgccatccctagctccacagcaccacttgctcctgcctcctgctgcttcttcccgagttcccgtgccgccgcgagcgctcccaaccaagcaacgagacaacaacaacaaccctgcaccgccgcagcacttgcgccgtccggtcctgtcctcccgcggtctcgacgccgccccctaccgtcctaccttatcgcgcaccgctccatggccgccaagtgggcccagaagaccgtcgttatcccggcgcatcggcggngctgccacctcatcacccccaagattctgagggagatcgagggcgacctggccgggttcaagtgcggtctcgcgcatttcttccttcagcacacaagcgcatcgctgaccatcaacgagaactatgactctgatgtgcaggctgacactgagacttttcttaacagaattgntccagagggccacaatgctccttggaaaaacactatggaaggacctgatgacatgccagcacatattaaatcttctatggttggttgttccctaacgattn

SEQ ID NO: 19380 - protein, 108 aa, Zea mays
  misc_feature: Ceres CLONE 1386611-F
  misc_feature (19)..(108): Pfam Name: UPF0047 Pfam Description: Uncharacterised protein family UPF0047
  misc_feature (18)..(18): Xaa is any aa, unknown, or other
  misc_feature (75)..(75): Xaa is any aa, unknown, or other
MAAKWAQKTVVIPAHRRXCHLITPKILREIEGDLAGFKCGLAHFFLQHTSASLTINENYDSDVQADTETFLNRIXPEGHNAPWKNTMEGPDDMPAHIKSSMVGCSLTI

SEQ ID NO: 19381 - DNA, 598 bp, Zea mays
  misc_feature: Ceres CLONE 1386612-F
  misc_feature (225)..(225): n is a, c, t, g, unknown, or other
  misc_feature (281)..(281): n is a, c, t, g, unknown, or other
  misc_feature (351)..(351): n is a, c, t, g, unknown, or other
  misc_feature (364)..(364): n is a, c, t, g, unknown, or other
  misc_feature (520)..(520): n is a, c, t, g, unknown, or other
  misc_feature (530)..(530): n is a, c, t, g, unknown, or other
  misc_feature (536)..(536): n is a, c, t, g, unknown, or other
  misc_feature (540)..(540): n is a, c, t, g, unknown, or other
  misc_feature (544)..(544): n is a, c, t, g, unknown, or other
tggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaaatcaagcttaattangctccctctacatctgatccagctaagtagctagccagcactacagaagggcgtgncaagaatcaggagagagatagcaggggggctagctagctgagctcgtgcgacgaagatgggccgaattgncagaacatggtgncgccgctccctggtgctcacctcatcatgtacatcatcgtcatcggcttcgcgagctggaacctgaccacttcatcaacgggcagacaactaccccggcgtgcccggcaacggcgcgacgttctacttcctgggtgtcgcatcctggcccgcgtgntgggcccgcntccaanctgncggncgtgcaccacgtgcgcgcctggcgcacgacagcctggccaccaacgccgcgtct

SEQ ID NO: 19382 - DNA, 621 bp, Zea mays
  misc_feature: Ceres CLONE 1386614-F
  misc_feature: Encodes the peptide sequence at SEQ ID NO. 19383
  misc_feature (339)..(339): n is a, c, t, g, unknown, or other
  misc_feature (526)..(526): n is a, c, t, g, unknown, or other
aagctggagctccccgcggtggcggccgctctatcctagtggatcccccgggctgcaggaattcccacgagaccattacctagaacatcctaatcgaaaactgaattcttttctactatagctagagccaggcgacgctacagcggcaaacggggtagcctgactcttctgtctacagcagctacctcttcacaccaactgccgcccctgctccgagaagcagaatggccgccgccgatgcatcatcgttgcctccgtgcggcatcacctgccgacccgcgatggcgtgtggaccgggccagccactgttgatggaggaggagaatgacaccccgcctnggacaatggagacccgtgtcaatctcgcctcccacctccgtctggcggagcgacgatactgcctgtccatcccacctgatagcctgagacaaacatactctctgatcgaatttgtcatctgggttcttcctccagatcaacatgcagaaacaacttgatctggtcgacaaattctacaccacgaggngtgcggagtagaaaaaattgcccgtgaagtggtgacgaggtccaaatcgcggacaaggtatccctggcttcatgggggatggcataggtccaagc

SEQ ID NO: 19383 - protein, 90 aa, Zea mays
  misc_feature: Ceres CLONE 1386614-F
  misc_feature: SWISSPROT Homolog: EC 1.1.1.1 Alcohol dehydrogenase
  misc_feature (39)..(39): Xaa is any aa, unknown, or other
MAAADASSLPPCGITCRPAMACGPGQPLLMEEENDTPPXTMETRVNLASHLRLAERRYCLSIPPDSLRQTYSLIEFVIWVLPPDQHAETT

SEQ ID NO: 19384 - DNA, 621 bp, Zea mays
  misc_feature: Ceres CLONE 1386616-F
  misc_feature: Encodes the peptide sequence at SEQ ID NO. 19385
  misc_feature (397)..(397): n is a, c, t, g, unknown, or other
  misc_feature (406)..(406): n is a, c, t, g, unknown, or other
  misc_feature (407)..(407): n is a, c, t, g, unknown, or other
agagctggagctccccgcggtggcggccgctctagaactagtggatcccccgggctgcaggaattcgcacgagaccattacctagaacatcctaatcgaaaactcttccagagtaccgcggtctcatctcctcccgggacgggcatgcagagcacggctgccatcggtctcgttcggccatgcgccgcgcggccactccccacctaccctagcccacggcgcggcgccggcgcgtgcagcggcgccgcacagccgatcctcgcgccccgcggcctctgcctctccgcccgcgccagcctactgccggactcgccgctggaggaggagtaccggagatgcagggccggccggcacgtggccgcggccgggaacgtggcggcggctgatggggccgtanaagaagcgnngggagggctcgtcaagacgctgcagctggggtcgctcttcgggctctggtacctcttaacatctacttcacatctacaacagcaggttctggaggttctggcataccctataaacatcaccacagtgcagtttgccgttgggagtgccattgcttttgttatgtggatcaccggtatccttaaaaggcaaagatttctggtggccagctttttg

SEQ ID NO: 19385 - protein, 159 aa, Zea mays
  misc_feature: Ceres CLONE 1386616-F
  misc_feature (85)..(85): Xaa is any aa, unknown, or other
  misc_feature (88)..(88): Xaa is any aa, unknown, or other
MQSTAAIGLVRPCAARPLPTYPSPRRGAGACSGAAQPILAPRGLCLSARASLLPDSPLEEEYRRCRAGRHVAAAGNVAAADGAVXEAXGGLVKTLQLGSLFGLWYLLTSTSHLQQQVLEVLAYPINITTVQFAVGSAIAFVMWITGILKRQRFLVASFL

SEQ ID NO: 19386 - DNA, 631 bp, Zea mays
  misc_feature: Ceres CLONE 1386620-F
  misc_feature: Encodes the peptide sequence at SEQ ID NO. 19387
aaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccatttcaccaactgtctacattgaaccgtgctgcttatttgcagcaacaactattacccatcaggcagctagctactggctactctcagcaacaacaact

SEQ ID NO: 19387 - protein, 153 aa, Zea mays
  misc_feature: Ceres CLONE 1386620-F
MATKIFSLLMLLALSACVANATIFPQCSQAPIASLLPPYLPSMIASVCENPALQPYRLQQAIAASNIPLSPLFQQSPALSLVQSLVQTIRAQQLQQLVLPVINQVALANLSPYSQQQQFLPFHQLSTLNRAAYLQQQLLPIRQLATGYSQQQQ

SEQ ID NO: 19388 - DNA, 622 bp, Zea mays
  misc_feature: Ceres CLONE 1386628-F
  misc_feature: Encodes the peptide sequence at SEQ ID NO. 19389
aagctggagctccccgcggtggcggccgctctagaactagtggatcccccgggctgcaggaattcgcacgagaccattacctagaacatcctaatcgaaaaattgattttttttccgcgcagccgatttcttttcgtctctctcgctctcgccttctcggcgcagcgcagtactacgagctagcagcaccaggaacctcttcccacacttccgcgctcctccctctgtctcgagactcgagaatggttgtgtaggcgggcgcaggagggagggaggcgagagggggagctagggtttttcgccgccgccttctgttatcctcaggctctgaaccccctcctgtccggtgcgcggcggattagactccgatggggaagtctccggcgaagtggatcaagtccgtgctcttcgggaagaagtcgtcgtccaggtccggctccaccaaggccaaagatttatcgaaaggtgcgagtaacaaaggagctgctgctgcggggaaggagcccgtgttctctgagagctccccagtgatctcggagcctgtacttgttagcgcccacaacaatgagaccgtgcgggaggtggcgaagggtgagaattccagcgtgcaagaagtgccagg

SEQ ID NO: 19389 - protein, 84 aa, Zea mays
  misc_feature: Ceres CLONE 1386628-F
MGKSPAKWIKSVLFGKKSSSRSGSTKAKDLSKGASNKGAAAAGKEPVFSESSPVISEPVLVSAHNNETVREVAKGENSSVQEVP

SEQ ID NO: 19390 - DNA, 628 bp, Zea mays
  misc_feature: Ceres CLONE 1386628-R
  misc_feature (542)..(542): n is a, c, t, g, unknown, or other
ccgggccccccctcgaggtcgacggtatcgataagcttttttttttttttttttaactcaatccatgcatgttctcattctctctaacatcagcagctctcaacaagaagggaggaagtctgggggtctgggaaccaaaacaaaccgggaaaatacttcagctatacatcacaaaaggcatgacggaaaaccctataataaataagttgactcccagcggattcatcacaacaaagccggttcattcatctcgccgacgatgacgacatcatttttttacatcacaaacaaaacaaatccgagcaaactgcaagggcgatccatccacccaaacggtcacgctaatcaaatggaggatttggatttgattcgccgcctcaacgtctccactcagctttcagtggtctctcgcttgcatctcttgatgacagcatagccttgtcacctttcgctccatcctttgcaccagcattagctggcctttgtgtacgtggagaatgtgaaaccatcttaccgttgtttagagatggaagggagtgacnacaatttgagccgtttttctctgctgaatcaaagctaattttttggtggaactatttcccccaagtttcccctttgctgaattggg

SEQ ID NO: 19391 - DNA, 625 bp, Zea mays
  misc_feature: Ceres CLONE 1386631-F
  misc_feature: Encodes the peptide sequence at SEQ ID NO. 19392
  misc_feature (429)..(429): n is a, c, t, g, unknown, or other
  misc_feature (430)..(430): n is a, c, t, g, unknown, or other
  misc_feature (564)..(564): n is a, c, t, g, unknown, or other
  misc_feature (565)..(565): n is a, c, t, g, unknown, or other
  misc_feature (580)..(580): n is a, c, t, g, unknown, or other
  misc_feature (604)..(604): n is a, c, t, g, unknown, or other
aaagctggagctccccgcggtggcggccgctctagaactagtggatcccccgggctgcaggaattcgcacgagaccattacctagaacatcctaatcgaaaaaacaaggccacatcagcagagagcccagcaactgaaaaaaccaaccatcgcgcgggcacggttgcggttgctacctcccgatcccgtcctcccgcaagccaagctctctctctccccctccccttcagcacgatcggagtccaagtccatcccatccagacccactcgacagtcgacccgatggcgccgtccatctccgtcggcgccgcggcgccgtcccgtgcagcgggcgcgagcacgaagaagagcgcggacgaggtggagctcctgcggcggcggaacgcgaagctggagcgggaggtggcggcgctgcggctggagctgggnncgcgcgcgcgccgcgccaagacggcggaagaagccccgagagcgctgtgcgtgcagctcggcgacgccgaggtggaggcgctcgagctcgcgcgcgcctaccaggcccacgtcacgagctcgccagggagctcnngcgcgcgcgcgcggncccgggacgcccggccagataggntctcgtggggctggtagaagc

SEQ ID NO: 19392 - protein, 112 aa, Zea mays
  misc_feature: Ceres CLONE 1386631-F
  misc_feature (50)..(50): Xaa is any aa, unknown, or other
  misc_feature (95)..(95): Xaa is any aa, unknown, or other
  misc_feature (100)..(100): Xaa is any aa, unknown, or other
  misc_feature (108)..(108): Xaa is any aa, unknown, or other
MAPSISVGAAAPSRAAGASTKKSADEVELLRRRNAKLEREVAALRLELGXRARRAKTAEEAPRALCVQLGDAEVEALELARAYQAHVTSSPGSSXARARXRDARPDRXSWGW

SEQ ID NO: 19393 - DNA, 631 bp, Zea mays
  misc_feature: Ceres CLONE 1386633-F
  misc_feature: Encodes the peptide sequence at SEQ ID NO. 19394
aaagctggagctccccgcggtggcggccgctctagaactagtggatcccccgggctgcaggaattcgcacgagaccattacctagaacatcctaatcgaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacgtacccgctaacttgctcgtgctttgatcgggttgagcgctgctccgacgcctgtaaggagtgcgtggaaacggaggactcgcgccacgtctgcgtcgacaggtaccgtggcgaccccgggccccagtgccacgacgaggacgggaggagcggcggacccgctgacgacgacgctggtgggcaagcgacgccgacggcagtgatggcagatgacaaa

SEQ ID NO: 19394 - protein, 148 aa, Zea mays
  misc_feature: Ceres CLONE 1386633-F
MAMGAASILLMMVSLEALLLAAAAGGGTIRLPSDVGGVAADLVTAMARARARAKHQLRDEERPWGECCDLAVCVKTYPLTCSCFDRVERCSDACKECVETEDSRHVCVDRYRGDPGPQCHDEDGRSGGPADDDAGGQATPTAVMADDK

SEQ ID NO: 19395 - DNA, 645 bp, Zea mays
  misc_feature: Ceres CLONE 1386637-F
  misc_feature: Translation starting site: 316
  misc_feature (471)..(471): n is a, c, t, g, unknown, or other
  misc_feature (514)..(514): n is a, c, t, g, unknown, or other
  misc_feature (645)..(645): n is a, c, t, g, unknown, or other
aagctggagctccccgcggtggcggccgctctagaactagtggatcccccgggctgcaggaattcgcacgagaccatacctagaacatcctaatcgaaaaacgccttcgctcgcgccgccgccgccgacgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctncagtatgctcttacataccgtgaggtcatttccatcctgatgncacgccatgtactttgtgatggcaaggtcaggacagacaagacttaccctgctgggttcatggatgtcatttccatccccaagaccatgagaactacaggctgctgtacgataccagggccgcttccgccn

SEQ ID NO: 19396 - DNA, 637 bp, Zea mays
  misc_feature: Ceres CLONE 1386646-F
  misc_feature: Encodes the peptide sequence at SEQ ID NO. 19397
  misc_feature (451)..(451): n is a, c, t, g, unknown, or other
  misc_feature (505)..(505): n is a, c, t, g, unknown, or other
  misc_feature (567)..(567): n is a, c, t, g, unknown, or other
aagctggagctccccgcggtggcggccgctctagaactagtggatcccccgggctgcaggaattcgcacgagaccattacctagaacatcctaatcgaaaaaatagcatctgcctacctgcactggactcaaaaacatgcctgccgtaggatcctgtgatgtgtccattcgcgtgttgagtcggcggcttgtgaaggcatccgacccctccctccagccgcacgtcgtcaccttctcaaacctagatctctacccggacaacgtgcaggcctccatagtgtgcctctaccccaagctgtcaacaaagtccggcccgggcggcggcttcgacgccgtcgtctccaccttcgaggccgtcctgccgaccttgcttaaccacttctaccctctcgccggtcgcattgtcgtcaacccaagctccggcgtccccgagctccactgccacaaccanggcgcggagctcgtggtgggagaggtcggcgtcgccctgggcagcctggattancgtcttgccgaggagtccctgaagaagatcatgatgccgacccctgaggacgtcacgctctncgtgcagctgctggtcttcgcgtgcgcggcttcctccgtcgtgtgggcaacaacaccctcctcacgacgg

SEQ ID NO: 19397 - protein, 167 aa, Zea mays
  misc_feature: Ceres CLONE 1386646-F
  misc_feature: SWISSPROT Homolog: EC 2.3.1.160 Vinorine synthase
  misc_feature (105)..(105): Xaa is any aa, unknown, or other
  misc_feature (123)..(123): Xaa is any aa, unknown, or other
  misc_feature (144)..(144): Xaa is any aa, unknown, or other
MPAVGSCDVSIRVLSRRLVKASDPSLQPHVVTFSNLDLYPDNVQASIVCLYPKLSTKSGPGGGFDAVVSTFEAVLPTLLNHFYPLAGRIVVNPSSGVPELHCHNXGAELVVGEVGVALGSLDXRLAEESLKKIMMPTPEDVTLXVQLLVFACAASSVVWATTPSSRR

SEQ ID NO: 19398 - DNA, 613 bp, Zea mays
  misc_feature: Ceres CLONE 1386654-F
  misc_feature: Encodes the peptide sequence at SEQ ID NO. 19399
  misc_feature (223)..(223): n is a, c, t, g, unknown, or other
  misc_feature (249)..(249): n is a, c, t, g, unknown, or other
  misc_feature (250)..(250): n is a, c, t, g, unknown, or other
  misc_feature (259)..(259): n is a, c, t, g, unknown, or other
  misc_feature (267)..(267): n is a, c, t, g, unknown, or other
  misc_feature (304)..(304): n is a, c, t, g, unknown, or other
  misc_feature (324)..(324): n is a, c, t, g, unknown, or other
  misc_feature (334)..(334): n is a, c, t, g, unknown, or other
  misc_feature (417)..(417): n is a, c, t, g, unknown, or other
  misc_feature (434)..(434): n is a, c, t, g, unknown, or other
aagctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgncatgcagatgccctgcccctgcgcgnngctgcaggncttgtacnggcgctgcgccggcctgacgacgatgatgggcgccgncgggctgtacccctacgcgnagtacctgangcagccgcagtgcagcccgctggggcgcgcgccctactacgccgggtgtgggcaaaccaccgccatgtaccagccgctccggnaacaggggttgcagcanaaaatgaaggatgagggaccgtgcatccccttcccgaaacaattgcaaaagaatgattgcattttagagggggcccttccccccaaaaaaaaccttggacaaaccatttttttatgcaaaaaaaaaaaaaattggttggaaccccccggggttcacccccatgggcctgtggggggggg

SEQ ID NO: 19399 - protein, 149 aa, Zea mays
  misc_feature: Ceres CLONE 1386654-F
  misc_feature (20)..(20): Xaa is any aa, unknown, or other
  misc_feature (29)..(29): Xaa is any aa, unknown, or other
  misc_feature (32)..(32): Xaa is any aa, unknown, or other
  misc_feature (35)..(35): Xaa is any aa, unknown, or other
  misc_feature (47)..(47): Xaa is any aa, unknown, or other
  misc_feature (54)..(54): Xaa is any aa, unknown, or other
  misc_feature (57)..(57): Xaa is any aa, unknown, or other
  misc_feature (85)..(85): Xaa is any aa, unknown, or other
  misc_feature (90)..(90): Xaa is any aa, unknown, or other
MKMVIVLVVCLALSAASASXMQMPCPCAXLQXLYXRCAGLTTMMGAXGLYPYAXYLXQPQCSPLGRAPYYAGCGQTTAMYQPLRXQGLQXKMKDEGPCIPFPKQLQKNDCILEGALPPKKNLGQTIFLCKKKKNWLEPPGVHPHGPVGG

SEQ ID NO: 19400 - DNA, 636 bp, Zea mays
  misc_feature: Ceres CLONE 1386657-F
  misc_feature: Encodes the peptide sequence at SEQ ID NO. 19401
  misc_feature (546)..(546): n is a, c, t, g, unknown, or other
  misc_feature (547)..(547): n is a, c, t, g, unknown, or other
  misc_feature (636)..(636): n is a, c, t, g, unknown, or other
aagctggagctccccgcggtggcggccgctctatacctagtggatcccccgggctgcaggaattcgcacgagaccattacctagaacatcctaatcgaaaaatcatcaactgatcaaacagagacaaacctatactgctacatgcataatggttggtacatggtaaaactatagcaagctaaggtcgatcgctcgtctatagctagaccactaccacctccatggtttcttgactgatagatagacggacgagaatgaagaagctagctagctactagatatatcatcagtagagtgttcagttgttgatgatggcctcctccttgcccctggtcaccactgggctgcgccatcctcctcctccgcagcagtcgccgagggtggtcctgcagagcgaggacccgaccgagtggtgcgcgtgggcgcaccaggggcaccgcctgtgggtggccatgccggactccttctgggtgtacacgtacaaggtggaccggtgcccgttccggggcaaccacgtgtggacgacgtgcccgtacgcgcactggnngggagcgcgcgcgccgccgcgaccccagccgctacgcgtacgccgccgcgacgtgcccggactacgccgactccaagcgccggacccgn

SEQ ID NO: 19401 - protein, 109 aa, Zea mays
  misc_feature: Ceres CLONE 1386657-F
  misc_feature (80)..(80): Xaa is any aa, unknown, or other
MMASSLPLVTTGLRHPPPPQQSPRVVLQSEDPTEWCAWAHQGHRLWVAMPDSFWVYTYKVDRCPFRGNHVWTTCPYAHWXGARAPPRPQPLRVRRRDVPGLRRLQAPDP

SEQ ID NO: 19402 - DNA, 617 bp, Zea mays
  misc_feature: Ceres CLONE 1386660-F
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (526)..(526): n is a, c, t, g, unknown, or other
  misc_feature (617)..(617): n is a, c, t, g, unknown, or other
aaagctggagctccccgcggtggcggccgctctagaactagtggatcccccgggctgcaggaattcgcacgagaccattacctagaacatcctaatcgaaaaacctagcgcagcgaagccggcacaatgccagccgccgccgtagtctcccctctcctcctctcgctctcctcgtcctcctcccccttcctctcttcctcatccacctcctttttcccaccctcctccgctgccgtcactccacacgccgccgtcaggacgagggcggctgtctccgtcctccgcgcgctgcgcgccgaggcggccaccctccccgtgctctcattcaccggagagaaggtcggggaggtaaccctcgacctcaaatccgcgccaccctccaccgcgcgcgctgtcgtgcaccgcgctatcatcaccgaccgccagaacgcgcgccgaggcacggcctccacgctcaccccgcggcgaggtcagaaggcggagggaggaagccctatcagcagaaaaaaacggggaaagcnnncgncgggggtcgcaacgtaccccgctccggtcccgcgggtggcggtcgtgttccggccccaagccccgcgactggtccatcaagatcaaccgcn

SEQ ID NO: 19403 - DNA, 692 bp, Zea mays
  misc_feature: Ceres CLONE 1386665-F
  misc_feature: Translation starting site: 244
  misc_feature (692)..(692): n is a, c, t, g, unknown, or other
tggagctccccgcggtggcggccgctctagaactagtggatcccccgggctgcaggaattcgcacgagaccattacctagaacatcctaatcgaaaaacgtttgcatctctaaccacctgcgctgcgctcgcgtctctcgtccccctcagatccaccgactcgctctgagtctctgaccgccccttccgtcgtccccgttcgaaggcgcggcaagcgagcgattcagccagattcgattcgacatgaatcccgagtacgactaccttttcaaacttctgcttattggtgattctggtgttgggaaatcatgcttgcttctcagatttgcggatgattcatatttggacagctacatcagcacaattgggggttgattttaaaattcggacagtagagcaagatgggaagaccataaaacttcaaattttgggatactgctgaggcaagagcgccttcgggaccatcactagcagttactaccgtgggagctcatgggaatcattattgtatatgaccgggacggacccaagaaagtttccataattgggaaggcaagggctaaaatggaaattgatccgttatgcaaggggacaatggtaaccagctcccttgttggggaaacaaaagggacctaaattggccaccaaaggttgggggaaatgggaaaaggcaaaggtttttttgtggatgn

SEQ ID NO: 19404 - DNA, 686 bp, Zea mays
  misc_feature: Ceres CLONE 1386667-F
  misc_feature: Encodes the peptide sequence at SEQ ID NO. 19405
  misc_feature (532)..(532): n is a, c, t, g, unknown, or other
  misc_feature (611)..(611): n is a, c, t, g, unknown, or other
  misc_feature (657)..(657): n is a, c, t, g, unknown, or other
aagctggagctccccgcggtggcggccgctctagaactagtggatcccccgggctgcaggaattcgcacgagaccattacctagaacatcctaatcgaaaacccgtccctctcccacccttttcagatctgcctgcgagcccccgccacgcacccccatgcccatgcggccatgcccatgaccccccgacgcgaggccactactgccaatggctccctgccgtgaccgagcccatggaggacctcgccccgggggccctcgcactcttcgccgccgtcgctgacttcatagacgactccgctcctgctgccgccggggccgggatgccaccgccggagcccgagtccgcgcccgggagtccctgctccgactgcagcagcgtcgccacgccggacttcgagggcttcgccgacctcgcctccacgctcgtgctcgacgacctcgtctcccccgcctccgcctccgcctccgccagctcgctccccgcctccgggcccagggccgccagggagcgtcttcgcgctcgactggntgcccgcgctggggactccactccgtggtgcggccgacggcccccaagaatggaggacggccgcccgggtgctcccaanccttcttccacgtccccgctctgggatgggtcgccggcggacgcgnacccgtcgacggccctcgaccggggcacg

SEQ ID NO: 19405 - protein, 151 aa, Zea mays
  misc_feature: Ceres CLONE 1386667-F
  misc_feature (100)..(100): Xaa is any aa, unknown, or other
  misc_feature (126)..(126): Xaa is any aa, unknown, or other
  misc_feature (142)..(142): Xaa is any aa, unknown, or other
MEDLAPGALALFAAVADFIDDSAPAAAGAGMPPPEPESAPGSPCSDCSSVATPDFEGFADLASTLVLDDLVSPASASASASSLPASGPRAARERLRARLXARAGDSTPWCGRRPPRMEDGRPGAPXPSSTSPLWDGSPADAXPSTALDRGT

SEQ ID NO: 19406 - DNA, 669 bp, Zea mays
  misc_feature: Ceres CLONE 1386668-F
  misc_feature: Encodes the peptide sequence at SEQ ID NO. 19407
  misc_feature (553)..(553): n is a, c, t, g, unknown, or other
  misc_feature (600)..(600): n is a, c, t, g, unknown, or other
tggagctccccgcggtggcggccgctctagaactagtggatcccccgggctgcaggaattcgcacgagaccattacctagaacatcctaatcgaaaaagaagtactaacgccccgcccctgcctggggttttaaccctacccaaccgccgcccatggcgtccatctcggagcccgctgctagggagaagcccatcgtcgtccgggtcaagcgcaaaccttcgcaaaaccgcccggacgctttctggctagagattaatgagaggccggcaaagaaggcggcgattgatttctcccgcctttccatctccgaaccctcctcgtcctctgccagtgtcaaagcttcagaggaaccacgggttaagaaaattcttgtccagcacatcgagacagtacaccactctgaagctgtcgaagatgttttacaatctcttttgcttgttgactcaaattccaaggagacaaagagcaagacaaagggagtggaatgacagaatcaagcaagacaaaaaaccagagcaactacggatcagctgccagacagaggcatgaggnatatgggagaaaattgctcggtttgccaaaatatggaagagtcgaanaggagaaaggctggatgctggtgactcattgagagaaaatgccatcttttatgatgtgggtcaagtaaa

SEQ ID NO: 19407 - protein, 111 aa, Zea mays
  misc_feature: Ceres CLONE 1386668-F
MASISEPAAREKPIVVRVKRKPSQNRPDAFWLEINERPAKKAAIDFSRLSISEPSSSSASVKASEEPRVKKILVQHIETVHHSEAVEDVLQSLLLVDSNSKETKSKTKGVE

SEQ ID NO: 19408 - DNA, 729 bp, Zea mays
  misc_feature: Ceres CLONE 1386670-F
  misc_feature: Translation starting site: 187
tccccgcggtggcggccgctctagaactagtggatcccccgggctgcaggaattcgcacgagaccatacctagaacatcctaatcggaactccaaagtttcgtccaccatttcgctcccgcaagcaccgatttgtttactgctctctccgacgcgcggcggcggagctccctacgacgactgaaccatgtgcggcggcgcgatccttgccaaccttcgcgagccggcgccgcgccggctcacagagcgggacatctggcagcagaaaaagaagctcaagaggggcggcggcggcgggaggcgctcgttcgcggcggaggacgatgaggacttcgaggccgactttgaggtcttcgaggccgactccagtgattcagatttggagctcagggaggggactgacgacgacgtcgtcgagatcaagcccttcactgccaagaggactttctccagcgatggcttaagcaccatgactagtgctgtagcaaggtcagccaagaggaagagaaagaatctatacaggggtatccgccagccggccttggggcaagtgggctgctgagatcagagatcctcagaagggggttcgtgttttgccttggcactttccataactcctgaggaagctgccagagcttatgatgccgaagcgcgcaggatttcggggcaaaaacggccaggtttacctttccctcatgccccagcaggtgggccagaaagccccgtttcg

SEQ ID NO: 19409 - DNA, 801 bp, Zea mays
  misc_feature: Ceres CLONE 1386676-F
  misc_feature: Encodes the peptide sequence at SEQ ID NO. 19410
  misc_feature (19)..(19): n is a, c, t, g, unknown, or other
  misc_feature (20)..(20): n is a, c, t, g, unknown, or other
  misc_feature (54)..(54): n is a, c, t, g, unknown, or other
agggtgggtggcctccccnncccttcccccctcccacacccccccccccccccngcgccaaaactggaactccccgcggtggcgcgccgctctagaactagtggatcccccgggctgcaggaattcgcacgagaccattacctagaacatcctaatcgaaaaatttcttctcctctctgctctgttcacttcgttctagtggggagcgccgccgctgcagttgccgccggcgccagagcagtccacctcgcactgatatgccgaccgggagtggaagcgccatcgcgtccttctccgtggcggcgcgaccggctgctgctctgcgcgtcaggtggccatgcgctcgcgcttgtggttgggccccctcacaccgcccgcagtcaggggaactcgacagcctcaagccttgcgcctaactggaaccgcaccgctcctctgtggcgcgcggcgatcgcactgccccggggccgtggggatggcatggcggggggccgtcttggtgcgcgccgtggcccgcggagaggagcaataattactcgcccccgctccggcggggcgcccgcgtgagactcccatcacacgtaactatccggaccggaacaacaagcacgccactcgcccacaatgcacccgctatccgaagccgagagttaactacgcgcctcctcatcatcgttttccagcgcaatcttgatcggctcccagccgccccgccttccaaaccaccccccaccgtcccagattatatagagagggggggcagtaaacactaaaaaaaccacacaacaacatcacccccac

SEQ ID NO: 19410 - protein, 52 aa, Zea mays
  misc_feature: Ceres CLONE 1386676-F
MPTGSGSAIASFSVAARPAAALRVRWPCARACGWAPSHRPQSGELDSLKPCA

SEQ ID NO: 19411 - DNA, 684 bp, Zea mays
  misc_feature: Ceres CLONE 1386681-F
  misc_feature: Encodes the peptide sequence at SEQ ID NO. 19412
tggagctcaccgcggtggcggccgctctagaactagtggatcccccgggctgcaggaattcgcacgagaccattacctagatcatcctaatcgaaaacccggcccgcgcctcgctctctcttgtctcgcccgctagctcccatcccagcctcccaccgcgcccgcctgccccaacatcccccctccccgctccgctccacgcacggctccagatctgctacggcggcggccggtggacgccgcgccgcgcgtgccggaggcggtgacgtgagcggcggatcctgcccggccgtgccatcctggcgacgatgacagcgtaagcgggcggcggacgaccgcgcccccccggcccctactcccgaggtcattggcgtgtgctccttggcagaaaaatggcgatgatggtggatccccccaatggcatggcaagtcaaggaaagcattactatactatgtggcagacactgtttgagatcgacaccaagtacgtgccgatcaagcccatcggaagaggagcttacggaatcgtttgctcatctgttaaccgcgagaccaatgaaaaagtcgcgataaaaagataaacaacgtcttttgacaccgtggggatgccctaaggaacgctgaaaaaagttaaaactccttccgcaccctggaggccgaaaaatgtaattgctccccaaggaa

SEQ ID NO: 19412 - protein, 62 aa, Zea mays
  misc_feature: Ceres CLONE 1386681-F
  misc_feature: SWISSPROT Homolog: EC 2.7.11.24 Mitogen-activated protein kinase
MAMMVDPPNGMASQGKHYYTMWQTLFEIDTKYVPIKPIGRGAYGIVCSSVNRETNEKVAIKR

SEQ ID NO: 19413 - DNA, 663 bp, Zea mays
  misc_feature: Ceres CLONE 1386685-F
  misc_feature: Translation starting site: 227
  misc_feature: SWISSPROT Homolog: EC 1.2.4.1 Pyruvate dehydrogenase (acetyl-transferring)
tggagctccccgcggtggcggccgctctagaactagtggatcccccgggctgcaggaattcgcacgagaccattacctagaacatcctaatcgaaaactccaccagtccaccatcgccacctacgcccaaccaaacccaactccatctcttccgactataaacgcaacccaccaccgctgccgcgaacctctgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggccatgaggtcttgctgtttgaagctcttcgtgaggccttgatggaagagatggaattagatccaacagtgtgtgtatttggtgaaagatgttggccattacggtggctcttacaaggtgacaaaaggtttggctgatacgtttggagaccatcgagttctggacacccctattgcggagaactcgtttactggcatgagagttggagcgcgaatgaaaagggctgaagccccgtcgttgaaggctgaaacatggagaa

SEQ ID NO: 19414 - DNA, 734 bp, Zea mays
  misc_feature: Ceres CLONE 1386687-F
tggagctccccgcggtggcggccgctctagactagtggatcccccggcatgaacgaattcacacgagaccattacctaaaacatcctaatcgataaattttctcgagaatattattcgtttaatgcatcataaaatcaatctacaactacaactaaacaatggtaaaatcactctttcgccttcttcatcatcatcatctgactacttattatatgtctgactgatcttgcctagattcccttaaccgtgtactaatgctggaaatacgtataggtatacatctactcaataaatctcataactctaacgctttccactcatcaccttctctggcttcctgagcacggcgtatctgctttacgcagtcatctcttcgcgctgattcttatcgtcctgtcatttgaggctcgaggtgcagtattgtcgagcctgcagctgctacacacgatgattaccttgatgttatgccagagatgactgcggatactctgcaactacagacgccgacgtacattgctactagctctattcgatatgatatcaagccagaatcactcttctccgccatacaggtccgggcacttgccatgaccacagcgagatccctcctcatgcaatatctgcctcatatggagcctaatccggcttcacactacgatgatgcatgtcctaacgatgacgcggaagactccgtggacgagacttgattggtcctcatacaagactgtcagcg

SEQ ID NO: 19415 - DNA, 646 bp, Zea mays
  misc_feature: Ceres CLONE 1386688-F
  misc_feature: Encodes the peptide sequence at SEQ ID NO. 19416
  misc_feature (553)..(553): n is a, c, t, g, unknown, or other
tggagctccccgcggtggcggccgctctagaactagtggatcccccgggctgcaggaattcgcacgagaccattacctagaacatcctaatcgaaaaagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctgttctcgatgatgttgtgaagcagtgcaggggcaggaacctcttctcagcactgatgttgagaagcacgtcgctgaggctgacattatcttttgtctcggtggaccaccccacaagaccccgggggctttggagcttncaaaggctgccgacctaccctactgggaagaaggctgcccggaggattgggggaatgcctccaggcctgaaaaaaaatggtgtgttgaaaaaa

SEQ ID NO: 19416 - protein, 129 aa, Zea mays
  misc_feature: Ceres CLONE 1386688-F
  misc_feature (2)..(128): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature (98)..(98): Xaa is any aa, unknown, or other
MVKICCIGAGYVGGPTMAVIALKCPDIEVVVVDISKPRIEAWNSDTLPIYEPVLDDVVKQCRGRNLFSALMLRSTSLRLTLSFVSVDHPTRPRGLWSXQRLPTYPTGKKAARRIGGMPPGLKKNGVLKK

SEQ ID NO: 19417 - DNA, 748 bp, Zea mays
  misc_feature: Ceres CLONE 1386698-F
  misc_feature: Encodes the peptide sequence at SEQ ID NO. 19418
  misc_feature (633)..(633): n is a, c, t, g, unknown, or other
  misc_feature (634)..(634): n is a, c, t, g, unknown, or other
  misc_feature (641)..(641): n is a, c, t, g, unknown, or other
  misc_feature (699)..(699): n is a, c, t, g, unknown, or other
  misc_feature (704)..(704): n is a, c, t, g, unknown, or other
  misc_feature (705)..(705): n is a, c, t, g, unknown, or other
  misc_feature (741)..(741): n is a, c, t, g, unknown, or other
aagctggagctccccgcggtggcggccgctctagaactagtggatcccccgggctgcaggaattcgcacgagaccattacctagaacatcctaatcgaaaaaacaatgagtccgcgcccacggccgaggcagctgcaggcagcggcccgtccggcggagaagggcggaagggcaaggcgcccaagggcgggcccgagaacggcaagttccggtaccgcggcgtgcggcagcggagctggggcaagtgggtggcggagatccgcgagccgcggaagcgctcccgcaagtggctcggcaccttcgccaccgccgaggacgccgcgcgcgcctacgaccgcgccgcgctcctcctctacggcccccgcgcgcacctcaacctcacctccccaccgccgcctacgctcgccgcgccgcgctcgcacccgcactcctcctccgccacgtcgtctgccccgccagcgctccgcccgctcctgccgcgcccgccactgcaccagctctccagcgatggtgctcctgcaccggatttccactaccacaaccagttccagcgccgtctcttgccacagccgacaccgacactatactacgccaacacggccacggcgtccacgtggaccaccaggtgccgannccgcggntgggcggtcccgcaggagccggccatcgcgcccgcagtagggctcctcgacgtcctanagganncccgaaggtaggtaaccccggaggaggcgcgcgggnaaaaaag

SEQ ID NO: 19418 - protein, 237 aa, Zea mays
  misc_feature: Ceres CLONE 1386698-F
  misc_feature (69)..(120): Pfam Name: AP2 Pfam Description: AP2 domain
  misc_feature (211)..(211): Xaa is any aa, unknown, or other
  misc_feature (233)..(233): Xaa is any aa, unknown, or other
  misc_feature (234)..(234): Xaa is any aa, unknown, or other
  misc_feature (235)..(235): Xaa is any aa, unknown, or other
AGAPRGGGRSRTSGSPGLQEFARDHYLEHPNRKNNESAPTAEAAAGSGPSGGEGRKGKAPKGGPENGKFRYRGVRQRSWGKWVAEIREPRKRSRKWLGTFATAEDAARAYDRAALLLYGPRAHLNLTSPPPPTLAAPRSHPHSSSATSSAPPALRPLLPRPPLHQLSSDGAPAPDFHYHNQFQRRLLPQPTPTLYYANTATASTWTTRCRXRGWAVPQEPAIAPAVGLLDVLXXXRR

SEQ ID NO: 19419 - DNA, 724 bp, Zea mays
  misc_feature: Ceres CLONE 1386701-F
  misc_feature: Encodes the peptide sequence at SEQ ID NO. 19420
  misc_feature (487)..(487): n is a, c, t, g, unknown, or other
  misc_feature (632)..(632): n is a, c, t, g, unknown, or other
ggagctccccgcggtggcggccgctctagaactagtggatcccccgggctgcaggaattcgcacgagaccatacctagaacatcctaatcgaaaatcaaggggtgacagggatattgacaaccaacaagcccttcaagcagaagataaggatgttgtgtcatctgtggccacagtgttatctgatctctgtggccctggagaatggatgcccatggcaaaactccacaacgagcttcttgagcagttcggcaatgtgtggcaccccagcagggtccggaagtacctgacacaggacgactggtcgccgacggagacgaagggcaggccttggttcggccttctggcgcttctcaggaagtacccggagcactttgtcatcaacacgaggtccaagggcagattgacctcggagttcgtctcgctggtctccttgctctcctagagggacggagagggcgtgttgtgtccagtcgtgtccagaggggntcggaggtgactgggctctcgtttgcttgccccttgctgtgtttcagcagctgttattgaccccaccctgttgtgtgtagtaaatctcgtgtggtcgagcagctggcactggtccgtgacggtcttctgtagtgtcggcaagaantgtatggaaagcatgtgcgttttaagttttaacctatgctagcaattcagcagcaggttcggtgattaccgtatccagcatgtatatcaatg

SEQ ID NO: 19420 - protein, 78 aa, Zea mays
  misc_feature: Ceres CLONE 1386701-F
MPMAKLHNELLEQFGNVWHPSRVRKYLTQDDWSPTETKGRPWFGLLALLRKYPEHFVINTRSKGRLTSEFVSLVSLLS

SEQ ID NO: 19421 - DNA, 889 bp, Zea mays
  misc_feature: Ceres CLONE 1386702-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (11)..(11): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (47)..(47): n is a, c, t, g, unknown, or other
nnnnnnccccnccccnnncccctccccccccacccccccccaggccnggcccaaaagctggagctccccgcggcggcggccgctctagaactagtggatcccccgggctgcaggaattcgcacgagaccattacctagaacatcctaatcgaaaaatccgctccccgccttccgcttccctaccccccgcatcacccaccaacgccgacaccatgggggccttcccgaaggaggagcactagttcctagccgagctcgggctcgcgcagcgcaacgcaggggcgttcgcatggggcgcgcggggcgggacaggtcccgccggcccctccacgagcccgaccaataatactgggtattcacagaggtcgtggaggcgttccgtgccactacctaagagtaggacatgccacgcctcgcttccaaaggccgccaaccaccttggaagtgcccagccccgcctcccacagtcgaggcacagcatcgcatgggcaaaactcggaggcatgccacatgaagagcaaaaggacacacctccagcctctggaggaggaataggtcgatcacagccgcacaaaaggcgtaaaccgctgcccctgacccgaaccggctaacacgccggcgccgtgttccccactaccaatccacccccaaccaagcctgacggataaaacaacatcgcgtgggcgcatcgacctggcggcatccctagatgtggcgtaaacaagtgtgcctcagctaccacgaacggagtccagcgcccgtataggaagccagagaccagtgaaagaccgaaaatcacccacaataaaaagatgcggtgtgcgcgccccctctcaccctccccttctcctccccttcacccccctcgcgcgaacactccactcttcag

SEQ ID NO: 19422 - DNA, 687 bp, Zea mays
  misc_feature: Ceres CLONE 1386704-F
  misc_feature: Translation starting site: 213
  misc_feature: SWISSPROT Homolog: EC 2.5.1.67 Chrysanthemyl diphosphate synthase
  misc_feature (573)..(573): n is a, c, t, g, unknown, or other
  misc_feature (586)..(586): n is a, c, t, g, unknown, or other
  misc_feature (589)..(589): n is a, c, t, g, unknown, or other
  misc_feature (601)..(601): n is a, c, t, g, unknown, or other
tggagctccccgcggtggcggccgctctagaactagtggatcccccgggctgcaggaattcgcacgagaccattacctagaacatcctaatcgaaaaacaaccgcaccacagtactctctccagtgtccacagaaacagaattccgctccctccccgtgtcctcctcccgcgcccgcgcatcgtgaggtggagttcccaccccgaggccgcaatggcgacggtggaggtggtggtggccaacggcttgggtggcgccgacaccaagaccgtgtttaaggaaacatacagcaagctcaaggaggagatgctagacgaccccgccttcgagttcaccgacgagtcgctacagtggatcgaccgcatgttggactacaatgtgctcggaggaaagtgcaatcgcgggctctctgtcattgatagctacaggatattgagggggtgttgatgttctgagcaaggaggagacatttcttgcttgcacccttggctggtgcattgaatggcttcaagcttattttcttgtgcttgatgatattatggacaactcccagacacggcgtgccaaaacttgntgggaattagagnggnccacaggttggncctcattgctgttaaagggatggggattatcccttcggcaatcatattttcacgaaatccttcaacgccactttcaggggaaggcc

SEQ ID NO: 19423 - DNA, 690 bp, Zea mays
  misc_feature: Ceres CLONE 1386715-F
  misc_feature (431)..(431): n is a, c, t, g, unknown, or other
  misc_feature (501)..(501): n is a, c, t, g, unknown, or other
aagctggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtcgatcgatcggtctatatagaaagacaggcgggtactacagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgccgcagctgctgcttccctacgnaggctccagtcgcggaacgagaagtgcaggtgctgccttgccgcagcatctccaccgcttgcgaggggtnaggattttcgtcgcagggcccgggccgttgcatcctcagtcgtcgggctccacaaaagcgggaaggggggttttgtagttgccaggccgtcccaccctcggggtcggggttccaaacgggccccctggaaccccccccccccccctcaaattttcttggggaaaatgggctccaaagtggggggggaag

SEQ ID NO: 19424 - DNA, 712 bp, Zea mays
  misc_feature: Ceres CLONE 1386716-F
  misc_feature: Encodes the peptide sequence at SEQ ID NO. 19425
  misc_feature (646)..(646): n is a, c, t, g, unknown, or other
  misc_feature (647)..(647): n is a, c, t, g, unknown, or other
  misc_feature (666)..(666): n is a, c, t, g, unknown, or other
aaagctggagctccccgcggtggcggccgctctagaactagtggatcccccgggctgcaggaattcgcacgagaccattacctaaaacatcctaatcgaaaactagcccagcaccgcagaggcgcagagacaggcgtcttcgtactcgcctatctccgcgactcaaagcttcttccatttcctaaccgccgccgctgcagctccaccccattccgtcgacaccatgagggagtgcattctcgatccacatcggccaagccggtatccaggtcggaaacgcgtgctgggagctctactgcctcgagcatggcattcaggccgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccgccagctcttccaccctgagcagcttatcagtggcaaggaggatgcagccaacaacttcgcccgtggtcactacaccattggcaaggagattgttgacctgtgccttgatcgcatcaggaagcttgccgacaactgcactggtctccagggcttcctcgtctttcacgctgnntggcggaggaacaggctcntggccttggatcctccatcctgaaagcgtctgtctggtgacttacg

SEQ ID NO: 19425 - protein, 119 aa, Zea mays
  misc_feature: Ceres CLONE 1386716-F
  misc_feature (14)..(119): Pfam Name: Tubulin Pfam Description: Tubulin/FtsZ family, GTPase domain
  misc_feature (106)..(106): Xaa is any aa, unknown, or other
  misc_feature (113)..(113): Xaa is any aa, unknown, or other
MPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFHAXWRRNRLXALDPPS

SEQ ID NO: 19426 - DNA, 710 bp, Zea mays
  misc_feature: Ceres CLONE 1386718-F
  misc_feature: Encodes the peptide sequence at SEQ ID NO. 19427
  misc_feature (631)..(631): n is a, c, t, g, unknown, or other
  misc_feature (632)..(632): n is a, c, t, g, unknown, or other
  misc_feature (660)..(660): n is a, c, t, g, unknown, or other
tggagctccccgcggtggcggccgctctagaactagtggatcccccgggctgcaggaattcgcacgagaccatttacctagaacatcctaatcgagaagagtatccgacagttcgccttcccgtctttccctctccccccacacccggtcgtcgtcgtcgcggcgtgagcgtctgagcgagcgtgcgagagcgagaggggggaacacaaaaccctagcaccgtcgccgacggacgccagagtagagagatggcggtggacgaggtgaattctgtctacgtcggcagccttccctacgaggccaacgaggagatgcttcgcgacgccttcgggtactacggcaccatcgtctccgtcaaggtgattaatgatcatactatcaaaggcaagtgttatggttttgttactttcactcaccccagagctgctgagcaagcaattgcaggcatggacggcaagaaattaggcaatcgtattattcgagtaaatgaagtgcgtacaagaggtccccgagattttggtcgagatggttttagacgagatccaagaaggtatggtagagatccatactgggacagaggggatagggaacagagctattgatcgtgaaagagatccctaccatgacaggnnatagtgatagatcccgcgagcatgatangagaagagattatgagcatggtgcttttttattagagaagtgactatccc

SEQ ID NO: 19427 - protein, 117 aa, Zea mays
  misc_feature: Ceres CLONE 1386718-F
  misc_feature (9)..(79): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAVDEVNSVYVGSLPYEANEEMLRDAFGYYGTIVSVKVINDHTIKGKCYGFVTFTHPRAAEQAIAGMDGKKLGNRIIRVNEVRTRGPRDFGRDGFRRDPRRYGRDPYWDRGDREQSY

SEQ ID NO: 19428 - DNA, 680 bp, Zea mays
  misc_feature: Ceres CLONE 1386723-F
  misc_feature: Encodes the peptide sequence at SEQ ID NO. 19429
tccccgcggtggcggccgctctagaactagtggatcccccgggctgcaggaattcgcacgagaccattacctagaacatcctaatcgaaaaaagtcaagtcggagcccgcaggtgtcgacaccgcgcgccgggagccggaagaagggtggggggtgagctgtggaccatgagcgcgaccgggcgagccccgtgcggcctgccgcgcatcggcctgggcacggcggtgcagggcccgcggccggaccccgtccgcgccgcggtgctgcgcgccatccagctcggctaccgccacttcgacacggccgcgcactacgccaccgaggcgcccatcggggaggccgccgccgaggccgtgcgcacggggctcgtcgcctcccgcgaggacctcttcgtcacgtccaaggtctggtgcgccgacgcgcaccgggacagggtgctcccggccctccgccggacgctcagcaatctccagatggaatacgtggacctgtacatggtgcactggcccgtgaccatgaaggccgggaggttcacggcccccttcacgcccgaggacttcgagccgttcgacatgcgggccgtgtgggaggccatgaaggagtgccaccccctgggcctggccacggcatcggtgggcgaaccttctcctgtaaaaagtccgagccctgttctcctttcc

SEQ ID NO: 19429 - protein, 171 aa, Zea mays
  misc_feature: Ceres CLONE 1386723-F
  misc_feature (7)..(171): Pfam Name: Aldo_ket_red Pfam Description: Aldo/keto reductase family
  misc_feature: SWISSPROT Homolog: EC 2.3.1.170 6'-deoxychalcone synthase
MSATGRAPCGLPRIGLGTAVQGPRPDPVRAAVLRAIQLGYRHFDTAAHYATEAPIGEAAAEAVRTGLVASREDLFVTSKVWCADAHRDRVLPALRRTLSNLQMEYVDLYMVHWPVTMKAGRFTAPFTPEDFEPFDMRAVWEAMKECHPLGLATASVGEPSPVKSPSPVLLS

SEQ ID NO: 19430 - DNA, 669 bp, Zea mays
  misc_feature: Ceres CLONE 1386725-F
  misc_feature: Encodes the peptide sequence at SEQ ID NO. 19431
aaagctggagctccccgcggtggcggccgctctagaactagtggatcccccgggctgcaggaattcgcacgagaccatacctaaaacatcctaatcgaaaaaactactccgtcactttgtttacaaagctcctcctcgatccatcgatcactgcaccggccggcggcaccgcgctcgcaggggctagccaacgagacggcagcaatggcggaccgagaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggcggagacgctgttcccgctgggcgggctgctgctggtgctgtcggggctggcgctgacgtcctccgtgggggggctggccgtgcccacgccggagttccagatcttctggcgcgagctcgtcccggccgcgatgctcatcgacacgagcgttcatgcattcactcacgtgggtgcattgaactctgctgcttatttgcaacaacaactaccattcaaccagctagctgctgcctacccccagcaatttcttccattcaaccaactagcagcattgaactctgctgcttatttacagcagcaacaactactacca

SEQ ID NO: 19431 - protein, 155 aa, Zea mays
  misc_feature: Ceres CLONE 1386725-F
  misc_feature (44)..(151): Pfam Name: Oleosin Pfam Description: Oleosin
MADRDRSGIYGGAHATYGQQQQQGGGGRPMGEQVKGMLHDKGPTASQALTAETLFPLGGLLLVLSGLALTSSVGGLAVPTPEFQIFWRELVPAAMLIDTSVHAFTHVGALNSAAYLQQQLPFNQLAAAYPQQFLPFNQLAALNSAAYLQQQQLLP

SEQ ID NO: 19432 - DNA, 728 bp, Zea mays
  misc_feature: Ceres CLONE 1386726-F
  misc_feature: Translation starting site: 226
  misc_feature: SWISSPROT Homolog: EC 1.1.1.1 Alcohol dehydrogenase
aagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagtagtagagagtgtcggtgaaggtgtgaccgagttccaagtcggtgaccacgttctcactgtcttcattggggaatgcaagagctgcaagcactgcgtctcagggaagagcaacatgtgccagaagctcggtcctggagaaggaagggtgtcatgcacagcgatcagaagacacgcttctctgtcaaggggaa

SEQ ID NO: 19433 - DNA, 753 bp, Zea mays
  misc_feature: Ceres CLONE 1386727-F
  misc_feature: Encodes the peptide sequence at SEQ ID NO. 19434
  misc_feature (659)..(659): n is a, c, t, g, unknown, or other
  misc_feature (739)..(739): n is a, c, t, g, unknown, or other
ggagctccccgcggtggcggccgctctagaactagtggatcccccgggctgcaggaattcgcacgagaccattacctagaacatcctaatcgaaaaacaaacacctccgatccgtccccgatcatcgcaccacctgtagcccacctcgctctcgagtctcgacccagcgacgagatggccgcggtggatctgaccccaaggacgcccaagaaggcctacggcggcgacggcggcgcctactacgagtggagccccgccgacctgcctatgctcgccgtcgcctccatcggcgccgccaagctctcgctcgccgccggcggcctctccctccccagctactccgactccgccaaggtcgcctacgtcctacaaggcgtcggtacctgcggcctcgtcctccccgaggcgacgaaggagaaggtggtggcggtgaaggagggcgacgcgctggcgctgcccttcggcgcggtgacgtggtggcacaacggccccgccgcgcaggccgacctcacggtgctcttcctcggcgacacctccaagggccacaggacgggggcagttcacaactccaggctcacgggggtccgcgggcatcttcacggcgtggtccacccgagttcgtgtcgcggcgggcgtggtaatctgccggagcccgacgncgtttaaaggtatgatgtcaaagccagtcgggcctcgggcagtcgtcaagttgctcgactccgtcgacgcgctcccgcgncactcgcgaaagaa

SEQ ID NO: 19434 - protein, 163 aa, Zea mays
  misc_feature: Ceres CLONE 1386727-F
  misc_feature (6)..(126): Pfam Name: Cupin_1 Pfam Description: Cupin
  misc_feature (162)..(162): Xaa is any aa, unknown, or other
MAAVDLTPRTPKKAYGGDGGAYYEWSPADLPMLAVASIGAAKLSLAAGGLSLPSYSDSAKVAYVLQGVGTCGLVLPEATKEKVVAVKEGDALALPFGAVTWWHNGPAAQADLTVLFLGDTSKGHRTGAVHNSRLTGVRGHLHGVVHPSSCRGGRGNLPEPDXV

SEQ ID NO: 19435 - DNA, 663 bp, Zea mays
  misc_feature: Ceres CLONE 1386732-F
  misc_feature: Encodes the peptide sequence at SEQ ID NO. 19436
  misc_feature (105)..(105): n is a, c, t, g, unknown, or other
  misc_feature (319)..(319): n is a, c, t, g, unknown, or other
tccccgcggtggcggccgctctagaactagtggatcccccgggctgcaggaattcgcacgagaccattacctagaacatcctaatcgaaaaatccaacgacgcanttgacatcccctcgcctaccccagctctacccgcgacgaagcatcaccaggaaggatgacgtgctcaatggatctcccggccaagggcgggttcagcttcgacctgtgccgccgcaacagtatgctggagaagaacgggctcaaactcccgggattcaggaagaccggaacaaccatcgtcggcctcgtctttcaggatggggttgttcttggngcagacacaagagcaactgaggggcctatagttgctgataagaattgtgagaagatccactttatggcgccaaacatttatttgtgtggagcaggaactgctgctgacactgaggctggtacagacatggtcagctcgcagctacagctgcaccgttacgcaacgggtcgcgaatctagagtcgtaactgctcttacccctgctgaagtccaatctctttaagatcaggggccatgtcagggctgcccttggtcttgggggggaggggattggactgggccgcctcttccacgtggttatccccacgcctccctggaaacctcctttggccccaaagggggtct

SEQ ID NO: 19436 - protein, 126 aa, Zea mays
  misc_feature: Ceres CLONE 1386732-F
  misc_feature: SWISSPROT Homolog: EC 3.4.25.1 Proteasome endopeptidase complex
MTCSMDLPAKGGFSFDLCRRNSMLEKNGLKLPGFRKTGTTIVGLVFQDGVVLGADTRATEGPIVADKNCEKIHFMAPNIYLCGAGTAADTEAGTDMVSSQLQLHRYATGRESRVVTALTPAEVQSL

SEQ ID NO: 19437 - DNA, 677 bp, Zea mays
  misc_feature: Ceres CLONE 1386741-F
  misc_feature (585)..(585): n is a, c, t, g, unknown, or other
  misc_feature (594)..(594): n is a, c, t, g, unknown, or other
tggagctccccgcggtggcggccgctctagaactagtggatcccccgggctgcaggaattcgcacgagaccattacctagaacatcctaatcgaaaacaattaccctgtttctatttaatatgctgtcatgatccaagtgacaattctctaggctggtgcggatgtgaacttgattgctccttctggagtaattttggctcaggcagtttgtgatgggtcaactgagattgtcaagtttttgctagaggttggagctgatcctaacattcctgatgaggatgggaaaatcccgatcatgtacccagcatttaatgggcatcgggagcttgttgaaattctatttcctaagacaagaccagtttcatctttgccagactggagcgttgatgggattattagaagtatgaaagatctgtttttcaagcctcaggatgcagctgtgatggaaaaaaagatagctgatgcgaagtcacaagggaaggaagctttcgcaaggggagagtaccctgcagcagtatacttctataccatggtactagagaacgaccttgatgctactgcgtttgccaaccggacctggtgtntttttgcgnctggaggtagggatccaaggctctgttacatgctcaacagtgcagaatgatacggcctcggatgttcgaaggcatgcctatcg

SEQ ID NO: 19438 - DNA, 756 bp, Zea mays
  misc_feature: Ceres CLONE 1386749-F
  misc_feature: Encodes the peptide sequence at SEQ ID NO. 19439
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (21)..(21): n is a, c, t, g, unknown, or other
nnnnnnnnnnnnnnnnccccnccgacaccccccgccgccgccccccctccaaagctggtgctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcatgctgacgcgggcgaggacggcgacagcggcgtggacgcctacgtctccggctcgggaaggggggagtgcccggcgccagggacttgcccgcacagggggccagacgcgggaaaaccccgcaaggcaaggagggggccgaaacccgcccggcaccgtgacgccaggcccgcttgttaccgttgccgtttcgtcccctgggcgagggagagggtcgaccggcccccttatacgatcttggtcaccccccttccccccagtctacctttcccctca

SEQ ID NO: 19439 - protein, 164 aa, Zea mays
  misc_feature: Ceres CLONE 1386749-F
MGKGSVGASWWAFLLLAGVLLVVAATAGAEDGVVERDRKEDLRWCKQACEWQYGKDTPRKRECESECRERHQHADAGEDGDSGVDAYVSGSGRGECPAPGTCPHRGPDAGKPRKARRGPKPARHRDARPACYRCRFVPWARERVDRPPYTILVTPLPPSLPFPS

SEQ ID NO: 19440 - DNA, 726 bp, Zea mays
  misc_feature: Ceres CLONE 1386753-F
  misc_feature: Encodes the peptide sequence at SEQ ID NO. 19441
  misc_feature (426)..(426): n is a, c, t, g, unknown, or other
  misc_feature (434)..(434): n is a, c, t, g, unknown, or other
tggagctccccgcggtggcggccgttctagaactagtggatcccccgggctgcaggaattcgcacgagaccattacctagaacatcctaatcgaaaaagttgccatctcgcaaagtcgcaataacttgtcttctcgaatcggctgcaaccccaccccagaccccaccgccgccgccgctagggttttggggtgaggatcgccgatgtcgacggctcccaggcgtcccttccgaggccgcggcgccatgccctcgggcaccggctacgtccgccgcggccccgccccaggctccgccgacgccgccaagcccctgcgcaagcccgtcttcaccaccgtcgaccagcttcgcccccagacacacggtcacactctcacaagcccgcggtcattgccgtcccgaaccggtcctcgacaagccttcaagnacctcggncggaaccgggttgccgagtgcctcgtcggagaaaggacccggaccggccctcggttccccggccgcggaaagaaaagggggggcccttttgaaacccaaaaaaaagggtttttcccaaaggcccaaatttgtttttttaggggccccttgaaaaggggggggaaaaaagggccccccaaaaaagggaaaattttttttttttttttggggggggagagaacaaccactttctctcggggggaaaacacccttgggggggggggtttaaaaaaagggggggggttgctcattt

SEQ ID NO: 19441 - protein, 160 aa, Zea mays
  misc_feature: Ceres CLONE 1386753-F
  misc_feature (61)..(61): Xaa is any aa, unknown, or other
MPSGTGYVRRGPAPGSADAAKPLRKPVFTTVDQLRPQTHGHTLTSPRSLPSRTGPRQAFKXLGRNRVAECLVGERTRTGPRFPGRGKKRGGPFETQKKGFFPKAQICFFRGPLKRGGKKGPPKKGKIFFFFLGGERTTTFSRGENTLGGGGLKKGGGLLI

SEQ ID NO: 19442 - DNA, 856 bp, Zea mays
  misc_feature: Ceres CLONE 1386754-F
  misc_feature: Translation starting site: 259
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (19)..(19): n is a, c, t, g, unknown, or other
  misc_feature (21)..(21): n is a, c, t, g, unknown, or other
  misc_feature (24)..(24): n is a, c, t, g, unknown, or other
  misc_feature (25)..(25): n is a, c, t, g, unknown, or other
  misc_feature (38)..(38): n is a, c, t, g, unknown, or other
  misc_feature (44)..(44): n is a, c, t, g, unknown, or other
  misc_feature (52)..(52): n is a, c, t, g, unknown, or other
ntgttttnncccccccccncnccnnaccctccccctanggtgtngggcgcgnccccccaaagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgggggcggcaacatcaccctgttccgggggctcctgtactgggtggcgcagctgctggggtccaccgtggcgtgctccctgctccgcttctcgacgggcgggcaggccacgggcacctttcggctggacggccgtgtcggtgtgggaaggcgctgggtgctgggagatcgagatgaccttccgggttgggggaccacgggggacggccaccggggggtgggaccccgaagaaaggggaagcctgggggcaccatccgcccgccaattgggcatcgggctttcattcggggggcacaacaaatctcccggcggggggggc

SEQ ID NO: 19443 - DNA, 824 bp, Zea mays
  misc_feature: Ceres CLONE 1386756-F
  misc_feature: Encodes the peptide sequence at SEQ ID NO. 19444
  misc_feature (268)..(268): n is a, c, t, g, unknown, or other
  misc_feature (332)..(332): n is a, c, t, g, unknown, or other
  misc_feature (387)..(387): n is a, c, t, g, unknown, or other
  misc_feature (747)..(747): n is a, c, t, g, unknown, or other
  misc_feature (753)..(753): n is a, c, t, g, unknown, or other
  misc_feature (754)..(754): n is a, c, t, g, unknown, or other
tggagctcccaccgcggtgggcggccggctctagaactagtggatcccccgggctgcaggaattcgcacgagaccattacctagaacatcctaatcgaaaaacggggcacaggacgcgcgcgatcccctcgagtccggattgccatggccaccacggcgttcgccgccgccaggttcttccccgcccacctcgactcctccccacgcatcgcgccccaccgcgtcgggcccaccgcgaatctctcctttctcacgcttttcgcaactncctcgtcctgctcccggctcatttcccctggccatccgcccccggggtaagctgcccccgccgncgcgatcgtacggcgcggcgggggattctggcaccccccaaactccggtgcgggnaaagcccgcccggaagatccctcggctcctcctcgcgggggggcccccccggttccttgggaacccaatttccctttaagggggttctggaagaattccccggggacccccttgggggtttggaaaagggccccccccccaaatttggcccaaaagggtgggattttttttctcccacggggggggggaaacacccaaatttcccccagagacccccccccccccccccggggtgtcccccccccccgtttttcccccggggcccttccccccaaaaatgtttgagggggggggggaattttcctctctccccgggaaaaaaatttttaaggggggccccctttggggggggggttttgngggggnnactcctacaaaaaaattttcccccccggtttttatagagaagaaaaaaatccccggggggggaaaaaaac

SEQ ID NO: 19444 - protein, 57 aa, Zea mays
  misc_feature: Ceres CLONE 1386756-F
  misc_feature (42)..(42): Xaa is any aa, unknown, or other
MATTAFAAARFFPAHLDSSPRIAPHRVGPTANLSFLTLFATXSSCSRLISPGHPPPG

SEQ ID NO: 19445 - DNA, 817 bp, Zea mays
  misc_feature: Ceres CLONE 1386760-F
  misc_feature: Encodes the peptide sequence at SEQ ID NO. 19446
ggagctccccgcggtggcggccgctctagaactagtggatcccccgggctgcaggaattcgcacgagaccattacctagaacatcctaatcgaaaaaccgccgattgccacagacccccgagaatcagattagatccacgtccagctccattcgcagctcgcgaccagagggcgagagttagcataaaggtccgtgactctgatcatgaacaggattgtcccgtcatagcctccagaaggcgtaccacccggaaggcctcctgggaaagttcgctgagtacatctccaccctcatcttcgtcttcgacgggcagtgctccaggatggacttcaacaagctgaccgtcggcgttcccacaaccccagctcccctgatcgcggcggcgatgaacgacacgatcctgactgttcctgttcttggatgcgtacgcaatgatctccggtgagtacgcgaatcctgccgtgacatgcggcggcttcgggtgtggcagcatcacctgtgaccgagggctcttgtactgctcgccgtacgtgatgtcgtccacagagccatgattcatgatcacttcctcaaagaacgcattcgccccggttacatctcgactgacgatcgtactctctctgggaggctctggggactaaaatgactctagatcatcggtttgttgcgacccctatacgccatggttgggggacctccaaaaagggacgatgggcaacatcccccccgttgccatcgttttcatcgtggtggccccattccgggggggagggaggctttaaacgtcccgtcaatgaacacgggcggggcctttag

SEQ ID NO: 19446 - protein, 40 aa, Zea mays
  misc_feature: Ceres CLONE 1386760-F
MDFNKLTVGVPTTPAPLIAAAMNDTILTVPVLGCVRNDLR

SEQ ID NO: 19447 - DNA, 659 bp, Zea mays
  misc_feature: Ceres CLONE 1386760-R
cgattgggtaccgggccccccctcgaggtcgacggtatcgataagcttttttttttttttttttactctggcaaatgctcttatctttcacaacctgactggtccggaattcacggttacgagcagctcaacctgacggcgactactgctgatccaaggaaaagcaaactatgcgagcggcgccggcgcagcggcggcctgagacagtcgactatgcatgcacgtgcacgaaagaaactagaacggctgctagcggggacagagagctggatgcgctagctgcactgcgcacccctaggtcggtcggcttcggcttttagtagtcggtggaggggagctgctcatgggtgtgggagatgaagagcagctcgtaaatgacgccggctaggccgccgcctatgaggggcccgacccagtacgccctctgggagccccactcccagctgacgagggcggggccgaacgacacggcgggggtcatggacgcgccgaccaatgcgccgcccaccacgatgttggcccccacgatgaaccccatggcaatgggggagatggtgaccaggctgcccttcttctggtccacccccgtggcgtacaccgtgtactccagccctaagggcatcacaatatcctgctccagagcctcccacagcgacagg

SEQ ID NO: 19448 - DNA, 800 bp, Zea mays
  misc_feature: Ceres CLONE 1386761-F
  misc_feature: Translation starting site: 294
gctctagaactagtggatcccccgggctgcaggaattcgcacgagaccattacctagaacatcctaatcgaaaaccggtcctccacacttcactgtctctcacactcacacagtctcacaaaggctcgtgggctcgtggcctggcctctataaacccccgcccagccggtcacccccaccccatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcaggagccggccataaccatgaggtaccacaaggggcgcgctcctgtcgggccccatcgcccgcaacttcatctggtacggcgacttctcggcgccgcagcgggcggagatcaccgacttcgtctcgtcgcttacgggggcggccccggccgcggcgcaacccgaagccgtccggggccacgtggtttcaagacgggggcgcaagaactacgccaggctccaagggggcggttccggggggctgggccttcggttccccagcccgtcgaacgggaaatggttcccccggaagggccgccggacagaaaaagggaccttggcttcaggttccgccggcacaggggaaccccccgaagccgcggccattcaaacctgggtggttccacggcccgcccaacgtgggacccc

SEQ ID NO: 19449 - DNA, 697 bp, Zea mays
  misc_feature: Ceres CLONE 1386766-F
  misc_feature: Encodes the peptide sequence at SEQ ID NO. 19450
ccccgcggtggcggccgctctagaatagtggatcccccgggctgcaggaattcgcacgagaccattacctagaacatcctaatcgaaaaaaaaccctagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgccaaggccattgagaagcatgctgctcagctttgcgttcttgctgaggactggtgaccagccaggataatgtcaaagcttggtgaaaggaccctcctgggctgaacccatgttcaccttggccctggtcctgctgctaaaaatcttggcaaggggcctgggcttttgcaaaaattacccccaaggggaaaggaaaaagaaaagttttaaagttttgtccctggtggtttttcggggcatcccgggaaaaatctggggggctaaaaaaaggggggagatttttcccccccccccaaaaaggagaacgggtttaaaaaaaaccccaaatttttgggggggggggggggaaaaaaaaaaaaaaatcctctcgcccccccggtgttttt

SEQ ID NO: 19450 - protein, 65 aa, Zea mays
  misc_feature: Ceres CLONE 1386766-F
MADQEAPVAVEAPTPVLGEPMDLMTALQLVMKKSSAHDGLVKGLREAAKAIEKHAAQLCVLAEDW

SEQ ID NO: 19451 - DNA, 820 bp, Zea mays
  misc_feature: Ceres CLONE 1386768-F
  misc_feature: Encodes the peptide sequence at SEQ ID NO. 19452
  misc_feature (78)..(78): n is a, c, t, g, unknown, or other
  misc_feature (88)..(88): n is a, c, t, g, unknown, or other
ggagctccccgcggtggcggccgctctagaatagtggatcccccgggctgcaggaattcgcacgagaccattacctangaacatcctnaatcgaaaagcgattggcgattccatttctaccccgagacctccagccttccgcccctgaaccctcagccttctccgtcccgcctcggcactcgacggccgccggcacacaccgcgcagtctcgagacaggaaccggaggaacgaggatggaggatgactcgccgctgacgaatacgatgaagggtgcggtgacaggactcgccgacgagaccatctgtggcaccgtcgtcgccacctggtacgacgtgacccgtgtggagcgccacgtcgcgctccctgcccttatcgggacgctcaagatgtgcggcacctacggagccacttccgccaccatcgggggcctctacatcggggtcgagcagctcgtgcaaagccaaggcaaaaagggggacttcctaaaggggccgtcggggaagtcggtggccgaagcctttgtctggggctcacggggaaaagggtttcattcggcctcctcggaggttcggggaggggtttcacattgggggggcgggaacttgggggaaaaccccccaggttgaacggggaaaaggtcttttcccccaccctttgaaaaaaagccgggatttttctccaaaggcgcgcttttaaaaaaaaattttgggcccccccaccccccggttttttgagggggggggcgctttttttgtttgttttcggcggagaattattttttaaaaccccccgggggcttttttcttccgggggggggg

SEQ ID NO: 19452 - protein, 130 aa, Zea mays
  misc_feature: Ceres CLONE 1386768-F
MEDDSPLTNTMKGAVTGLADETICGTVVATWYDVTRVERHVALPALIGTLKMCGTYGATSATIGGLYIGVEQLVQSQGKKGDFLKGPSGKSVAEAFVWGSRGKGFHSASSEVRGGVSHWGGGNLGENPPG

SEQ ID NO: 19453 - DNA, 781 bp, Zea mays
  misc_feature: Ceres CLONE 1386769-F
  misc_feature: Encodes the peptide sequence at SEQ ID NO. 19454
  misc_feature (531)..(531): n is a, c, t, g, unknown, or other
  misc_feature (635)..(635): n is a, c, t, g, unknown, or other
  misc_feature (641)..(641): n is a, c, t, g, unknown, or other
tacccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaccctttctccctactctcagcaacaacaatttcttccattcaanccactgtctacactgaaccctgctgcttatttgcagcaacaactattaccattcaggcagctagctactggctactctcagcaacacaacttcttccatttaancaatgnccgcactgaaccccgctgcttattgcagcagcaatactactaccattttagcagctagctgcaacaacccgggttccttcatgaccagcaacagttgctgcctttctacaagagtttgcgctaaccccgaaccttcttaa

SEQ ID NO: 19454 - protein, 179 aa, Zea mays
  misc_feature: Ceres CLONE 1386769-F
  misc_feature (124)..(124): Xaa is any aa, unknown, or other
  misc_feature (159)..(159): Xaa is any aa, unknown, or other
  misc_feature (161)..(161): Xaa is any aa, unknown, or other
MATKIFSLLMLLALSACVANATIFPQCSQAPIASLLPPYLPSMIASVCENPALQPYRLQQAIAASNIPLSPLLFQQSPALSLVQSLVQTIRAQQLQQLVLPVINQVALATLSPYSQQQQFLPFXPLSTLNPAAYLQQQLLPFRQLATGYSQQHNFFHLXNXRTEPRCLLQQQYYYHFSS

SEQ ID NO: 19455 - DNA, 835 bp, Zea mays
  misc_feature: Ceres CLONE 1386775-F
  misc_feature: Translation starting site: 168
  misc_feature (516)..(516): n is a, c, t, g, unknown, or other
  misc_feature (610)..(610): n is a, c, t, g, unknown, or other
  misc_feature (628)..(628): n is a, c, t, g, unknown, or other
  misc_feature (629)..(629): n is a, c, t, g, unknown, or other
  misc_feature (640)..(640): n is a, c, t, g, unknown, or other
  misc_feature (657)..(657): n is a, c, t, g, unknown, or other
  misc_feature (676)..(676): n is a, c, t, g, unknown, or other
  misc_feature (677)..(677): n is a, c, t, g, unknown, or other
  misc_feature (737)..(737): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (755)..(755): n is a, c, t, g, unknown, or other
  misc_feature (756)..(756): n is a, c, t, g, unknown, or other
  misc_feature (769)..(769): n is a, c, t, g, unknown, or other
  misc_feature (770)..(770): n is a, c, t, g, unknown, or other
  misc_feature (800)..(800): n is a, c, t, g, unknown, or other
ggagctccccgcggtggcggccgctctagaactagtggatcccccgggctgcaggaattcgcacgagaccattacctagaacatcctaatcgaaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaaccntgcggcgttggcagcaccccgatcctgggccagttgcgtcgagtttctgaggcatcagtgcagcccgacggcgacgccctactgctcgcctcangtgccagtcgttgccggnnagcagtgttgncagcagcttcaaggcanggtggagccgcagcacggnntgcaggcgactcttttcggtttttggtcctcccagtccatcctgcacagagccgcaaggnccagnnnnnnnnnnnngnntgtttttgtttgnncggggaatatacgcacaaactttttttccngttaattgggcgtccctgcacaagccgactcatgc

SEQ ID NO: 19456 - DNA, 809 bp, Zea mays
  misc_feature: Ceres CLONE 1386777-F
  misc_feature: Encodes the peptide sequence at SEQ ID NO. 19457
tccccgcggtggcggccgctctagaactagtggatcccccgggctgcaggaattcgcacgagaccattacctagaacatcctaatcgaaaaattttctgctcttctgccgtctagtcctttgtactgaccggcgctccggtcggctcctcgcgcttgcgggttccccgtccccaccccacgccgggtgcaagagatggagaacggggtggcgctccggaagtggtttgaccgcggcgacgccggtcgtaccggttacatccccgctgcccagctccagggagtgatcgctgccggaaacctcaacttccccatctccgccgagcagcagatgattaggatgtatgacttcaatcgaaatgtatccatgaagttcgaagagtttctggctcttataaattcctagagaaggtggaaaatgtgtttttccgccctggataggggtcgaggatttcttagtcttgaggaggcgtacaagtcagtaatcaaattgggcttctcgtgagattccccagccttttatactgtttgagaggactttgacgaaaccagaaagggtatgattcaattgattaaaactatatcactctggaatttttgggcagcccgcccgaaaccggttgaattcccttctatacaagtggccaggcagaaggacttttgatttttgcccaattcgggtactgcaacgcaaaatgcgagtaataagtggggttggacatgtccccccaaaacaaaaagaaagccgggggaaattggtaaaccggttcccaattaaaacctccctttctgaaccgcgaaacctggggaa

SEQ ID NO: 19457 - protein, 69 aa, Zea mays
  misc_feature: Ceres CLONE 1386777-F
MENGVALRKWFDRGDAGRTGYIPAAQLQGVIAAGNLNFPISAEQQMIRMYDFNRNVSMKFEEFLALINS

SEQ ID NO: 19458 - DNA, 1056 bp, Zea mays
  misc_feature: Ceres CLONE 1386778-F
  misc_feature: Encodes the peptide sequence at SEQ ID NO. 19459
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (988)..(988): n is a, c, t, g, unknown, or other
nnnttttnnnnnncccnnnnnncccccccccccccnnnaagaaaaatggaaaagctggagctcaccgcggtggcggccgctctataactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtaaccgcagcggcatctacggcggtgcccacgccacctacgggcagcagcagcagcacggaggaggcggccgcccgatgggtgagcaggtgaagggtatgctccacgactaggggccgacggcgtcccaggcgctgacggtggtgacgctgtctcccgctgggcgggctgctgcctggcgctgtccggggctgccgcctgacgaccttcccgtgttggcccttgtccgtggccccaccccggtggtttcttgattcttcaactcccgtagatccgtcccccgccgccgcttgcttccaccgcgaaccgatccctcaattcgaacatccccatcaaggcccggatctacaccttacggtctcctcgtgacaaattttagtccctatcacatttaaactatagtattcagacactactctcctgccccccccattcatcgctgagctaccccccctccacctctccccgcctacacacccctatgaacacgcaatagcctcactaacgggctagtttaattattctctacccacacacgattcttcgtaatgggagggcgctcaacatcaaccaaagattgccttctgcctcgccccaccagcccctaccattatgagcacaatacgccgcgtagcactaaccatcctctccctcataactattatcattaagtcttcatatcaatgaaatcgccccttcgccccccacgacacagaagacacnaagacagacgttaggacccccctcaacgccacagcactgttcattgtgagagaggtcgtcgacacaga

SEQ ID NO: 19459 - protein, 40 aa, Zea mays
  misc_feature: Ceres CLONE 1386778-F
MADRNRSGIYGGAHATYGQQQQHGGGGRPMGEQVKGMLHD

SEQ ID NO: 19460 - DNA, 801 bp, Zea mays
  misc_feature: Ceres CLONE 1386779-F
  misc_feature: Encodes the peptide sequence at SEQ ID NO. 19461
tccccgcggtggcggccgctctagaactagtggatcccccgggctgcaggaattcgcacgagaccattacctagaacatcctaatcgaaaaaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaagccgtgcttccttcttgacacagcaacagttgctgcttttctaccagcagttttgcgctaacccccgcaccctctttacactacacagttggtgc

SEQ ID NO: 19461 - protein, 215 aa, Zea mays
  misc_feature: Ceres CLONE 1386779-F
  misc_feature (1)..(209): Pfam Name: Zein Pfam Description: Zein seed storage protein
  misc_feature: SWISSPROT Homolog: EC 3.1.13.4 Poly(A)-specific ribonuclease
MATKIFSLLMLLALSACVANATIFPQCSQAPIASLLPPYLPSMIASVCENPALQPYRLQQAIAASNIPLSPLFQQSPALSLVQSLVQTIRAQQLQQLVLPVINQVALANLSPYSQQQQFLPFNQLSTLNRAAYLQQQLLPFSQLATAYSQQQQLLPFNQLAALNPAAYLQQQILLPFSQLAAASRASFLTQQQLLLFYQQFCANPRTLFTLHSWC

SEQ ID NO: 19462 - DNA, 775 bp, Zea mays
  misc_feature: Ceres CLONE 1386782-F
  misc_feature: Encodes the peptide sequence at SEQ ID NO. 19463
  misc_feature (553)..(553): n is a, c, t, g, unknown, or other
gctctagaactagtggatcccccgggctgcaggaattcgcacgagaccattacctagaacatcctaatcgaaaaagcacagatccatcggagtgacagcgagcgagagcgagagagacagagagattgtccgcgcgtcagcgactcccggcgaagacgatggggaaggggttcgcatcctacctggcgatgaagacggggccggagggcggcgacgcggcggcggcgcagcaggctctgatcgacggcggacctgcgggagctcggcgtcgcccgcgcggaagctccgccaaccacgcaatttggtcctcggcggcgggcttggggttcggcaccttcttccctcaatgggtgggccttcccccgccccaatggtttcccttggaatttgggtccgcccccattgggaaaacccacttgggtggacggctcctctggggtcccttaactttttccttcccccgggccaaaggggggtggttttccctgggaccaaggggaggggggggggaaaaggggtttcgggaaatttttgggggtttttccgggggtgnattttcttttcccccccccccttttcccaaaaagggggttaaaaggtctctccgggggttcaccactatcccggggcgccaacgagggggggcccccccccacaccttgttttgggggaaaaaacttcttttgggggggaccaccccccgcgggggaggggctcctccaaaagcgccctctggggaacacgaagaggttttccccttgttcccccaaaaacc

SEQ ID NO: 19463 - protein, 205 aa, Zea mays
  misc_feature: Ceres CLONE 1386782-F
  misc_feature (132)..(132): Xaa is any aa, unknown, or other
MGKGFASYLAMKTGPEGGDAAAAQQALIDGGPAGARRRPRGSSANHAIWSSAAGLGFGTFFPQWVGLPPPQWFPLEFGSAPIGKTHLGGRLLWGPLTFSFPRAKGGWFSLGPRGGGGEKGFREIFGGFSGGXFSFPPPPFPKKGVKRSLRGFTTIPGRQRGGAPPHTLFWGKKLLLGGTTPRGGGAPPKAPSGEHEEVFPLFPQK

SEQ ID NO: 19464 - DNA, 690 bp, Zea mays
  misc_feature: Ceres CLONE 1386783-F
  misc_feature: Encodes the peptide sequence at SEQ ID NO. 19465
  misc_feature (471)..(471): n is a, c, t, g, unknown, or other
  misc_feature (472)..(472): n is a, c, t, g, unknown, or other
cgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagcttgacgcgggcgaggacgcgacagcgcgtggacgctacgtctccgctccgnnagggcgagtgccgcgcagtgctgcgcgcacgaggccagccgtgggagaccaggatgcatgagcgtgccgcgccgcgactggcgtccacatgagcagatacggtccggcaacaaagcgcgggcagggccggaaaagtgccacgcccccacccgggaactgggggaaaagcaagctgccatgataaaaaaaaccccgggggggggaaaaagaaaggcccg

SEQ ID NO: 19465 - protein, 74 aa, Zea mays
  misc_feature: Ceres CLONE 1386783-F
MGKGSVGASWWAFLLLAGVLLVVAATAGAEDGVVERDRKEDLRWCKQACEWQYGKDTPRKRECESECRERHQQA

SEQ ID NO: 19466 - DNA, 746 bp, Zea mays
  misc_feature: Ceres CLONE 1386785-F
  misc_feature: Encodes the peptide sequence at SEQ ID NO. 19467
  misc_feature (581)..(581): n is a, c, t, g, unknown, or other
  misc_feature (628)..(628): n is a, c, t, g, unknown, or other
gcggtggcggccgctctagaactagtggatcccccgggctgcaggaattcgcacgagaccattacctagaacatcctaatcgaaaaacgcacctcccgacttctccggttctcccttcttcatagcagccacccacgcatctcagcgccgaggcgagcgaggacctcgtggttcgtgccctgctcacctcgtgaggatgtggatcgcgaggcggctcttcctcgcggcggcggcgctgctgatggctgtgcttctgctcgtcgcggggccggtggcggcgcaggacgcggcggtggagggcgtggccccgcctgcggaggagatcgcggcgaacgcgagggccaaggaggcggcggttctggccgccgagctagtgcagctcagggcgaagatctccgcgttagagtctcgcattgcagagcagaacctggagttcaagaccaagaatgatgcaatcgaaacactgaatatgattgtcaaggaaaagtcacagaagatgctactatgcagaaatgagtaacttccctcgaggcaaagggtcttagctgcagaggagcaggccagcaaggccaatgcactgnctattgagctcaagaagcagaacgagaagctcaggaaggatattacngaaccaaaatttaaaaagccgctctggagggtagggctggcatggcttaataaaaaggtgcaaactaaatatggagcttggaaaaagtcccagggacaaacagggtccaaaggcgcag

SEQ ID NO: 19467 - protein, 107 aa, Zea mays
  misc_feature: Ceres CLONE 1386785-F
MWIARRLFLAAAALLMAVLLLVAGPVAAQDAAVEGVAPPAEEIAANARAKEAAVLAAELVQLRAKISALESRIAEQNLEFKTKNDAIETLNMIVKEKSQKMLLCRNE

SEQ ID NO: 19468 - DNA, 1041 bp, Zea mays
  misc_feature: Ceres CLONE 1386797-F
  misc_feature: Encodes the peptide sequence at SEQ ID NO. 19469
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (33)..(33): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
ncccccccnnnnnnnncnccccncnnnnncccnccccccgcccccnnnnnnnnnnggcccgtcctctccacattgggggctcaccgcggtggcggccgctctagaactagtggatcccccgggctgcaggaattcgcacgagaccattacctagaacatcctaatcgaaaaacgaagagcagcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcagggagtacctaccaatcaccggtctggctgaattcaataagctgagcgctaagcttatcttttggcgctgacaggcctggctattcaggaaaataggggttgctaccggggcaggggcctatcgggggtactggtttctttaaagaggccgggagggggaattttctttggaaggggcacttattcacgggagggggcacttattctaacttccccacaaaaccccaagcgcggggggaaaaattcacaccccaagaaaggccctttccccccccctaattttgggggctttgggaaaccgtttaaggggaggcttaaccgggcttattttaatgggattccctgggaaacaaatggccagcgcctttccacttttcggaaagggaacttcctgggaaaaagaaccctccgggggttcgtgcgctccctttccggggtttcaaattttggaactggggttggaatggcccttgggcctcccacaaacccctacactggggaggaaaaattcctaacccattggaaaaggggggggaaaacagcatttagcggcgggttggggggaggaataaaaaaaccccgtgcgtttccccgttctttgtgg

SEQ ID NO: 19469 - protein, 93 aa, Zea mays
  misc_feature: Ceres CLONE 1386797-F
  misc_feature: SWISSPROT Homolog: EC 2.6.1.1 Aspartate transaminase
MASQGSSVFAALEQAPEDPILGVTVAYNKDPSPVKVNLGVGAYRTEEGKPLVLNVVRRAEQMLINNPSRVREYLPITGLAEFNKLSAKLIFWR

SEQ ID NO: 19470 - DNA, 727 bp, Zea mays
  misc_feature: Ceres CLONE 1386806-F
  misc_feature: Encodes the peptide sequence at SEQ ID NO. 19471
atagctggagctccccgcggtggcggccgctctagaactagtggatcccccgggctgcaggaattcgcacgagaccattacctagaacatcctaatcgaattctattccaccgctcaccacaagaagccacctcaggctcacgccgcggatccacacgagcaaatcccgccgcttcctccccacgcaccccttcccatccttcccgaagcacgaggcgagccgggccgccggatatggcgccggcggcgccgtacggcggggacgagtcgcagcgggaggcggacctactcaagcaggagggcaacgcctttttcaggaaggaacgcctcagcgccgccatcgacgcctacaccggggccataactctttgcccaaatgtgggggtatattggaccaaccgagcactttgctataggaaggggaatgagtggaacaagagttggggaaaattgcagaacagctatcccagcttgacagccaggctgttaaggcacattacatgctccgggaatctctggccaacggccctggattatcaggaaggaacaagaatcactggagaaggcccttggggctttggaaggggttgcacctccctggcaagctgcctggtgggaagaggatctggcagggaagctttctcaaggcgaaaatacatcggaatggggaaagccttatcgaaggaagaccgaacctgtgccgactggcaagaagcctgaaaggtaa

SEQ ID NO: 19471 - protein, 161 aa, Zea mays
  misc_feature: Ceres CLONE 1386806-F
  misc_feature (16)..(49): Pfam Name: TPR_1 Pfam Description: Tetratricopeptide repeat
  misc_feature: SWISSPROT Homolog: EC 3.1.3.16 Phosphoprotein phosphatase
MAPAAPYGGDESQREADLLKQEGNAFFRKERLSAAIDAYTGAITLCPNVGVYWTNRALCYRKGNEWNKSWGKLQNSYPSLTARLLRHITCSGNLWPTALDYQEGTRITGEGPWGFGRGCTSLASCLVGRGSGREAFSRRKYIGMGKALSKEDRTCADWQEA

SEQ ID NO: 19472 - DNA, 807 bp, Zea mays
  misc_feature: Ceres CLONE 1386807-F
  misc_feature: Encodes the peptide sequence at SEQ ID NO. 19473
ggagctcaccgcggtggcggccgctctataactagagaatcccccggcatgaaccaatacaaaggagaccattacctacaacatcctaatcgaaaaaacaatgttccctctgaacgcgctgctcctgctgctgccgcgactggcgatggcagcctccacggtggggatgagcctgaacacgcccgtgttcctgctcttcagcaccatgatcgtcaccgccgcgctgctcatcaacacgagcatcgcggtcaacctcacgacggccgagctggtgctcgccggactgtcctcactaacgtgcctcgaacaaaaggcgcggaatgagttccagcgaagacccggaactacgtcatagaaggcatctccaccacctatgagaagaaaccacgcgacgccaccagttcacaccaagaacagcgccagggacggccctacgcgcatttccaaaagacaagagcgacaggtaggcccgtctgaatgaccaactggacgaccctcgcgacccgcccaggaaagctaccctcctgaaaataaaaaaaaaaccccttccattagaaatgacctggacagggtcaaccgccaaaaaaggggcgcccccgaagccaaaggcgtccttcccctgataacagggaggaaaaccgaccttcttggattcgtcattacacccaagtggccgggaaaaaaaaaacccctggcgactacgacacggaccaagatgcaaccccccaaaacttgaaaaacagggtgccccacctgtaaaaacaaaaaattggattaaccacaacctcgaactggaaaacaaaaaag

SEQ ID NO: 19473 - protein, 84 aa, Zea mays
  misc_feature: Ceres CLONE 1386807-F
MFPLNALLLLLPRLAMAASTVGMSLNTPVFLLFSTMIVTAALLINTSIAVNLTTAELVLAGLSSLTCLEQKARNEFQRRPGTTS

SEQ ID NO: 19474 - DNA, 673 bp, Zea mays
  misc_feature: Ceres CLONE 1386808-F
  misc_feature: Translation starting site: 473
tggagctccccgcggtggcggccgctctagaactagtggatcccccgggctgcaggaattcgcacgagaccattacctagaacatcctaattgaaaaatcacctataatattttgagcattcagaaacacaccaagcgaagcacattagcaacaacctaacaacaatggctaccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaacgcaacagcaacaaacaattcctaccagcactgagcccactagccatggtgaaccctgccgcctacttgcaacagcagttgcttgcatcaaacccacttgctctggcaaacgtaattgcaaccagccacaacacagctgcacagtttctggcagcgctcagcaactaagcctggggaaccctgtcgcctaactacaacaggacaactgctttcatctacccgctcccttggggccaaggaactaca

SEQ ID NO: 19475 - DNA, 587 bp, Zea mays
  misc_feature: Ceres CLONE 1386811-F
  misc_feature: Encodes the peptide sequence at SEQ ID NO. 19476
  misc_feature (379)..(379): n is a, c, t, g, unknown, or other
  misc_feature (429)..(429): n is a, c, t, g, unknown, or other
agagctggagctccccgcggtggcggccgctctagaactagtggatcccccgggctgcaggaattcgcacgagaccattacctagaccatcctaatcgaaatcgcaccaccgccgcgccgcccaatccctatgccgtcgccgaccgccgcacgccgccatgagtcgccgtcataccgccccctcgtctccgtgaaagccctagagggcgacatggtaacctacgcccccggaatcgccttaccgcccgtcttcggtgcgccgatacgccccgacgtgttctggttcacccacaagctgttgtcctgcaacaagcgcctgccctacggagtctcccggcgcgccgggcactagacgtcgagcgattcctggggtaccggncgagtcgtgtctcgtatcccacgcgtccccgggtggtgtacccaacggcnccggtcaaggtagcttcggtaaactgggcccaggaggagcattttccccccctcaaaattttggctagggggccggcgccttaaaataaaccttcgccgggttccaggaaccctaaattaactgccagggcgtcccggccctttttttttaaagggga

SEQ ID NO: 19476 - protein, 73 aa, Zea mays
  misc_feature: Ceres CLONE 1386811-F
MPSPTAARRHESPSYRPLVSVKALEGDMVTYAPGIALPPVFGAPIRPDVFWFTHKLLSCNKRLPYGVSRRAGH

SEQ ID NO: 19477 - DNA, 753 bp, Zea mays
  misc_feature: Ceres CLONE 1386812-F
  misc_feature: Pfam Name: KH_1 Pfam Description: KH domain
  misc_feature (374)..(374): n is a, c, t, g, unknown, or other
aaagctggagctccccgcggtggcggccgctctagaactagtggatcccccgggctgcaggaattcgcacgagaccattacctagaacatcctaatcgaaaaccctgatgatgactgcataattacagtttctgcgaaagagttctttgaagatcctgtatctccaacaattgatgctgcagttcgtttgcagcctagatgcagcgagaaaagtgatttagaatcagctgagcagtcatacacaacacgcttgctggtgtcaacatcacgtattgggtgcctaattggcaaaggtggttcaatcattactgagatacggagaacatccagagcaaatgtacgtattctttcaaaagaaaatgttccaaaggtancaccagaagatgatgagatggttcagatcactggagggccttgatgttgcaagaaaatgctcttgtgcaaatagttacaaggctggaaacccaatttctttgaaagaaaggcttctttatctggatttccaccctgttatccccttaccatccctttgcctggtggggtttcggtagaaccaaaattatttaggagagaaccccaagcctgttgggccccatccaaattcaaagggggttccgacaatccggaggaaacaatcccttttgaacgttttggaagttttagggggtcccccggcccccggaaagagaattggggttttaacggggggaaaagggttctcccccccaaaaaggggtttacccgccccatccc

SEQ ID NO: 19478 - DNA, 741 bp, Zea mays
  misc_feature: Ceres CLONE 1386813-F
  misc_feature: Encodes the peptide sequence at SEQ ID NO. 19479
  misc_feature (489)..(489): n is a, c, t, g, unknown, or other
  misc_feature (590)..(590): n is a, c, t, g, unknown, or other
  misc_feature (600)..(600): n is a, c, t, g, unknown, or other
  misc_feature (605)..(605): n is a, c, t, g, unknown, or other
  misc_feature (652)..(652): n is a, c, t, g, unknown, or other
  misc_feature (716)..(716): n is a, c, t, g, unknown, or other
  misc_feature (720)..(720): n is a, c, t, g, unknown, or other
ggagctccccgcggtggcggccgctctagaactagtggatcccccgggctgcaggaattcgcacgagacctttacctagaacatcctaatcgaaaaatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgcggccgggacggtgggcttcttctggctggtgaaccacggcgtgacagaggagctgatgggcgcatggctccgcgnggtgcgccagttcacagggccccccgtggagggcgaagcaggcgctctactccagggacctggctcgcaacctgcgcttcgcctccaacttcgacctcttncaggccgctngcggncgactggcgcgaacgttcttttctgcgaggtggctccgacccgcccnccgcggggaggagctgccggagccactgaggaacgtgatgctgaagtacggcgcggcggtgcgnaaanctggtggcggttcgtggtcgg

SEQ ID NO: 19479 - protein, 200 aa, Zea mays
  misc_feature: Ceres CLONE 1386813-F
  misc_feature: SWISSPROT Homolog: EC 1.14.11.20 Desacetoxyvindoline 4-hydroxylase
  misc_feature (117)..(117): Xaa is any aa, unknown, or other
  misc_feature (151)..(151): Xaa is any aa, unknown, or other
  misc_feature (154)..(154): Xaa is any aa, unknown, or other
  misc_feature (156)..(156): Xaa is any aa, unknown, or other
  misc_feature (193)..(193): Xaa is any aa, unknown, or other
  misc_feature (194)..(194): Xaa is any aa, unknown, or other
MAPTTATKDDSGYGDERRRELQAFDDTKLGVKGLVDSGVKSIPSIFHHPPEALSDIISPAPLPSSPPSGAAIPVVDLSVTRREDLVEQVRHAAGTVGFFWLVNHGVTEELMGAWLRXVRQFTGPPVEGEAGALLQGPGSQPALRLQLRPLXGRXRXTGANVLFCEVAPTRPPRGGAAGATEERDAEVRRGGAXXWWRFVV

SEQ ID NO: 19480 - DNA, 704 bp, Zea mays
  misc_feature: Ceres CLONE 1386815-F
  misc_feature (383)..(383): n is a, c, t, g, unknown, or other
tggagctccccgcggtggcggccgctctagaactagtggatcccccgggctgcaggaattcgcacgagaccattacctagaacatcctaatcgaaaaattggggcaggatcccgcgatggctcccagctcggtggagtgcaacccgtccgtggcgcccgcgaggccgaggtcgagctcggtgagcgccgcggctgctgccgggtgcgctgcgagcgccggcccgatgtcctccgtccagcagtagaactcggagaggtcgagcgccctgagcgctgggcagtccccgaggagcggctcgagatccgcgccggcgtcgaggcccggcgggcgctggtgccagcgcacgagcttgacgctgcggaggcgggacctccagtgcggngtgaggctgactagcgtggtgaggtcgcggcagtagacggcgagcgaggacacggcgaggaagcagtaggcgaggcgcgccgcgaccagcttcgttctgctccgcgacctgctgcggcgtcacggacggcgcgacggcgtcggccgacggcgccacggaggagaggaactgatgtccccacggcgacgccagcgagaggtcgagccgctccagcgcccgggagcagaacgccggactgaggaaaaggacgccggcgaccgtgggtccccgcgcagcgacagcgcggccagtgtggcccgcttccgcgcgaggtagcgacgc

SEQ ID NO: 19481 - DNA, 741 bp, Zea mays
  misc_feature: Ceres CLONE 1386817-F
  misc_feature: Encodes the peptide sequence at SEQ ID NO. 19482
  misc_feature (541)..(541): n is a, c, t, g, unknown, or other
  misc_feature (548)..(548): n is a, c, t, g, unknown, or other
  misc_feature (708)..(708): n is a, c, t, g, unknown, or other
  misc_feature (723)..(723): n is a, c, t, g, unknown, or other
  misc_feature (724)..(724): n is a, c, t, g, unknown, or other
aagctggagctccccgcggtggcggccgctctagaactagtggatcccccgggctgcaggaattcgcacgagaccattacctagaacatcctaatcgaaaactctttctaacacgactaatatatatatatatatatgtatatatatatatatatatatatatatatatatatatatatatatatctctatatctctgtgggtgactgagagagagagagagcgagagagtgcgtatgtgtgcttgtgggtgccaggggctgcgcgcgtcgggtgcagctagctctctcggagtcacgactgcagaggacaaagtggtgctgcgccaggtgccgctcccccccgggcgggagcgcgacttcaagagtgtggacatctcggtggcgcgaggcgatgatgatgaaggagcagaggacgctcgcctgcgcgctggcggtctgctcctgtgtggaggagcgcggggcgcagaggacactctaggacgctcaagagcgctcgcgcgagcgagctcaacgagtggcgcgcggtagtttgccagagcntatatgntggcgcctagactcgcgcgcggcgcgtcgcgcccgatcgggagcacgctgaggcagagtgcctctgtccgtcacaatagcgcctggggcggggggacgccccaacaagaaaccagaggcgagggggcggcgctccgtcccgacgtgtacctgattggcanagacgcgggaacggnngcccctggaggtctggt

SEQ ID NO: 19482 - protein, 68 aa, Zea mays
  misc_feature: Ceres CLONE 1386817-F
AGAPRGGGRSRTSGSPGLQEFARDHYLEHPNRKLFLTRLIYIYIYVYIYIYIYIYIYIYIYLYISVGD

SEQ ID NO: 19483 - DNA, 740 bp, Zea mays
  misc_feature: Ceres CLONE 1386819-F
  misc_feature: Encodes the peptide sequence at SEQ ID NO. 19484
tggagctccccgcggtggcggccgctctagaactagtggatcccccgggctgcaggaattcgcacgagaccattacctagaacatcctaatcgaaaaatggtcctccattgcaagctccactactccacacctagacttcccaatcctccattgggcaacctgtcacacagtacgccgtcgcctgtgatttggtttgtggagtgatagagaaagagagagagagacctagactcggactcgtagagaaggagatgatgtcgagggagcgcaagaaggcgtctgctcttcaggagaagctgaagatcctccgctccatcactcactcccacgctctgagcaacacgtcgataatcatggacgcgtccgcgtacatcaaggagctgaagcataaggtggtgcagctgaaccaggagattgcgtgcgcgcaggacgcgctgatacacatggtatcatcctatcccacgctgaccgtggaagccctaggagtgcagggtccgacgttcctggtgaacgtgttctccgacaagagctgcccggtgctgctcgtcgtcgtgctggtagacttcgacgagctggggctcagcgtgatccaggacaccgcgtcctgcgccgactcctttcgcctcgagggcgtcggccgtatagaacgtggcggaaaacgtgtaagaacacgtcttggagcaggccgtcctgcaggtcgtcaagagcttgtcccgaggacggtagcgactaccacgag

SEQ ID NO: 19484 - protein, 162 aa, Zea mays
  misc_feature: Ceres CLONE 1386819-F
MMSRERKKASALQEKLKILRSITHSHALSNTSIIMDASAYIKELKHKVVQLNQEIACAQDALIHMVSSYPTLTVEALGVQGPTFLVNVFSDKSCPVLLVVVLVDFDELGLSVIQDTASCADSFRLEGVGRIERGGKRVRTRLGAGRPAGRQELVPRTVATTT

SEQ ID NO: 19485 - DNA, 725 bp, Zea mays
  misc_feature: Ceres CLONE 1386820-F
  misc_feature: Encodes the peptide sequence at SEQ ID NO. 19486
  misc_feature (684)..(684): n is a, c, t, g, unknown, or other
  misc_feature (687)..(687): n is a, c, t, g, unknown, or other
aaagctggagctccccgcggtggcggccgctctagaactagtggatcccccgggctgcaggaattcgcacgagaccattacctagaacatcctaatcgaaaaatcgcttcaggtcggcgtcttcacaaacgccggcgaaaactctcgcccgagcccgacagatctctaattccccataccgtccaccgatcgaccttcacgccagcctcggcctcttccgaaggcgtcgcgcgcggttgttcgagaggagagcaggaagatgagggagtgcatctccgcccacatcgtgcaggacggcatccaagtcagcaacgcgtgctgcgaactttactgcctcgagcacgacatccagtctgatggccaagtgcctgtagataacaccgcgcgacatcacgatgatgccttcagcaccttcttcagccagactggtgctgacaagcacgttcgccgtgcaatctgcgatgatctagaacccactgtgatctatgacgtgcgcactggcacgtaccgccagctcttccaccctgagcagctcatcggcggcaatgaggatgacgataacaatttacgccgtgtgcactacgcaattgacaaggagattgatgatctagcgcttgaccgtatgcgctagcttgatgacgactgaaccggcctcccaggcttcctgctcttcgatgccgatgncgntgccactgggactgcccttggttctctcctcctggacg

SEQ ID NO: 19486 - protein, 123 aa, Zea mays
  misc_feature: Ceres CLONE 1386820-F
MRECISAHIVQDGIQVSNACCELYCLEHDIQSDGQVPVDNTARHHDDAFSTFFSQTGADKHVRRAICDDLEPTVIYDVRTGTYRQLFHPEQLIGGNEDDDNNLRRVHYAIDKEIDDLALDRMR

SEQ ID NO: 19487 - DNA, 735 bp, Zea mays
  misc_feature: Ceres CLONE 1386824-F
  misc_feature: Encodes the peptide sequence at SEQ ID NO. 19488
aagctggagctccccgcggtggcggccgctcgacaactacccggatccgccggggtggaggaattccaccctaccattacctatgagatgctactcgaacaatccggcgacgtcctcgctgcgggactcgtccccaaactggagcaatcgcccgcccaaggagacgatcctcctcgacggctgcgacttcgagcactggctcgtcatcatggagccgccgcctagtgacgcctccaaccccgatatcacacgcgacgagatcatcgatagctatatcaagactctcgcccaagtcgtcgggagtgaggaataagctaggcaaaagatatactctgtatcgactcgtcattactttggctttggtgctcttgcatctgaggaactttcttacaaactgaaataaattcccaaggtccgctgggttcttcctgattcatacttggatgtcaaaaacaaggactatggaggcgaacccttcataaatgggcaagctgttccttatgatcctaaatatcatgaagagtgggtgagaaacaatgcccgtgccaatgacagaaaccggcgcaatgataggcctcgcaactttgacaggtcaaggaactttgacaggagaagggagaacatgcacaactaccagaacagagatggggctcctgcccaaggtcttcattggccccccacctccacctggccagaaccagatgccatcccaacatagtcaggggcacatgtctc

SEQ ID NO: 19488 - protein, 76 aa, Zea mays
  misc_feature: Ceres CLONE 1386824-F
MRCYSNNPATSSLRDSSPNWSNRPPKETILLDGCDFEHWLVIMEPPPSDASNPDITRDEIIDSYIKTLAQVVGSEE

SEQ ID NO: 19489 - DNA, 743 bp, Zea mays
  misc_feature: Ceres CLONE 1386825-F
  misc_feature: Encodes the peptide sequence at SEQ ID NO. 19490
  misc_feature (315)..(315): n is a, c, t, g, unknown, or other
  misc_feature (322)..(322): n is a, c, t, g, unknown, or other
  misc_feature (371)..(371): n is a, c, t, g, unknown, or other
tggagctccccgcggtggcggccgctctagaactagtggatcccccgggctgcaggaattcgcacgagaccattacctagaacatcctaatcgaaaacgtgtttctaactccggtggctccaccaccagcaacccgtgcagcgagcccaccccgaccactgccatgtcgaggcgcggcgactgggtctacgagaacaacggcgggacctgcgtggccatcgccggcgccgattactgtgtcgtcgcgacggacacccgcctctctgtcggatacagcatcctcacgcgcgaccactctaagatctgcgacctggntgacaantgtgtactagcatcttctggcttttcagggtgatattaaggctctgcancagaacctagctgccataggattgctataccatccccaggataacaaaaggatggactgccctggcatggaacaggtccttctccaataacctgaactacaagggttccttcccaatatacccctcaagtggctccgggggctttaacacggaggggaaagggggtgttttccccttagagggagaggttcctaaaaaaaaattggtttaaggggtccgggaatgggtcctccttttaattttgcccgccggggaaaaaaaaaaaaaaccacaaggccttttgttcccccgcggggggggttgcaccaccctttggggggagaagggccccttttttttaaggggggggttttcttcctccacaaaaaaaaa

SEQ ID NO: 19490 - protein, 63 aa, Zea mays
  misc_feature: Ceres CLONE 1386825-F
  misc_feature: SWISSPROT Homolog: EC 3.4.25.1 Proteasome endopeptidase complex
  misc_feature (51)..(51): Xaa is any aa, unknown, or other
  misc_feature (53)..(53): Xaa is any aa, unknown, or other
MSRRGDWVYENNGGTCVAIAGADYCVVATDTRLSVGYSILTRDHSKICDLXDXCVLASSGFSG

SEQ ID NO: 19491 - DNA, 727 bp, Zea mays
  misc_feature: Ceres CLONE 1386826-F
  misc_feature: Encodes the peptide sequence at SEQ ID NO. 19492
tccccgcggtggcggccgctctagaactagtggatcccccgggctgcaggaattcgcacgagaccattacctagaacatcctaatcgaaaagttcccctctctcttccccgtcctgcaggctccaggcgctgctgctctcgtcctccgctagcgagcgaatcgctgacgctggcccgacgccgcggcgggaggtatctcgctttcgatcaggattttggttggggcgtcgttctccggtgcttatctcatttctatttatcggtgcctcgggctcacggccaaattcgctgctgcgtggggctttggagattggagccgattccttaaagtggcggtggcagcgtctggtgggaaccatgagcttcgtgttccgaggaagcagggccgacatcgaggtcggtggcttcacagggttcgcccccgagcgccgcaccatgcgaattcatgcagggagcaggtcggcgaatagcaattcccttggttattcttctaactgtttttgttttgttcatggtactgaactcacaccagatgtctcccaatcttttgctttggatagtcttgggagccttcctaatggtcacgagccttaaaatgtatgccccgtgcccacaacttgctcatgctgcagctgccaacagttttcttggccacactgagatgcgtgtgcatggaccggccaaccttggcccttgctaccagaggccaagttacagaagcttaaac

SEQ ID NO: 19492 - protein, 94 aa, Zea mays
  misc_feature: Ceres CLONE 1386826-F
MQGAGRRIAIPLVILLTVFVLFMVLNSHQMSPNLLLWIVLGAFLMVTSLKMYAPCPQLAHAAAANSFLGHTEMRVHGPANLGPCYQRPSYRSLN

SEQ ID NO: 19493 - DNA, 702 bp, Zea mays
  misc_feature: Ceres CLONE 1386827-F
  misc_feature: Encodes the peptide sequence at SEQ ID NO. 19494
  misc_feature (597)..(597): n is a, c, t, g, unknown, or other
  misc_feature (702)..(702): n is a, c, t, g, unknown, or other
tggagctccccgcggtggcggccgctctagaactagtggatcccccgggctgcaggaattcgcacgagaccattacctagaacatcctaatcgaaaaaaacctaaacctctcacccggcgccgccgccgccgccgccaccgccgccgccccgaggccccatcccagcgaaaccgacttccgcctcggattgaagcaatgtcgtcggacgacgaggtcagggaggagaaggagctcgacctctcctccaacgatgtcgtcaccaagtacaagactgccgccgaaatcctgaacaacgctctgaagctggttgtgtctgagtgcaagccaaaagcaaagattgttgacctttgtgagaaggttgactctttcataagagagcaaactgggaatgtctactagaatgcaaagaggaagattgaaaggggcattgctttcccaacctgtgtttcggtgaacaaacagtctgccacttctccccgcttacacagatgatgcagttctgaaaaaaatgacatggttacaattgacatggggtgtcatattgatggctttattgctggggggcacaatacactggaaatgcaaagggcctgccnaggaaaaacagctgatttcttgctgctgccaacccgcatcaaaagttgcatgaggttggcaaactgggaaaaaaataggatgtacttgacaatcagaaggtgtgn

SEQ ID NO: 19494 - protein, 67 aa, Zea mays
  misc_feature: Ceres CLONE 1386827-F
MSSDDEVREEKELDLSSNDVVTKYKTAAEILNNALKLVVSECKPKAKIVDLCEKVDSFIREQTGNVY

SEQ ID NO: 19495 - DNA, 596 bp, Zea mays
  misc_feature: Ceres CLONE 1386829-F
  misc_feature (567)..(567): n is a, c, t, g, unknown, or other
tggagctccccgcggtggcggccgctctagaactagtggatcccccgggctgcaggaattcgcacgagaccattacctagaacatcctaatcgaaaaaggacctgcttgtttgattgtttcatcgatcgccaatgcaagtttgtccattcgcattgcgctgaatactgtaactactagcgggagtgccactgtgccgcagctgcctgcttccccattactgcaagcctgtgttcaatcaaacgcttaaattaaaggttccccttctaaattctgttccagttaatagctagccccaactacaaaggggggggcaaaattccggaaaaaataaccagggggcctaattaatttaatttcgggagaaaaaaaaagccccccaaatttggagaaaaatggggggcccccctcctggggccaacccccaaaaaaaaaaccctggtttccccttcccgggggtgaaaaatacacccttctttccggggggaccacccttcccccccgggggggccccaaaaggggcgaaaatttcctttcttctctgtgggggccccccaccccctcccccnccggagggggggaggcgacgcgccccccc

SEQ ID NO: 19496 - DNA, 736 bp, Zea mays
  misc_feature: Ceres CLONE 1386836-F
  misc_feature: Encodes the peptide sequence at SEQ ID NO. 19497
  misc_feature (574)..(574): n is a, c, t, g, unknown, or other
  misc_feature (578)..(578): n is a, c, t, g, unknown, or other
  misc_feature (610)..(610): n is a, c, t, g, unknown, or other
  misc_feature (636)..(636): n is a, c, t, g, unknown, or other
  misc_feature (705)..(705): n is a, c, t, g, unknown, or other
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtgaccacgccggtgttcctgatcttcagccccgtgctcgtccccgccgcgctgctcatcgggacggccgtcatggggttcctcacgtcgggcgcgctggggctccggggcctgtcctcgctcacgtgcctcgccaacacggngcgncaggcgtccagcgcaccccggactacgtggtnagagcgcaccgcaggatggcggaggnccgcgcgcacgcgtgccacaagaccgcgcaggcaggccagtcccatccaggcagggcgcaagaggccgncccccggggtaggtgcagggtgcggccgctg

SEQ ID NO: 19497 - protein, 178 aa, Zea mays
  misc_feature: Ceres CLONE 1386836-F
  misc_feature (44)..(154): Pfam Name: Oleosin Pfam Description: Oleosin
  misc_feature (125)..(125): Xaa is any aa, unknown, or other
  misc_feature (137)..(137): Xaa is any aa, unknown, or other
  misc_feature (146)..(146): Xaa is any aa, unknown, or other
  misc_feature (169)..(169): Xaa is any aa, unknown, or other
MADRDRSGIYGGAHATYGQQQQQGGGGRPMGEQVKGMLHDKGPTASQALTVVTLFPLGGLLLVLSGLALTASVVGLAVTTPVFLIFSPVLVPAALLIGTAVMGFLTSGALGLRGLSSLTCLANTXRQASSAPRTTWXERTAGWRRXARTRATRPRRQASPIQAGRKRPXPGVGAGCGR

SEQ ID NO: 19498 - DNA, 694 bp, Zea mays
  misc_feature: Ceres CLONE 1386839-F
  misc_feature: Encodes the peptide sequence at SEQ ID NO. 19499
tggagctccccgcggtggcggccgctctagaactagtggatcccccgggctgcaggaattcgcacgagaccattacctagaacatcctaatcgaaaaaattccattctcggaagagaccatttccttcctcctgatctctcacggagttcctctccatggcgacgccccgctctccgagcccccgcgccgaagcgcccctcgattccgcgccgctgctgggcggtgcctccgtcgacggtagccgtcgccgaggcggagcgctccgccgaccctcgctccgcggtgacgggcagatgctgcgccgcgacgggcggcgagccatgcggaagccctcggtgttgacgtgcgaggcagccgcacaccacctgtaggaacgcaaggtggactgtggctactccccgcccgtcgtggagctcgacctgctctgaaacctcgccttcatcacgcgtcgctgcggaagtgctcgtggtcagccgccaagaggagtcgcccatgccgctccggacctgggtcgccgggtacgccctggagtgagatatacacttggggggcggcccaatcctagtacggaatgccccatggccaggtcggtgggcacccgggacaagtgccggtttaccaagaaaagggccaggtacgggtccgtcaccctcatatttgataaagaagacaagtgagctccaatccccttgg

SEQ ID NO: 19499 - protein, 71 aa, Zea mays
  misc_feature: Ceres CLONE 1386839-F
MATPRSPSPRAEAPLDSAPLLGGASVDGSRRRGGALRRPSLRGDGQMLRRDGRRAMRKPSVLTCEAAAHHL

SEQ ID NO: 19500 - DNA, 669 bp, Zea mays
  misc_feature: Ceres CLONE 1386845-F
  misc_feature: Translation starting site: 216
gctggagctccccgcggtggcggccgctctagaactagtggatcccccgggctgcaggaattcgcacgagaccattacctagaacatcctaatcgaaaactaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagacattgggggaggtgatgatgctttcaacaccttcttcagtgagactggggctggaaacacgtggccccggcttgtttttgttgcccttgaccccctggcttcgaggaggggggaaatgggaccctacgggccagttttccacccgggaggagttctccgggggaaaggaggatggccccgaaaaattttgcccggggggccctcacccccttttttaaaaagaaaagtttgtgcccgcgggcccttgttatccgacaaaaaaaaaatttttggcccaaaaaaaggggggggggccccagagaggggtctccccttttttccacccgggggggg

SEQ ID NO: 19501 - DNA, 635 bp, Zea mays
  misc_feature: Ceres CLONE 1386852-F
  misc_feature: Encodes the peptide sequence at SEQ ID NO. 19502
  misc_feature (281)..(281): n is a, c, t, g, unknown, or other
  misc_feature (534)..(534): n is a, c, t, g, unknown, or other
  misc_feature (565)..(565): n is a, c, t, g, unknown, or other
tccccgcggtggcggccgctctagaactagtggatcccccgggctgcaggaattcgcacgagaccattacctagaacatcctaatcgaaaaattttttttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggnggcagtttcgtcgccgtcgcctccatgacgtccgccgccgtctccaccagggtggagaacaagaagccatttgctcctccgagggaggtacatgtccaggttacacattcaatgccatctcacaagattgaaattttccagtcacttgatgattgggctagagataatatcttggacacatctcagccagtccagaagtggtggcagccacaagatttcctccctggaccagcatctggaggatttcatgatngaagtaaggagctcagaagacgtggcaaggnagaccctgatgattattttgtttggttgggtggagacatgattactggagaagctctaccacataccagc

SEQ ID NO: 19502 - protein, 141 aa, Zea mays
  misc_feature: Ceres CLONE 1386852-F
  misc_feature: SWISSPROT Homolog: EC 1.14.19.2 Acyl-[acyl-carrier-protein] desaturase
  misc_feature (108)..(108): Xaa is any aa, unknown, or other
  misc_feature (118)..(118): Xaa is any aa, unknown, or other
MALRLHDVALCLSPPLAARRRSGGSFVAVASMTSAAVSTRVENKKPFAPPREVHVQVTHSMPSHKIEIFQSLDDWARDNILDTSQPVQKWWQPQDFLPGPASGGFHDXSKELRRRGKXDPDDYFVWLGGDMITGEALPHTS

SEQ ID NO: 19503 - DNA, 575 bp, Zea mays
  misc_feature: Ceres CLONE 1386866-F
  misc_feature: Encodes the peptide sequence at SEQ ID NO. 19504
  misc_feature (545)..(545): n is a, c, t, g, unknown, or other
ggagctccccgcggtggcggccgctctagaactagtggatcccccgggctgcaggaattcgcacgagaccattacctagaacatcctaatcgaaaatcctttctccgggcacaccatactgttcttgctacttctagatagaggaacaagagagagaaggccaccgacatcgcctcttaacccgacaagccccattgcccaggagaaccccgtgccggggagcgagccgcgcgcattccccgtcccgtgccaccggaccaggggaaggaggacacacatgtcgtcgtctctctctccagcggcggcagccgcgcccctggatctggacggcaactccgtcgcgcccctcaccatctgcatgattggtgccggcggcttcatcggctcccacctctgcaagaagctcatggccgagacgcgccatgtcgtcctcgccgtcgacgtatactgcgataagatccgccacctcgtcgaccccgcgccgccgcaccctcggggggcgcatcctcttccaaccggctcaacatcaaaaattgactcccggnttcgaggggccccctcccaaaaagggccca

SEQ ID NO: 19504 - protein, 99 aa, Zea mays
  misc_feature: Ceres CLONE 1386866-F
  misc_feature (90)..(90): Xaa is any aa, unknown, or other
MSSSLSPAAAAAPLDLDGNSVAPLTICMIGAGGFIGSHLCKKLMAETRHVVLAVDVYCDKIRHLVDPAPPHPRGAHPLPTGSTSKIDSRXRGAPSQKGP

SEQ ID NO: 19505 - DNA, 624 bp, Zea mays
  misc_feature: Ceres CLONE 1386886-F
  misc_feature (509)..(509): n is a, c, t, g, unknown, or other
  misc_feature (513)..(513): n is a, c, t, g, unknown, or other
cgcggtggcggccgctctagaactagtggatcccccgggctgcaggaattcgcacgagaccattacctagaacatcctaatcgaaaaagcctgcgctccccttctttcccgttcggctcacagcgaagaaggaagccggttagggtttccacctcctttcccctcctctccttcagcgacgaccgcgggccacaccctcgatatccttcccctcggacccggaggcgagcagcagcctccagcgcctgccacgcctgcccgtctcgtattgggaggattcgcctgtctgaatggagtccgcacagctcttatgactcgacagctccagatacagcagcttcaggaggcatttgctgagcttgagaccagagcacggtttcatgaacctcagtggagcagcttggagacactttcgtggtcttggacagccctcaagaaaagtttgcgagctaaagagcaggagaaggagtccagagactgccgcaaatcagagaaatctggagcacggnaggncactgttggggaaagactgactctttggaaaatttcaggaaaaaaggaactgctaactaggtctttaaaaggcagggttccttacggggccaacatacccaggaaaggggg

SEQ ID NO: 19506 - DNA, 663 bp, Zea mays
  misc_feature: Ceres CLONE 1386887-F
  misc_feature: Encodes the peptide sequence at SEQ ID NO. 19507
cgcggtggcggccgctctagaactagtggatcccccgggctgcaggaattcgcacgagaccattacctagaacatcctaatcgaaaacgggatcgctctctctttgggctaccggctccgccgccgctccgccgccctaagccaggtgctgaaggccttcgtcggtcttttcaccggcgacgacgacccactaggaaaagaattttcctggcatatttttgtttccagaaatattcgtgtcaagttggtatgtcagggatcacagcaatttggcgtcggtcatgtccattagctgctagtcagattctaatggagacatattttggcccatctgtatcttctggtgttctgaggtggctcagcagcggcactaagcactcaagaaaacctgaattttctgttgctaaccatatcaggggtggggggatttgcattctgcttctgcaggtaattatgtgtcaacgaacagaagggtgcccctttcctgccgtatggacgctaagtgggtggattacttcaaagtccagacctggtgcattggcaggcaatccctagggggtcccacgcttccatggcgggatacctcctcggaaactgggaatcccgcgaggagcctcgtgaaaggaggggggtgtcaaaacgttccttgctagggaaggtggc

SEQ ID NO: 19507 - protein, 101 aa, Zea mays
  misc_feature: Ceres CLONE 1386887-F
MSGITAIWRRSCPLAASQILMETYFGPSVSSGVLRWLSSGTKHSRKPEFSVANHIRGGGICILLLQVIMCQRTEGCPFPAVWTLSGWITSKSRPGALAGNP

SEQ ID NO: 19508 - DNA, 684 bp, Zea mays
  misc_feature: Ceres CLONE 1386891-F
  misc_feature: Encodes the peptide sequence at SEQ ID NO. 19509
ggagctccccgcggtggcggccgctctagaactagtggatcccccgggctgcaggaattcgcacgagaccattacctagaacatcctaatcgaaaaatggcatctgcattgcagttgcagccacgccaacaactgggcagcggcgacatctgcatctcccacctcgtctccctcccgtatctgcaagccttgatcccgccgccagccatccatccaagggagccatgtctccatccggcgagctgctggcttccatctcctccgtcttcactgtcgccttcgtcctcctcgcctgcgtcgagctcggcgacgccgccgccgcccgccgtcggcgtctaccgcctcatccagacggaacctcgccggcgctccgctcggccccccgcggccgcggtcctcaaccaccacgctgccgcgctcccgctccccggccggcgcagacctctcccgctccgccctcgtcgcgccggctccttgacctcccgctctctttcctcagagaggaactcggtggagaaaaaacatcggggggaataaccccataccggctccccaaaaacaatgaaccgctgcgcaacgaaacggcgcaaactcccgcggtgtactcgcctcgcaccggcgccgcctccgcgcctggcccggagcaaaagacagagacgccgagggacatttcgaggcccccgc

SEQ ID NO: 19509 - protein, 153 aa, Zea mays
  misc_feature: Ceres CLONE 1386891-F
MSPSGELLASISSVFTVAFVLLACVELGDAAAARRRRLPPHPDGTSPALRSAPRGRGPQPPRCRAPAPRPAQTSPAPPSSRRLLDLPLSFLREELGGEKTSGGITPYRLPKNNEPLRNETAQTPAVYSPRTGAASAPGPEQKTETPRDISRPP

SEQ ID NO: 19510 - DNA, 628 bp, Zea mays
  misc_feature: Ceres CLONE 1386897-F
  misc_feature: Encodes the peptide sequence at SEQ ID NO. 19511
  misc_feature (544)..(544): n is a, c, t, g, unknown, or other
  misc_feature (545)..(545): n is a, c, t, g, unknown, or other
aaagctggagctccccgcggtggcggccgctctagaactagtggatcccccgggctgcgggaattcgcacgagaccattacctagaacatcctaatcgaaaagttgtgtagccgccactagtacgaagccctcagtcctccctcacacaccgaaccgagcgcaccatgtcgtcggcggctggaggagtggaggagacggtgcgggcgtcgcacatcctcatcaagcacgagggttcccgccgcaaggcctcctggaaggaccctgacggccgcatcatctccgccaccacgcgcggcgacgccgcagcgcgcctcctggacctccgcaaccagattctctccggccaggccaacttcgccgacctcgccgctcggcactccgactgctcgtccgcgcgacgcggtggggacttaggtaccttttggaggaggcagatgcagaaacccttcgaggacgccacatatgccctcaaggttggtgagctcagcgacatcgtggacactgacagtgggggttcacatcatccctgcggactgcctgganngagggatcacactgtcctctcagggctttcagttagtggtttatgggcgttctggttagaccctggtatttgtattcctgctg

SEQ ID NO: 19511 - protein, 154 aa, Zea mays
  misc_feature: Ceres CLONE 1386897-F
  misc_feature (16)..(117): Pfam Name: Rotamase Pfam Description: PPIC-type PPIASE domain
  misc_feature: SWISSPROT Homolog: EC 5.2.1.8 Peptidylprolyl isomerase
  misc_feature (127)..(127): Xaa is any aa, unknown, or other
MSSAAGGVEETVRASHILIKHEGSRRKASWKDPDGRIISATTRGDAAARLLDLRNQILSGQANFADLAARHSDCSSARRGGDLGTFWRRQMQKPFEDATYALKVGELSDIVDTDSGGSHHPCGLPGXRDHTVLSGLSVSGLWAFWLDPGICIPA

SEQ ID NO: 19512 - DNA, 666 bp, Zea mays
  misc_feature: Ceres CLONE 1386903-F
  misc_feature: Encodes the peptide sequence at SEQ ID NO. 19513
  misc_feature (289)..(289): n is a, c, t, g, unknown, or other
  misc_feature (291)..(291): n is a, c, t, g, unknown, or other
  misc_feature (292)..(292): n is a, c, t, g, unknown, or other
  misc_feature (317)..(317): n is a, c, t, g, unknown, or other
  misc_feature (322)..(322): n is a, c, t, g, unknown, or other
  misc_feature (333)..(333): n is a, c, t, g, unknown, or other
  misc_feature (343)..(343): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (389)..(389): n is a, c, t, g, unknown, or other
  misc_feature (423)..(423): n is a, c, t, g, unknown, or other
tccccgcggtggcggccgctctagaactagtggatcccccgggctgcaggaattcgcacgagaccattacctagaacatcctaatcgaaaaaattgggaatttctcctcgccgcctcgtctctgccgggctcgctcgtacgtcgctccccacccgcaatggcggacactttcgccctcctccttctcctgatcctgtcctcgtcggtccgcgccgcccccgacgccgtggtgtcgagaatcgccttcggatcctgcgccaaccagagcgagccccagcccatttggacngnncgtcgcggggttcgaacccgcaggntgttncgtctggctcnggggacaacngtctacggcgacaacaagcnnncccattccgggtcttcgggagggnagcgcaccgtggggccctgggaagaacgtgccgncgcttctacccttccaccgaggaggagctggcggaggcggtaccagctcgccagggcgcagcccgggtacgccaggctcagggagagggctcaggatcttggaacatggcatgaccatgatcatggattgaatgatgcaggagaagaacttagggggaaagtgattgctcgaagggcttaaggtagagtccccgggtgaaccgggagacggcaacgcgcgaaaccaatgggggatgatggatc

SEQ ID NO: 19513 - protein, 148 aa, Zea mays
  misc_feature: Ceres CLONE 1386903-F
  misc_feature (45)..(45): Xaa is any aa, unknown, or other
  misc_feature (54)..(54): Xaa is any aa, unknown, or other
  misc_feature (55)..(55): Xaa is any aa, unknown, or other
  misc_feature (59)..(59): Xaa is any aa, unknown, or other
  misc_feature (69)..(69): Xaa is any aa, unknown, or other
  misc_feature (70)..(70): Xaa is any aa, unknown, or other
  misc_feature (78)..(78): Xaa is any aa, unknown, or other
  misc_feature (89)..(89): Xaa is any aa, unknown, or other
MADTFALLLLLILSSSVRAAPDAVVSRIAFGSCANQSEPQPIWTXRRGVRTRRXXRLAXGTTVYGDNKXXHSGSSGGXRTVGPWEERAXASTLPPRRSWRRRYQLARAQPGYARLRERAQDLGTWHDHDHGLNDAGEELRGKVIARRA

SEQ ID NO: 19514 - DNA, 670 bp, Zea mays
  misc_feature: Ceres CLONE 1386905-F
  misc_feature: Encodes the peptide sequence at SEQ ID NO. 19515
  misc_feature (296)..(296): n is a, c, t, g, unknown, or other
tggagctccccgcggtggcggccgctctagaactagtggatcccccgggctgcaggaattcgcacgagaccattacctagaacatcctaatcgaaaattccacctctcaatctcaccccacgcctgccccgagctccaaccctaaaggaacacacccctgcttgcggcggcggggagcggtcttgggcgtccgccttttgctgtggcccagccgtgacagatccgggccccgcgccgttaggtcggtgtttcttcggcgacggtgtagccgctggatgttagtctggcggatcggngcccgttgttcgcgtgattcgagctaggcggtgttgagttgtaacatttgtgtcacatgaatgaactcaggagcatctcagtgttaaaactgtgagcatatcaattcccctcctttaagcagtatgggagctaattgctgcattgctgcaaaggagaggacacaaccatgcattactccattagaagtatcagcgtacaggattgtcagacattccccatcatgggacctttccgcgcgcacctcgcacacatatcacagacccaatggaaatccctactctgttccccaccgatacgaaagcaaggagtcgaactgaaagaaagaaagaagccgatgccccaaactgcagggctttcagaggcagactcccgg

SEQ ID NO: 19515 - protein, 64 aa, Zea mays
  misc_feature: Ceres CLONE 1386905-F
MGANCCIAAKERTQPCITPLEVSAYRIVRHSPSWDLSARTSHTYHRPNGNPYSVPHRYESKESN

SEQ ID NO: 19516 - DNA, 626 bp, Zea mays
  misc_feature: Ceres CLONE 1386908-F
  misc_feature: Encodes the peptide sequence at SEQ ID NO. 19517
  misc_feature (328)..(328): n is a, c, t, g, unknown, or other
  misc_feature (354)..(354): n is a, c, t, g, unknown, or other
  misc_feature (487)..(487): n is a, c, t, g, unknown, or other
ggagctccccgcggtggcggccgctctagaactagtggatcccccgggctgcaggaattcgcacgagaccattacctagaacatcctaatcgaaaaataatctttttctccccaagaaaaaaaaggcggcgagagcataagaagaaaaaaaacacacacacacacacacaaagcgcacttttcaaatcgacaaaggggaaaggttcgcttcttgtggcatcttgctttccttcgagtgccatggccgatccggcggaggagaacgttgtctcgccgccaccgacccctgcgggcccagccgtgggcgcctcagacccgcccctgcagnctgctgctgacagcgcctcaacgganaaggtgtctgctccggcgccggaagtaagggtcccggggatcaggcttcttggagaggacacttccgtgcacaatccctttggggcggtaaaactgctggacgtctggtatggaaagacagaaacttctgctngtgtataggcggcgcactgtcatcttggttccggtccgaagtgcttgattaccacctccctgacctgatatccatgcacttggattggtgtgcttgccaccttaattcctgtggtccaaagcaaccacctttcatcaag

SEQ ID NO: 19517 - protein, 84 aa, Zea mays
  misc_feature: Ceres CLONE 1386908-F
  misc_feature (30)..(30): Xaa is any aa, unknown, or other
  misc_feature (38)..(38): Xaa is any aa, unknown, or other
  misc_feature (83)..(83): Xaa is any aa, unknown, or other
MADPAEENVVSPPPTPAGPAVGASDPPLQXAADSASTXKVSAPAPEVRVPGIRLLGEDTSVHNPFGAVKLLDVWYGKTETSAXV

SEQ ID NO: 19518 - DNA, 641 bp, Zea mays
  misc_feature: Ceres CLONE 1386909-F
  misc_feature (364)..(364): n is a, c, t, g, unknown, or other
gctctagaactagtggatcccccgggctgcaggaattcgcacgagaccattacctagaacatcctaatcgaaaagaaaacttcctccacatcgatcccctcccccctccactcgtctccaaaatcgccagcgagagccatgccgcctcctcccctgccctcgccgagcctgaccgactgaccccacctcgccactgttctttcccttccacctgggccccacagcgcccccttaccgtcgccaccaaatccccaaatcccggaggcacgaggagggaattcgtcgcctgaccgatcggccgatccactgccgtcggcaccccaatccgccgctgccgccatgttcaacaagatcatcaagaggngaaaccgcaaggggcgcgcgcggggacaacgcggaggccgccgcgcgccccgcagcgccctcctcgcctccgggagaggtggcgggcggccccggattcaatccccccccggcacccgtcaaaccacgctccccgggccacagaggccttcccccggaccccgcccactttcgccggaaggtggcggcccgtcttgggcttgggaccaacccacgaggacgggggtgagtaacataaaatataactataaatcgatatacggatcaggaagacaagc

SEQ ID NO: 19519 - DNA, 542 bp, Zea mays
  misc_feature: Ceres CLONE 1386911-F
  misc_feature: SWISSPROT Homolog: EC 3.1.1.61 Protein-glutamate methylesterase
  misc_feature (208)..(208): n is a, c, t, g, unknown, or other
  misc_feature (321)..(321): n is a, c, t, g, unknown, or other
  misc_feature (322)..(322): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
cacccgcggtggcggccgctctagaactagtggatcccccgggctgcaggaattcgcacgagaccattacctagaacatcctaatcgaaaaaaatcccctgagcaaggcccccgtcggctagcgccgcagccgtcgccgtcgacgccgactctcaccggcagccgcttgcagcgcgtcccttccccgctcccggcgccatggactgcngcaaaagggaaagggtcgatgggcgggacctcctacgaacaaaattttgaatggttggaaaaaactttttccgggggagaggcgccccgcaaaaaaccccccccccccctttnncccctcttatgggggggaaattggggggaaacttttttcgagcccccccagggggaaaaaaaccccccccccccccgggggggttctttccccggggggggggggggggggccccccaaaaaaaaaatttttttacaccggggggggcggggggggggggggggggnnnncccaaaaaccaccctccttttttttttttttttagtggggggaggagggg

SEQ ID NO: 19520 - DNA, 646 bp, Zea mays
  misc_feature: Ceres CLONE 1386913-F
  misc_feature (646)..(646): n is a, c, t, g, unknown, or other
ggagctccccgcggtggcggccgctctagaactagtggatcccccgggctgcaggaattcgcacgagaccattacctagaacatcctaatcgaaaaatcaggaccgtctccaactcgccagtactcagccgccgcaatcagggacagggagctcgagcgcgcgccccacctgcgccgacgcgatgcgggccaaggttcctcttccctcgcctccgctgcgttcttctttccatgatgatgcgatgaaaccgtgtcctaggtagctttgcggagctagtcattttctaggttttcgccgtgggctgtgggtggccagaggcgacatcccagcgaggtgggtgggcgttgggcgccgcatccgcccttgggccgtcttgctgggccgccgctgcccctgccgcaggggggaaggaagacacgggaggaggcccaggaacaaaggccccggactgcagggcccctgggttaagcccaaaaagaaaacaagatactcaaaacaaattctcggccgcattaaactttgggagggttctcggagtcttcctcctggaatccgaagggattccgccgggcgttcgtttggttggtccccgggaggggcccttctacgaagtcccggggcctctgtcttgtctcacaaacaccn

SEQ ID NO: 19521 - DNA, 1117 bp, Zea mays
  misc_feature: Ceres CLONE 1386915
  misc_feature: Encodes the peptide sequence at SEQ ID NO. 19522
atttcacaatgcttacaaaacccatccatcattttagctgttgatacaaagagaagggaatggccgagataaccctagagccgagtgatcttatggcgcaaacaaacaaaagaatagtgccaaagttcactgaaatcttccccgtggaggacgcgaactacccttacagcgccttcatcgcgtcggtccggaaagacgtgatcaaacactgcaccgaccataaagggatcttccagcccgtgctgccaccggagaagaaggtcccggagctatggttctacacagagctcaaaactaggaccagctccatcacgctcgccatacgcatggacaacctgtacctcgtgggcttcaggaccccgggcggggtgtggtgggagttcggcaaggacggcgacacccacctcctcggcgacaaccccaggtggctcggcttcggcggcaggtaccaggacctcatcggcaacaagggtctggagaccgtcaccatgggccgcgccgaaatgaccagggccgtcaacgacctggcgaagaagaagaagatggcgacactggaggaggaggaggtgcagatgcagatgcagatgccggaggccgctgatctggcggcggcggcagcggctgacccacaggccgacacgaagagcaagctggtgaagctggtggtcatggtgtgcgaggggctgcggttcaacaccgtgtcccgcacggtggacgcggggttcaacagccagcacggggtgaccttgaccgtgacgcaggggaagcaggtgcagaagtgggacaggatctccaaggcggccttcgagtgggctgaccaccccaccgctgtgatccccgacatgcagaagcttggcatcaaggataagaacgaagcagcgaggatcgttgcgctcgttaagaatcaaactactgccgctgccgctactgctgccagtgctgacaacgacgacgacgaggcctgatcaatgcaacgacacatcatgatctgctgctgcacttaattactatgttcgtatacaaataaatacacccggcgtacgcggtgttccttatatggtctaaaatgtagccagtaaattttaaactactttatttcaaaaaaaaaaaaaaaaaa

SEQ ID NO: 19522 - protein, 301 aa, Zea mays
  misc_feature: Ceres CLONE 1386915
  misc_feature (18)..(288): Pfam Name: RIP Pfam Description: Ribosome inactivating protein
  misc_feature: SWISSPROT Homolog: EC 3.2.2.22 rRNA N-glycosylase
MAEITLEPSDLMAQTNKRIVPKFTEIFPVEDANYPYSAFIASVRKDVIKHCTDHKGIFQPVLPPEKKVPELWFYTELKTRTSSITLAIRMDNLYLVGFRTPGGVWWEFGKDGDTHLLGDNPRWLGFGGRYQDLIGNKGLETVTMGRAEMTRAVNDLAKKKKMATLEEEEVQMQMQMPEAADLAAAAAADPQADTKSKLVKLVVMVCEGLRFNTVSRTVDAGFNSQHGVTLTVTQGKQVQKWDRISKAAFEWADHPTAVIPDMQKLGIKDKNEAARIVALVKNQTTAAAATAASADNDDDEA

SEQ ID NO: 19523 - DNA, 654 bp, Zea mays
  misc_feature: Ceres CLONE 1386921-F
  misc_feature: Translation starting site: 207
  misc_feature (348)..(348): n is a, c, t, g, unknown, or other
  misc_feature (392)..(392): n is a, c, t, g, unknown, or other
  misc_feature (437)..(437): n is a, c, t, g, unknown, or other
  misc_feature (499)..(499): n is a, c, t, g, unknown, or other
tggagctccccgcggtggcggccgctctagaactagtggatcccccgggctgcaggaattcgcacgagaccattacctagaacatcctaatcgaaaaaaaaccgcggggcagctagtctcgccaccgcaggccgcaccggtcatcacaccggagcgcacgcggggagcccccgtagagttccggggcgaccaggccaactaacgccatgaaggaggaaggcggcggcggggacgcggggttcgtgcgggcggaccagatcgacctcaagagcctggacgagcagctggagcgccatctcacccgcgcctggaccatggagaagcgcaaggaggaggctcccgcgggcnttggggcgccggcgccaggaagcaccagcagtccggcggcccgncgaagggagggactgggaagatcgaccccgccaagcttgtcggtncaagggcgtcatcgcccgcggcaccctttggcaccgtccaccgcggcatctacacgctccgnaacgtcgcagtgaaactacttgattgggggagaaggatgggccatagatccaaaacaagacattgcagcactaagagcagcttttttccaagaaggtctctgtttgggcataaagctgaccatcccaatggtacccaagtttattggagctataa

SEQ ID NO: 19524 - DNA, 644 bp, Zea mays
  misc_feature: Ceres CLONE 1386932-F
  misc_feature: Encodes the peptide sequence at SEQ ID NO. 19525
  misc_feature (427)..(427): n is a, c, t, g, unknown, or other
  misc_feature (429)..(429): n is a, c, t, g, unknown, or other
  misc_feature (470)..(470): n is a, c, t, g, unknown, or other
  misc_feature (471)..(471): n is a, c, t, g, unknown, or other
tggagctccccgcggtggcggccgctctagaactagtggatcccccgggctgcaggaattcgcacgagaccattacctagaacatcctaatcgaaaaatctacctcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcgccgggntnggggggggcgggccgccatcgcgctggcgctcatgggcggnncgggttcgtcacctccggcggcctcggcggcgctgcggctgtccgtgtccctcctgggatgtacaagttacctggacgggcaagcacccgccgggcgccgaccagctggaccacgccaagggcgagggctggcgtccaaggcccgcgacatcaaggatgcagcacagcaccgc

SEQ ID NO: 19525 - protein, 152 aa, Zea mays
  misc_feature: Ceres CLONE 1386932-F
  misc_feature (36)..(148): Pfam Name: Oleosin Pfam Description: Oleosin
  misc_feature (81)..(81): Xaa is any aa, unknown, or other
  misc_feature (95)..(95): Xaa is any aa, unknown, or other
MADHHRGATGGGGGYGDLQRGGGMHGEAQQQQKQGAMMTALKAATAATFGGSMLVLSGLILAGTVIALTVATPVLVIFAGXGGGGPPSRWRSWAXRVRHLRRPRRRCGCPCPSWDVQVTWTGKHPPGADQLDHAKGEGWRPRPATSRMQHST

SEQ ID NO: 19526 - DNA, 681 bp, Zea mays
  misc_feature: Ceres CLONE 1386936-F
  misc_feature: Encodes the peptide sequence at SEQ ID NO. 19527
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
tggagctccccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttgggcctcgtgtgcatcctcatcttgctagccatcgcctcctacgtccagtacactcgctggaaaaaggggggaaagggccgcttcgggggcccatggggaaggtctgctcccttggaagctggcctcctggctcccctggggctggcccttaaccttggcggagacccctcccagcttttactccccagggacccccaggcttccttctttcgcttccaaaccagaaaaaaggaaacgggggaggatctttcaagacgcacctctttctggggtgggcccgggcggtggatgctggcgaagcccgaaaatcnnnccccgggtttccagttgggggcaaccaatacccccctgtggtaaagcgaaatacaccccgggggaaaaaggagaggaagtactggggcgcggggggtttcta

SEQ ID NO: 19527 - protein, 123 aa, Zea mays
  misc_feature: Ceres CLONE 1386936-F
  misc_feature (109)..(109): Xaa is any aa, unknown, or other
  misc_feature (110)..(110): Xaa is any aa, unknown, or other
MAFFLGLVCILILLAIASYVQYTRWKKGGKGRFGGPWGRSAPLEAGLLAPLGLALNLGGDPSQLLLPRDPQASFFRFQTRKKETGEDLSRRTSFWGGPGRWMLAKPENXXPGFQLGATNTPLW

SEQ ID NO: 19528 - DNA, 639 bp, Zea mays
  misc_feature: Ceres CLONE 1386941-F
  misc_feature: Encodes the peptide sequence at SEQ ID NO. 19529
  misc_feature (283)..(283): n is a, c, t, g, unknown, or other
  misc_feature (361)..(361): n is a, c, t, g, unknown, or other
  misc_feature (380)..(380): n is a, c, t, g, unknown, or other
  misc_feature (383)..(383): n is a, c, t, g, unknown, or other
  misc_feature (384)..(384): n is a, c, t, g, unknown, or other
  misc_feature (387)..(387): n is a, c, t, g, unknown, or other
  misc_feature (392)..(392): n is a, c, t, g, unknown, or other
  misc_feature (415)..(415): n is a, c, t, g, unknown, or other
  misc_feature (423)..(423): n is a, c, t, g, unknown, or other
  misc_feature (453)..(453): n is a, c, t, g, unknown, or other
tggagctccccgcggtggcggccgctctagaactagtggatcccccgggctgcaggaattcgcacgagaccattacctagaacatcctaatcgaaaagcctctgcgtcttccaccctttgccatttgcttgcaatgtctaatacctgagtgagagagcttcctcagtccatggaggtgtcgtcgaggctccaaagcctcctcagacccttcctactctgccgctcccgcgccgcagggatgaccctccaaaccctagctctttctcccgccgcctcctccgcnatcccatcttccttctcctcgaacgcgccgtctacctcctcctttcccatggcggccatcccgtcttcttttcacagnactttcgctcgtctcccgnccnncgncctgntcagggaggaccacttcactccnagacaggnaccccggccgggccttttgctccgcacgcnaagagctcgcctccgaaacgagtctactacacgagacccttcccaaggggggaagaaacccgtccggggtctcccggaagggatttttttatggcccaattgccttgggggctggggcccaaaatccttaggggttccccccctggggggcccaaatattgttttaaaataaatgttgggggcccc

SEQ ID NO: 19529 - protein, 32 aa, Zea mays
  misc_feature: Ceres CLONE 1386941-F
MAQLPWGLGPKILRGSPPGGPKYCFKINVGGP

SEQ ID NO: 19530 - DNA, 646 bp, Zea mays
  misc_feature: Ceres CLONE 1386951-F
  misc_feature: Encodes the peptide sequence at SEQ ID NO. 19531
  misc_feature (504)..(504): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (529)..(529): n is a, c, t, g, unknown, or other
  misc_feature (592)..(592): n is a, c, t, g, unknown, or other
tggagttcaccgcggtggcggccgctctagaactagtggatcccccgggctgcaggaattcgcacgagaccattacctagaacatcctaatcgaaaaaattagccagcccacctctgctctgcgggcgcttcagatggaagcactagccattggatccgcgcctcgccgtccgggcgcaaggtactcccaacttccgccgccccggaaccctcgccgtcaccaccacagccacagttgcattgccgccccctcacggcgccctccatggacgccgccgttggccgcccgagccgcgcgcctattccgctgcaccagcgcggagacggactcggtggatgaggtcgcgacgagctcgcacgccgcggaggccaacgcggggggcaccacggagcaagagggcaacgggagccccgtggccgccgctgccgcgtactcccccgtggtcgccggcgtcgacgggataaggattccggcggggccccgtgaggggggcccgcggtggnctaacgtggnnncccgttccagttnccgcctcgagaacgaggggaacacgccgcggaacatcctcgagaaaatcatctggaacagggnaacgtcgaggttttcgcagatggaaaggagaggaggcccctgacatttggctga

SEQ ID NO: 19531 - protein, 166 aa, Zea mays
  misc_feature: Ceres CLONE 1386951-F
  misc_feature (124)..(124): Xaa is any aa, unknown, or other
  misc_feature (127)..(127): Xaa is any aa, unknown, or other
  misc_feature (128)..(128): Xaa is any aa, unknown, or other
  misc_feature (132)..(132): Xaa is any aa, unknown, or other
  misc_feature (153)..(153): Xaa is any aa, unknown, or other
MEALAIGSAPRRPGARYSQLPPPRNPRRHHHSHSCIAAPSRRPPWTPPLAARAARLFRCTSAETDSVDEVATSSHAAEANAGGTTEQEGNGSPVAAAAAYSPVVAGVDGIRIPAGPREGGPRWXNVXXRSSXRLENEGNTPRNILEKIIWNRXTSRFSQMERRGGP

SEQ ID NO: 19532 - DNA, 682 bp, Zea mays
  misc_feature: Ceres CLONE 1386958-F
  misc_feature: Encodes the peptide sequence at SEQ ID NO. 19533
  misc_feature (322)..(322): n is a, c, t, g, unknown, or other
  misc_feature (426)..(426): n is a, c, t, g, unknown, or other
tggagctccccgcggtggcggccgctctagaactagtggatcccccgggctgcaggaattcgcacgagaccattacctagaacatcctaatcgaaaaacattattcaggtccaggtcacatgatgcacagacagcccgtccgacgccgggttagctacttgcctacttcagctatatgaaacggcaaaagtcttcccctcgttccccaatctcctctccatcgaaaccctagcacgacgcaattcccgtcttcccacgccgtgtcgccgttgctatgggcaagaagcggaagctcgagcccaaatcggcggcagggttcacngccggttaaggcctccccgaccaccaggtctgccaccgctaaggccgctggtcctatccgaggtcctcgccccccgtcgaggctaccgatggaaaagctgccgncagggggcaggcgggcgagggatgtagaggaaatcgagggaaaggtggaggccccagaggaaaaagggaaaggggaaaaaggaagaacaaggcgagagcgacccaggcttcgatccaggcgctggctggattcgctccccaaggaccagcttggtcgagctgttacgcgacgctgcctcgttcaagggggagtgctaaccacactccggcgcgtgtgcgacgccgacgcggtctcacggaaagatcttcgtaacgg

SEQ ID NO: 19533 - protein, 90 aa, Zea mays
  misc_feature: Ceres CLONE 1386958-F
  misc_feature (6)..(6): Xaa is any aa, unknown, or other
MEKLPXGGRRARDVEEIEGKVEAPEEKGKGEKGRTRRERPRLRSRRWLDSLPKDQLGRAVTRRCLVQGGVLTTLRRVCDADAVSRKDLRN

SEQ ID NO: 19534 - DNA, 713 bp, Zea mays
  misc_feature: Ceres CLONE 1386963-F
ggagctccccgcggtggcggccgctctagaactagtggatcccccgggctgcaggaattcgcacgagaccattacctagaacatcctaatcgaaaaattatccccagctttttctccaagcgtccgttcaggaagctgtccggcaacgagccgctcggcactgggcggtggccgtgcaagagcgatcgggaccgcatcgctcgtctgctcctccaggcctccgcctccctcatcatcactgcagcggcgagaagaacaagggacgggccccggcggtggtctccactgacatcgcctaccatggctaccatgctgccgccgtggcatgggcggatctgcgccccgctgcgggctccccgcgagggtcccccagacggatcttccggcgagagtccaacattttcctaaaatggtagaaaccaacttcaaccaaagggcatctccccaagaagttcctaccccggaatggcttgcccccaggcccctccagggaccaaccttctctcagccgggaaaaaaaatggtttccaaagtctgggccttgggaaacccctgtggggggccgggggaaacaaaactattagggggggccattccccttgggggttaaatataaacccctcccccttttagggggccaaaaccctctggcctctttataccttcaaaaaaaaggaagagagtgcgctcaaaaaggggggcactattgcaag

SEQ ID NO: 19535 - DNA, 721 bp, Zea mays
  misc_feature: Ceres CLONE 1386966-F
  misc_feature: Encodes the peptide sequence at SEQ ID NO. 19536
  misc_feature (659)..(659): n is a, c, t, g, unknown, or other
tggagctccccgcggtggcggccgctctagaactagtggatcccccgggctgcaggaattcgcacgagaccattacctagaacatcctaatcgaaaaaatagcatctgcctacctgcactggactcaaaaacatgcctgccgtaggatcctgtgatgtgtccattcgcgtgttgagtcggcggcttgtgaaggcatccgacccctccctccagccgcacgtcgtcaccttctcaaacctagatctctacccggacaacgtgcaggcctccatagtgtgcctctaccccaagctgtcaacaaagtccggcccgggcggcggcttcgacgccgtcgtctccaccttcgaggccgtcctgccgaccttgcttaaccacttctaccctctcgccggtcgcattgtcgtcaacccaagctccggcgtccccgagctccactgccacaaccagggcgcggagctcgtggtgggagaggtcggcgtcgccctgggcagcctggattacggtcttgccgaggagtccctgaagaagatcatgatgccgtaccctgaggacgtcacgctctcggtgcagctgctgtccttcgcgtgcggcggctttctccgtcgtgtgggccaacaacaacctcctcaacgacggcaacgccatcaccatgtggcgtncaggatgtggtccaagctggacccgggggccggcgggagcatcgcaccgcctgggggaaagg

SEQ ID NO: 19536 - protein, 196 aa, Zea mays
  misc_feature: Ceres CLONE 1386966-F
  misc_feature: SWISSPROT Homolog: EC 2.3.1.160 Vinorine synthase
  misc_feature (176)..(176): Xaa is any aa, unknown, or other
MPAVGSCDVSIRVLSRRLVKASDPSLQPHVVTFSNLDLYPDNVQASIVCLYPKLSTKSGPGGGFDAVVSTFEAVLPTLLNHFYPLAGRIVVNPSSGVPELHCHNQGAELVVGEVGVALGSLDYGLAEESLKKIMMPYPEDVTLSVQLLSFACGGFLRRVGQQQPPQRRQRHHHVAXRMWSKLDPGAGGSIAPPGGK

SEQ ID NO: 19537 - DNA, 685 bp, Zea mays
  misc_feature: Ceres CLONE 1386967-F
tccccgcggtggcggccgctctataactagtggatcccccgggctgcaggaattcgcacgagaccattacctagaacatcctaatcgaaaaaccgagcctcccagtcccagtccgcgcgcccggcgcctccctcgaacgagggccgtacctagcgcctctgtcctccgtcggccgtcgcactgtgcccccgtccgcctccggcctccgccaacccgcgtccgcccacgactaggcggctctgggcaggtccttccacaaagatgtgaaggattaaagctcatgtgaaagattctaagactacaattggtatcaaggcggttgctttcttatttctcatacgctcaaccatgctcctgcatgctaaggattcagggtaggaagaatgcattcagttgctaagaactacctttggggttggatcttactcattcctccaagatccttggaaagagcttccagaaactggtggttccatttcaagaaccggtttcctttactcattgctcatcttgagaggccggttcagttgaaccagaagcatgggggattggtatggggaaagcaatggattggggaaggagggcccgtacctttgcccacagggcactttcccggcctgagtgaaaacggctctgaaagggggaacttttcttaagggccatggcccggttcttctatggcgca

SEQ ID NO: 19538 - DNA, 632 bp, Zea mays
  misc_feature: Ceres CLONE 1386973-F
  misc_feature: Encodes the peptide sequence at SEQ ID NO. 19539
  misc_feature (570)..(570): n is a, c, t, g, unknown, or other
  misc_feature (576)..(576): n is a, c, t, g, unknown, or other
  misc_feature (577)..(577): n is a, c, t, g, unknown, or other
  misc_feature (590)..(590): n is a, c, t, g, unknown, or other
tggcggccgctctagaactagtggatcccccgggctgcaggaattcgcacgagaccattacctagaacatcctaatcgaaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctgacgagcatggacaggaagtgcctcgtggacctcggccacccgctgctcaaccgcgtcgccgacagcttcatccgcgccgctggggtcggggcggccagggccgtctccagggaggcctacgtcgtcaccgtcgaagggctttcaggagactcgtccgggctagacgccgacggcggcaagcggagccatttctccagcatcagaggtgacgacggccagaggtcgctcgacgcagtggtaaaaacggccggcaagaggcttccccggggggggggttggcagccggagtctactcagggctcacgtacgcggctgcgggagggccaggggatgccacgactggnagacgnngggccatcgaggnggctttgtgttggggggggggggtgggcggttcacgggtgga

SEQ ID NO: 19539 - protein, 148 aa, Zea mays
  misc_feature: Ceres CLONE 1386973-F
  misc_feature (128)..(128): Xaa is any aa, unknown, or other
  misc_feature (130)..(130): Xaa is any aa, unknown, or other
  misc_feature (135)..(135): Xaa is any aa, unknown, or other
MSTLDTRTLKDELTSMDRKCLVDLGHPLLNRVADSFIRAAGVGAARAVSREAYVVTVEGLSGDSSGLDADGGKRSHFSSIRGDDGQRSLDAVVKTAGKRLPRGGGWQPESTQGSRTRLREGQGMPRLXDXGPSRXLCVGGGGWAVHGW

SEQ ID NO: 19540 - DNA, 621 bp, Zea mays
  misc_feature: Ceres CLONE 1386975-F
  misc_feature: Encodes the peptide sequence at SEQ ID NO. 19541
tccccgcggtggcggccgctctagaactagtggatcccccgggctgcaggaattcgcacgagaccattacctagaacatcctaatcgaaaaaactactccggcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggtcgcccgatgggtgagcaggtgaagggcatgctccacgacaaggggccgacggcgtcgcaggcgctgacggaggtgacgctgttcccgctgggagggctgctgctggtgctgtcggggctggcgctgacggcctccgtggaggggctggccgagaacacgccggtgatcctgatcttcagccccgtgctcgtccccggcgagctgctcatcgggacggccgacatgggggtcctcacgtcggaagcgctgagagctcgaggagcctgtccatcgctcacgtgcctcgccaacacggagcgtcaggcgatccagcgcaccccggactaacgctgtaggacgagcaccg

SEQ ID NO: 19541 - protein, 135 aa, Zea mays
  misc_feature: Ceres CLONE 1386975-F
  misc_feature (44)..(133): Pfam Name: Oleosin Pfam Description: Oleosin
MADRDRSGIYGGAHATYGQQQQQGGGGRPMGEQVKGMLHDKGPTASQALTEVTLFPLGGLLLVLSGLALTASVEGLAENTPVILIFSPVLVPGELLIGTADMGVLTSEALRARGACPSLTCLANTERQAIQRTPD

SEQ ID NO: 19542 - DNA, 707 bp, Zea mays
  misc_feature: Ceres CLONE 1386979-F
  misc_feature: Translation starting site: 193
  misc_feature (448)..(448): n is a, c, t, g, unknown, or other
  misc_feature (451)..(451): n is a, c, t, g, unknown, or other
tggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatctcagcgggggtttggggggccgggncgncatcgcgctggggctcatgggcggccgggttcgtcacctccggggggcctcggcgtcgctgggctgtccgggttctcctggatgtaccagtacctgacgggcaagcaccccgcggggggcgaccagctggaccacgccaaggggaaggtgggggcccagggcccgggactccagggatgaggacaggccccgatcaccagggggaggggtctttggaaaaaaaaccccactccgaggggacgggggggggggaccc

SEQ ID NO: 19543 - DNA, 656 bp, Zea mays
  misc_feature: Ceres CLONE 1386987-F
  misc_feature: Encodes the peptide sequence at SEQ ID NO. 19544
aagctggagctccccgcggtggcggccgctctataatagtggatcccccgggctgcaggaattcgcacgagaccattacctagaacatcctaatcgaaaaacacaaggttaggcacaagcgaaccaaacccatggcgtccgacggcaccgccgtgtcgacggtgtacggcagcaacggcgcggagctgctggagccgtccaagcagctccaagtcggcgactttctccgtcaaggtggggctggcgcagatgctccggggcgcggtcatcatggacgtggtgaccccggatcatgcgcgcctcgcggaggaggccggcgcgtgcgccgtgatggcgctggagcggctccccgccgatatccgcgcgcagggaggcgtggcgcgcatgtcggacccgggactcatccgcgacatcaagcgcgccgtcaccatcacggtcatggccaaggcccgcatctgacacttcgtggaggcccagatcctggaggccgtgggcgtccactacgtggacgagatcgaggtgctgacccccgccgacgacgcgcaccacatcaacaagtacaacttccggcatcaccttcatttgctgcttgccgcgacctccgcaaggggctccgcagggttggggaagggccccccccatggattcgcacccag

SEQ ID NO: 19544 - protein, 62 aa, Zea mays
  misc_feature: Ceres CLONE 1386987-F
MDVVTPDHARLAEEAGACAVMALERLPADIRAQGGVARMSDPGLIRDIKRAVTITVMAKARI

SEQ ID NO: 19545 - DNA, 655 bp, Zea mays
  misc_feature: Ceres CLONE 1386996-F
  misc_feature (270)..(270): n is a, c, t, g, unknown, or other
aagctggagctccccgcggtggcggccgctctagaactagtggatcccccgggctgcaggaattcgcacgagaccattacctagaacatcctaatcgaaaactctctcgcgcgtccgcgcccgcgcccgcggcctcgttcaatccgccagcgctcccccgccccccggtggtagcgggctctacggcagcgctcctctccggttcccctgcgctccgcgtcttcatctgtggcggcgacgcctccgtcggtgtctcgtcggacggagcgnagcggagctagggttccgtttcatgctcaggatcggcgagatctagggtctcgatttcagggtgattgtactggatagctgctgctgatattgcaagacaatgaaagctcatcagcagcaaggtaatgcatctggcacaggagcaaagaccaaatctttttttgataagatacaaagactgaaagctggtgcacatatcaacaaatcatcaggcaatgtggctgcaaagcgtagaaagggctctccttttgaatcacatagcaaaaggaagatagcatcggagactggcagttttatggaagcgccagcaagggaggctaagttggctgctcggccactaatcagtcttggaaagttaaactttgagcttttcccggtatttgag

SEQ ID NO: 19546 - DNA, 664 bp, Zea mays
  misc_feature: Ceres CLONE 1387002-F
  misc_feature: Encodes the peptide sequence at SEQ ID NO. 19547
  misc_feature (238)..(238): n is a, c, t, g, unknown, or other
  misc_feature (429)..(429): n is a, c, t, g, unknown, or other
tccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaacctaaccggccgacggtggncatgatggccaccgagcccttgtccccggggaatctcgtcgaggacgtcgaaacactacccctggactcctcctccactctcgcggctacgacggacccgctgctccgcccacctcccccctcgtccaccttctctcccaccgccggtgagaaccatggcgcttttctggacgaggaggatgaggacgtgntggatgacttcacgcctccgctggctccccatgccgctacggccgcgacgaagtcccgcgaggcgtcaccgtgggtccgctgaaatcactgactccgagcctaggaagcacgcggagcccgcgacccggaaacgtggtcggcattaccggctccggccgcctacgtcgccgaactcatcggcgaatgggggcccggcgggaggccgagctcccacagagccggcagaaccggaag

SEQ ID NO: 19547 - protein, 90 aa, Zea mays
  misc_feature: Ceres CLONE 1387002-F
  misc_feature (64)..(64): Xaa is any aa, unknown, or other
MMATEPLSPGNLVEDVETLPLDSSSTLAATTDPLLRPPPPSSTFSPTAGENHGAFLDEEDEDVXDDFTPPLAPHAATAATKSREASPWVR

SEQ ID NO: 19548 - DNA, 673 bp, Zea mays
  misc_feature: Ceres CLONE 1387004-F
  misc_feature: Encodes the peptide sequence at SEQ ID NO. 19549
  misc_feature (354)..(354): n is a, c, t, g, unknown, or other
tggagctccccgcggtggcggccgctctagtactagtggatcccccgggctgcaggaattcgcacgagaccattacctagaacatcctaatcgaaaaagtcctctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgtccgcgcgcgccaccgcaccgcccgtccccggtcgggtacctcttcaaccgcgctgccgcctacgcctcttccgccgtggcccaggcggcacctgccaccccgccgccggncaccgggaagcacggcgggggcaagatcactcacgacgtcaccggcgctggagccctcggacagctgcgccatgagatcggtcgcctccttgacgtgcgcttcgatgatggcctccccggccatcctcacggggggtcgaagggctcggaaaacgacgttcccgactggtgctcccaggtgccgctatcccccttgggggagaaactgggcggcgcccccagtctttttatggaccgccaccgaaaaggagctccgttccgccggccccacccggggaatcttaaatcccgtgggtttcccccccaatccactggtggt

SEQ ID NO: 19549 - protein, 169 aa, Zea mays
  misc_feature: Ceres CLONE 1387004-F
  misc_feature: SWISSPROT Homolog: EC 3.6.3.14 H(+)-transporting two-sector ATPase
  misc_feature (63)..(63): Xaa is any aa, unknown, or other
MASRRVVSSLLRSASRLRAASPAAPRPRAPPHRPSPVGYLFNRAAAYASSAVAQAAPATPPPXTGKHGGGKITHDVTGAGALGQLRHEIGRLLDVRFDDGLPGHPHGGSKGSENDVPDWCSQVPLSPLGEKLGGAPSLFMDRHRKGAPFRRPHPGNLKSRGFPPQSTGG

SEQ ID NO: 19550 - DNA, 572 bp, Zea mays
  misc_feature: Ceres CLONE 1387005-F
  misc_feature (48)..(48): n is a, c, t, g, unknown, or other
  misc_feature (49)..(49): n is a, c, t, g, unknown, or other
  misc_feature (60)..(60): n is a, c, t, g, unknown, or other
  misc_feature (182)..(182): n is a, c, t, g, unknown, or other
  misc_feature (183)..(183): n is a, c, t, g, unknown, or other
  misc_feature (191)..(191): n is a, c, t, g, unknown, or other
  misc_feature (270)..(270): n is a, c, t, g, unknown, or other
  misc_feature (271)..(271): n is a, c, t, g, unknown, or other
  misc_feature (296)..(296): n is a, c, t, g, unknown, or other
  misc_feature (309)..(309): n is a, c, t, g, unknown, or other
  misc_feature (310)..(310): n is a, c, t, g, unknown, or other
  misc_feature (330)..(330): n is a, c, t, g, unknown, or other
tggagctccaccgcggtggcggccggctctagaactagtgggatcccnnccgggctgcanggaattcgcacgagaccattacctagaacatcctaatcgaaaaaactcgaaccgaagggacgaccgagcggagtctagactcgagagcaacctcgacctcccggatctctctcccaccacgnnctcgtcgngccgtcgtctgctgcagcgatggcctccccccgactgctctttcatctgcgaaactctttctactgggcgccctacagnnagcatcacaacagggacgtcccggnctttcaagcaaannccgccgttgaggggaagccnttcggttccgttcaaaatgggcctcggtccaccaattggggatagggggaatgaattcaaacccttacctcgtttgaggcgggaaaattttccccgttaccctcctgtgaaaaaaagaaggggtttttccccccccaggggggggggggggggggtcccccctggggaacaccccctttcccgcggggattttttggaaatttttcctcccaaaaaaaccccccggggcgcgcgcgggggga

SEQ ID NO: 19551 - DNA, 626 bp, Zea mays
  misc_feature: Ceres CLONE 1387006-F
  misc_feature (313)..(313): n is a, c, t, g, unknown, or other
  misc_feature (314)..(314): n is a, c, t, g, unknown, or other
  misc_feature (324)..(324): n is a, c, t, g, unknown, or other
agagctggagctccccgcggtggcggccgctctagaactagtggatcccccgggctgcaggaattcgcacgagaccattacctagaacatcctaatcgaaaagaaggcacacagccgccgctgtttcttcatcttactcgtgctcggcacgcaggcgacggcgacggcggcggcgttcaggctcgggctctcagcgacggtatcagtggtctcccgcctctcgccagtcgcgtcgcgccctcgcctccggtcctctgcacaccgtccggtgaccttgtgttgtaagtttttccagcactgcttgctcacccannttctcattanaaaaccctcaattctgtccctgagcaccaaatcaagaccatacccaatttagtgggggcgggacaggatggcaaatggcccgcagtttcttgccccaatggtggatttcccaggggtccgtcccctccagagggaaattatttcaagggtgggttggtgggggggccccccgggaaatgggggcatttgggaaagggggggggggccttggcccggggaaaggtttcccggggggggatcttaaatttttttttaaggaggggttaaccccaaaaaaaaacccttggggccccgggggaaat

SEQ ID NO: 19552 - DNA, 737 bp, Zea mays
  misc_feature: Ceres CLONE 1387014-F
  misc_feature: Encodes the peptide sequence at SEQ ID NO. 19553
  misc_feature (389)..(389): n is a, c, t, g, unknown, or other
  misc_feature (401)..(401): n is a, c, t, g, unknown, or other
  misc_feature (726)..(726): n is a, c, t, g, unknown, or other
ggagctccccgcggtggcggccgctctagaactagtggatcccccgggctgcaggaattcgcacgagaccattacctagaacatcctaatagaaaaagaagccgcagccacgcccccacaccaagccgtatcgtcttctccctcttgtccggttcgggtggtccgcggtcggggtgagtgagtgagcagctttgcttctccatctccccgttcccttccctccccagccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggaggcggcnagcggcgggcgncggtggcggccaacggaaaggcgtgctgccacgccgccaaggggcccgggtacgccacgccgctggaggccatggagaagggccccagggagaagctcgtctacgtcacctgcgtctacaacggcaccggaattaacaagccggattaccttgcgacgggggatttggatcccagctctcctacgtactcccaggtgatccacaggctcccggtcacccacatcggcgacgagctgcatcactctgggctggactcctgcagctcctgccacggggacccatcggccaagcgccggttcctgatcctgcctcccttgctggcaanccggggggatg

SEQ ID NO: 19553 - protein, 88 aa, Zea mays
  misc_feature: Ceres CLONE 1387014-F
  misc_feature (85)..(85): Xaa is any aa, unknown, or other
MEKGPREKLVYVTCVYNGTGINKPDYLATGDLDPSSPTYSQVIHRLPVTHIGDELHHSGLDSCSSCHGDPSAKRRFLILPPLLAXRGD

SEQ ID NO: 19554 - DNA, 652 bp, Zea mays
  misc_feature: Ceres CLONE 1387017-F
  misc_feature: Encodes the peptide sequence at SEQ ID NO. 19555
  misc_feature (389)..(389): n is a, c, t, g, unknown, or other
  misc_feature (399)..(399): n is a, c, t, g, unknown, or other
tggagctccccgcggtggcggccgctctataactagtggatcccccgggctgcaggaattcgcacgagaccattacctagaacatcctaatcgaaaaaggagacttggcttgtactgcatcgcaaaccgcaatcgcacgcggcacttgccccccgcgatcataacctcaccgcccgccaccagctgcagccacaagcgcagcgctcgacagcctcaccagccgccatcactcgcggcagtacccggccgctgggactgcaagagtggggagtgagacgctgctgctgttgccgagcgcgaggagacactactactcactcaagagtcaagactcaacagcagcaggggcgaccgagctctgcgtgcgtggggagaaccggagaaggcancagaggaggnagggagggagcgcgtggaccaggctaggcgcagcagcatgggcgccgggatcagggtcctggcggcgctcttggcggcgctcgcggcagccaccgccggcgtgacggcgcagctgcggcaggactactacgcggcggtgtgcccggacctggagagcatcgtgcgcgccgcggtgtccaagaaggtgcaggcgcagcccgtcgccgtgggcgccaccatccgcctcttcttcacgactgcttcgtcgagggct

SEQ ID NO: 19555 - protein, 72 aa, Zea mays
  misc_feature: Ceres CLONE 1387017-F
  misc_feature: SWISSPROT Homolog: EC 1.11.1.7 Peroxidase
MGAGIRVLAALLAALAAATAGVTAQLRQDYYAAVCPDLESIVRAAVSKKVQAQPVAVGATIRLFFTTASSRA

SEQ ID NO: 19556 - DNA, 644 bp, Zea mays
  misc_feature: Ceres CLONE 1387018-F
  misc_feature: Encodes the peptide sequence at SEQ ID NO. 19557
  misc_feature (490)..(490): n is a, c, t, g, unknown, or other
  misc_feature (580)..(580): n is a, c, t, g, unknown, or other
  misc_feature (610)..(610): n is a, c, t, g, unknown, or other
  misc_feature (626)..(626): n is a, c, t, g, unknown, or other
  misc_feature (636)..(636): n is a, c, t, g, unknown, or other
ggagctccccgcggtggcggccgctctagaactagtggatcccccgggctgcaggaattcgcacgagaccattacctagaacatcctaatcgaaaaactgctctctctccatctccttctccctctctcccagtccgtggcgggagcttgccaattgtcagatcgcagttcagttcgcttacacggtttgcatgcccccctcgtgtctgggctgtctgcagttgtgcgtgcagcggcgtcggagagatggcgtcggaggccaaggacgtgggcatcctcgccatggacatctacttcccgcccagctgcgtgctccaggaagagttggaaacacatgatggtgtgagcaaagggaagtacaccattgggcttgggcaggaaaatatggcattttgcactgaagttgaggatgttatttcgatgagcttgacagttgtgaagtccctcctgaaaaattataacattgacccaaagtgcattggacgtttgnaagttggcagtgaaacagtaatagacaagagcaagtctataaagacatggctgatgcagatattcgaggaatctggcaatactgatattngaggagtgactccctcaatgcgtgctatgntggaacagctgcattngttaaattgngttaactg

SEQ ID NO: 19557 - protein, 132 aa, Zea mays
  misc_feature: Ceres CLONE 1387018-F
  misc_feature (4)..(132): Pfam Name: HMG_CoA_synt_N Pfam Description: Hydroxymethylglutaryl-coenzyme A synthase N terminal
  misc_feature: SWISSPROT Homolog: EC 2.3.3.10 Hydroxymethylglutaryl-CoA synthase
  misc_feature (82)..(82): Xaa is any aa, unknown, or other
  misc_feature (112)..(112): Xaa is any aa, unknown, or other
  misc_feature (122)..(122): Xaa is any aa, unknown, or other
  misc_feature (127)..(127): Xaa is any aa, unknown, or other
  misc_feature (130)..(130): Xaa is any aa, unknown, or other
MASEAKDVGILAMDIYFPPSCVLQEELETHDGVSKGKYTIGLGQENMAFCTEVEDVISMSLTVVKSLLKNYNIDPKCIGRLXVGSETVIDKSKSIKTWLMQIFEESGNTDIXGVTPSMRAMXEQLHXLNXVN

SEQ ID NO: 19558 - DNA, 685 bp, Zea mays
  misc_feature: Ceres CLONE 1387018-R
  misc_feature: SWISSPROT Homolog: EC 2.3.3.10 Hydroxymethylglutaryl-CoA synthase
cgaattgggtaccgggccccccctcgaggtcgacggtatcgatattttttttttttttttttggcacccaaaaaataggttcattgaatgacatcagattccgattacatacagggcaaaccaatgggaacagctatggccgactactccacgctcaaatgcaaaactgcagcttgctaacaagacatttcacagctgcataagagccctatgcgttaacaggaacgacaggctacctaacctaactctatagcatttacagggtaaacgggacacctatacataggatgggctaccaggtcagttaccacggctatctacaaacattgaaccaagcctctcaccctgcactttgcgcagctaccaaagaaccatggatcatgccttctctcctttcccttcagcacaagaagcattgccgtttgtcagaatgcttaggaacacctgcctctgttatttgacttgttgcagctccgggcagaagacagatcagtggccgttggacattgcagtagtggtgacaccgtcacctttcacgtcatagaaccttcggtacttggagtcaacgtgcgtgagataatatgtgcctacagatagcaaacttgtgtcttgactggtcacgaaatctttcgccccataccggtgctccatcagtttcagtacctcaataaatatctttggcggg

SEQ ID NO: 19559 - DNA, 652 bp, Zea mays
  misc_feature: Ceres CLONE 1387021-F
  misc_feature: Encodes the peptide sequence at SEQ ID NO. 19560
gagctggagctccccgcggtggcggccgctctagaactagtggatcccccgggctgcaggaattcgcacgagaccattacctagaacatcctaatcgaaaaagccatctcctcaccctcgttcaccacacagtccgccactcctttagtagcttgtgatttgtacgtccacgagatcactggtcgggtggcggacgacgacacatggagaagggtagtgtggatgcatcatggtgggcgttcctcctgctcgccggcgtgctgctggtcgtaacagccacgcccaggccggaggacggagtgatcaaacggaaccgcaaggaggacctgcgatggtgcaagcaggcgtgcgagtggcaatacggaaacgacaccccgcggaagagggaatgcaagagcgagtgccgcgagcggcaccagcaagctgacgcgttcgaggacggcgacagcgtcgtgtacgcctacttctcccgctccgggaggggcgagtgccggcgccagtgcctgcgccgccacgagggccagccgtgggagacccaggagtgcatgaggcggtgccgcctccgcggactgttcgtctacatgtagcaagagtacggtcgcgtcagcgagagcgcgatcaagtgccgtgagaggtgcgagcgccaccacgc

SEQ ID NO: 19560 - protein, 127 aa, Zea mays
  misc_feature: Ceres CLONE 1387021-F
MEKGSVDASWWAFLLLAGVLLVVTATPRPEDGVIKRNRKEDLRWCKQACEWQYGNDTPRKRECKSECRERHQQADAFEDGDSVVYAYFSRSGRGECRRQCLRRHEGQPWETQECMRRCRLRGLFVYM

SEQ ID NO: 19561 - DNA, 631 bp, Zea mays
  misc_feature: Ceres CLONE 1387032-F
  misc_feature: Encodes the peptide sequence at SEQ ID NO. 19562
tggagctccccgcggtggcggccgctctagaactagtggatcccccgggctgcaggaattcgcacgagaccattacctagaacatcctaatcgaaaaagtaatacggcacgccgttcaatctaccgggacggcgagacggagaatagaagacgtcagcactcagcagttcagcactgacccgtcggccgtcgccctcccggctcgcaaccgcatctctctcggcttctggcctcttcctagttcctaactaccaccgccacctctaccactggcctcaatctgcaaaccctagccctcgtcgccggcggccatggccgagaccgtcgacgacaaggtcagctactttcaggccgtcaccggcatctccaacacggacctctgcacggagatcctcgccgcgcacaactgggacctgcagctcgcggtgtccaccatcaccgccaaccccttctcgccctccgcttcggcctccacctcctcgcgtgacccggccccttccgctccgttggcggtagatgcggagtacgtcgcgcccccgcccccgctgccgctgccgctgccgccccagcagcagcccgggatcgcgtggaagctggtgacgctcccccttcacgtggtctcggggtgggg

SEQ ID NO: 19562 - protein, 106 aa, Zea mays
  misc_feature: Ceres CLONE 1387032-F
MAETVDDKVSYFQAVTGISNTDLCTEILAAHNWDLQLAVSTITANPFSPSASASTSSRDPAPSAPLAVDAEYVAPPPPLPLPLPPQQQPGIAWKLVTLPLHVVSGW

SEQ ID NO: 19563 - DNA, 697 bp, Zea mays
  misc_feature: Ceres CLONE 1387035-F
  misc_feature: Encodes the peptide sequence at SEQ ID NO. 19564
  misc_feature (466)..(466): n is a, c, t, g, unknown, or other
  misc_feature (605)..(605): n is a, c, t, g, unknown, or other
  misc_feature (606)..(606): n is a, c, t, g, unknown, or other
tccccgcggtggcggccgctctagaactagtggatcccccgggctgcaggaattcgcacgagaccattacctagaacatcctaatcgaaaacgaaaaaaccccaccgcagcacagcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatggaggacggcgacgagatcgacgccatgcttcaccagaccggaggcagcgttcctagcaccacctaanagcagcagctgcggagcctcgttttgctctccgccctgcgtagtactaaacaaaagggaaaaagtcttttaagggaacttgtgatgctctggctcccttgtgcattgctgagggacatcctttagccttatttaggggnnatggtttggtactttggtctggcatcactccgttatctatcccctataactggcggccatggttgtacttccaaaaaaaaaaaaaaaaagg

SEQ ID NO: 19564 - protein, 99 aa, Zea mays
  misc_feature: Ceres CLONE 1387035-F
  misc_feature (21)..(91): Pfam Name: ubiquitin Pfam Description: Ubiquitin family
MSGAGEEDKKPAEGGAHINLKVKGQDGNEVFFRIKRSTQLKKLMNAYCDRQSVDMNAIAFLFDGRRLRGEQTPDELEMEDGDEIDAMLHQTGGSVPSTT

SEQ ID NO: 19565 - DNA, 600 bp, Zea mays
  misc_feature: Ceres CLONE 1387036-F
  misc_feature: Encodes the peptide sequence at SEQ ID NO. 19566
  misc_feature (400)..(400): n is a, c, t, g, unknown, or other
  misc_feature (483)..(483): n is a, c, t, g, unknown, or other
  misc_feature (541)..(541): n is a, c, t, g, unknown, or other
  misc_feature (600)..(600): n is a, c, t, g, unknown, or other
aaagtggagtccccgcggtggcggccgctctagaactagtggtcccccgggctgcaggaattcgcacgagaccattacctagaacatcctaatcgaaaaattgaactggctctggggaccgccctgtaacatccaccaactcgaggaggaggaggaggagaagagatccccccaccgagcctcggtttccaagcgccagcagaagaagaagagacaggacacatggcggcaggtttcggcccgaggttcgccgccggcgatgctccggcgagacggtgtaacctggagcggttcctcgaggccaccacgcccgtcgttgcgtcctccagctgctcgtccaaggtacccgatctaccggatcccgacggggccaacgctgcgcgagctggacgcctgcttnctcacctacccactcctggtcacgcagttcgcagcaggcgccagcagcaacgggcccagaacggcgacgggagccaccgcgancgggatgatgtggctcccgacgttcgcgatggccgtcgtaccaggtgaaaggcgcggncgttgaaccccgggctggcccgaacgggcagggggggcgggtcccctccggcagggcgn

SEQ ID NO: 19566 - protein, 95 aa, Zea mays
  misc_feature: Ceres CLONE 1387036-F
  misc_feature (47)..(47): Xaa is any aa, unknown, or other
  misc_feature (75)..(75): Xaa is any aa, unknown, or other
MLRRDGVTWSGSSRPPRPSLRPPAARPRYPIYRIPTGPTLRELDACXLTYPLLVTQFAAGASSNGPRTATGATAXGMMWLPTFAMAVVPGERRGR

SEQ ID NO: 19567 - DNA, 663 bp, Zea mays
  misc_feature: Ceres CLONE 1387037-F
  misc_feature: Encodes the peptide sequence at SEQ ID NO. 19568
  misc_feature (310)..(310): n is a, c, t, g, unknown, or other
tccccgcggtggcggccgctctagaactagtggatcccccgggctgcaggaattcgcacgagaccattacctagaacatcctaatcgaaaagttccataaaccctaacctcgttggattcgcggcaaaaatcctcccaattcggaaccctccgatgttccagctacctgcgggagctgagccgtgctcggtttggcgaaatttcgcacccctcttgtgctaggaccacccggttcaagctgttcctcggaagggtcaggtcttcaccggtgttctccggcgccggatccaggtttgttccggcgagaggntcggcctcttggtgggggccagcccagcttcgagctcaatttgccggcctgagatggaatcgcgactgcggtgccggtgcctcaggtagtcgcgtcgagtcgacgcgcgattcctgccatttgggtgggccagcctttcctgggcaatctcggggggcgtttcgcctcgctgcgtggcagaaaggtgtgacgtgtgatgcatcccaaggctcgaatccacgccgacccggtgcgcgaggtcgaccacttcgactgcctgccggattcgctcgtcctgctcatcctgaacaaggtcgaggacgtgcggtcgctcggccggtgctacgccgtgtccaagcggctctgtgggctcg

SEQ ID NO: 19568 - protein, 52 aa, Zea mays
  misc_feature: Ceres CLONE 1387037-F
MHPKARIHADPVREVDHFDCLPDSLVLLILNKVEDVRSLGRCYAVSKRLCGL

SEQ ID NO: 19569 - DNA, 722 bp, Zea mays
  misc_feature: Ceres CLONE 1387041-F
  misc_feature: Encodes the peptide sequence at SEQ ID NO. 19570
  misc_feature (565)..(565): n is a, c, t, g, unknown, or other
  misc_feature (566)..(566): n is a, c, t, g, unknown, or other
  misc_feature (583)..(583): n is a, c, t, g, unknown, or other
  misc_feature (584)..(584): n is a, c, t, g, unknown, or other
  misc_feature (626)..(626): n is a, c, t, g, unknown, or other
  misc_feature (666)..(666): n is a, c, t, g, unknown, or other
tccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcacaccgaccgcgnntgtgatgattgccgagnncaaagtcgcggttttcaatcaatgggaagctatctacccacntttgttgggacttccaccttcagcgagtacccgcatgggnttggggtgggttggtggttgcaaagatcaaccctcaggctccccttttgataaagt

SEQ ID NO: 19570 - protein, 174 aa, Zea mays
  misc_feature: Ceres CLONE 1387041-F
  misc_feature (34)..(143): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (123)..(123): Xaa is any aa, unknown, or other
  misc_feature (129)..(129): Xaa is any aa, unknown, or other
  misc_feature (143)..(143): Xaa is any aa, unknown, or other
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRITPTAXVMIAEXKVAVFNQWEAIYPXLLGLPPSASTRMGLGWVGGCKDQPSGSPFDK

SEQ ID NO: 19571 - DNA, 731 bp, Zea mays
  misc_feature: Ceres CLONE 1387044-F
  misc_feature: Encodes the peptide sequence at SEQ ID NO. 19572
  misc_feature (513)..(513): n is a, c, t, g, unknown, or other
  misc_feature (565)..(565): n is a, c, t, g, unknown, or other
  misc_feature (566)..(566): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (681)..(681): n is a, c, t, g, unknown, or other
aagctggagctccccgcggtggcggccgctctagaactagtggatcccccgggctgcaggaattcgcacgagaccattacctagaacatcctaatcgaaaaaacccaacacggccgtccccgtcccgagtcaccaactcaccaccgaccctagcaaaaccgcacgcaccctgccagcggccccccaactcccaacccaacccctactccagctagcgcggcggctgcggccatggcgttccggctgagcaacaacctgatcggggtcctcaacttcgtcaccttcctgctctccgtcccgatcctgggcgcgggcatctggctgggccaccgcgccgacggcaccgagtgcgagcgctacctctcggcgcccgtcatcgcgctgggggccttcctcctcgccgtctccctggcgggcctcgtcggcgcatgctgccgcgtcacctggctgctctgggcctacctcctcgccatgttcgtcctcatcctcgtcctcttctgcttcaccgtcttncgccttcgtcgtcaccaacaggggcgccgggcgaggccgtctccggccgcgnnatacaaggagtacccgcctcggggactactccaactggctgcagaagcgcgtcgaaacaccaggaactggnnnaccgggatcaggagctgcctccaagggactcaaaggtctgcnaggagcctgcaggacaaggaacgagaccggcgccccacagttcacgagtt

SEQ ID NO: 19572 - protein, 166 aa, Zea mays
  misc_feature: Ceres CLONE 1387044-F
  misc_feature (5)..(154): Pfam Name: Tetraspannin Pfam Description: Tetraspanin family
  misc_feature (94)..(94): Xaa is any aa, unknown, or other
  misc_feature (112)..(112): Xaa is any aa, unknown, or other
  misc_feature (136)..(136): Xaa is any aa, unknown, or other
MAFRLSNNLIGVLNFVTFLLSVPILGAGIWLGHRADGTECERYLSAPVIALGAFLLAVSLAGLVGACCRVTWLLWAYLLAMFVLILVLFCFTVXRLRRHQQGRRARPSPAAXYKEYPPRGLLQLAAEARRNTRNWXTGIRSCLQGTQRSARSLQDKERDRRPTVHE

SEQ ID NO: 19573 - DNA, 779 bp, Zea mays
  misc_feature: Ceres CLONE 1387049-F
  misc_feature: Encodes the peptide sequence at SEQ ID NO. 19574
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
ataaacacaannnnccgncnnccgcgcccggcgccggcgcgcggnnntnnataagctggagctccaccgcggtggcggccgctctagaactagtggatcccccgggctgcaggaattcgcacgagaccattacctagaacatcctaatcgaaaaaaaacccaatccatccaaacccatttccctcgctcccatcccgtcccgccccttgtctcttccgcttccccccgaccccgcgcgccgcggaccagcagccatgtcgtgctcccacctctccaccgcctggtcctcctcggcgctcgccagcagcgcctccaccacccgacggcgctcccccccgcgctcgggtctcctggtgcggtgttccctccgtgagctccgcacccgcatcgactccgtcaggaacacgcagaagatcacggaggccatgtaagctggtggccgccgccaaggtccggcgcgcgcaggaggcccgtcgtatcctctcggcctttctcggaagaactgaagggaagagcagcaacaaggtgaggcagtaagatgcagcgacagagcgctaggacgtgaacatagaaagataaccgaccacttggtgggcgaggaagacgacggggtggattaagaaacggggcagggggagagagacgggcggaccccgcacacgccccgccaccgagcgcggagccgccccggaggcggatggaggaacgtggatagggcggtcggagcaggaccaggcggggaagagagggacagggagccgatgagcgaagaaacagag

SEQ ID NO: 19574 - protein, 58 aa, Zea mays
  misc_feature: Ceres CLONE 1387049-F
  misc_feature: SWISSPROT Homolog: EC 3.6.3.14 H(+)-transporting two-sector ATPase
MSCSHLSTAWSSSALASSASTTRRRSPPRSGLLVRCSLRELRTRIDSVRNTQKITEAM

SEQ ID NO: 19575 - DNA, 652 bp, Zea mays
  misc_feature: Ceres CLONE 1387052-F
  misc_feature: Encodes the peptide sequence at SEQ ID NO. 19576
  misc_feature (303)..(303): n is a, c, t, g, unknown, or other
  misc_feature (375)..(375): n is a, c, t, g, unknown, or other
  misc_feature (376)..(376): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (389)..(389): n is a, c, t, g, unknown, or other
  misc_feature (392)..(392): n is a, c, t, g, unknown, or other
  misc_feature (393)..(393): n is a, c, t, g, unknown, or other
  misc_feature (395)..(395): n is a, c, t, g, unknown, or other
  misc_feature (396)..(396): n is a, c, t, g, unknown, or other
  misc_feature (401)..(401): n is a, c, t, g, unknown, or other
  misc_feature (421)..(421): n is a, c, t, g, unknown, or other
  misc_feature (452)..(452): n is a, c, t, g, unknown, or other
  misc_feature (458)..(458): n is a, c, t, g, unknown, or other
  misc_feature (459)..(459): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (554)..(554): n is a, c, t, g, unknown, or other
  misc_feature (555)..(555): n is a, c, t, g, unknown, or other
  misc_feature (646)..(646): n is a, c, t, g, unknown, or other
ccccgcggtggcggccgctctagaactagtggatcccccgggctgcaggaattcgcacgagaccattacctagaacatcctaatcgaaaaacggggcacaggacgcgcgcgatcccctcgagtccggattgccatggccaccacggcgttcgccgccgccaggttcttccccgcccacctcgactcctccccacgcatcgcgccccaccgcgtcgggcccaccgcgaatctctccttctcaccgctttccgccaactcctcgtccctgctccgcctccattccccctgccatccgggcccggnggtaggctgcccccgccgccgcgatcgtacggcggcgccggcggatctggcgacgcgcgaaactccgggggnngnnnaaggccccncgnnannctccncccggccccccccccccggnggggccgccggcccccgcgcgggccccgcgncccccnngcgggggggccgggggggggccccccgcggcgccccccnnngggcggcggggggggcggcccccccccgcggggcccggccccgccggggggggnngggcggccccccccgcggggggcggggccgcgcccgggccccgcggcgcgggcccccccccccccccccggcggcggccccccgcgggggncccgcc

SEQ ID NO: 19576 - protein, 173 aa, Zea mays
  misc_feature: Ceres CLONE 1387052-F
  misc_feature (57)..(57): Xaa is any aa, unknown, or other
  misc_feature (81)..(81): Xaa is any aa, unknown, or other
  misc_feature (82)..(82): Xaa is any aa, unknown, or other
  misc_feature (83)..(83): Xaa is any aa, unknown, or other
  misc_feature (86)..(86): Xaa is any aa, unknown, or other
  misc_feature (87)..(87): Xaa is any aa, unknown, or other
  misc_feature (88)..(88): Xaa is any aa, unknown, or other
  misc_feature (90)..(90): Xaa is any aa, unknown, or other
  misc_feature (107)..(107): Xaa is any aa, unknown, or other
  misc_feature (109)..(109): Xaa is any aa, unknown, or other
  misc_feature (122)..(122): Xaa is any aa, unknown, or other
  misc_feature (123)..(123): Xaa is any aa, unknown, or other
  misc_feature (141)..(141): Xaa is any aa, unknown, or other
MATTAFAAARFFPAHLDSSPRIAPHRVGPTANLSFSPLSANSSSLLRLHSPCHPGPXVGCPRRRDRTAAPADLATRETPGXXXGPXXXSXRPPPPGGAAGPRAGPAXPXRGGRGGAPRGAPXXAAGGAAPPRGARPRRGGXGGPPRGGRGRARAPRRGPPPPPPAAAPRGGPA

SEQ ID NO: 19577 - DNA, 631 bp, Zea mays
  misc_feature: Ceres CLONE 1387054-F
  misc_feature: Encodes the peptide sequence at SEQ ID NO. 19578
tggagctccccgcggtggcggccgctctagaactagtggatcccccgggctgcaggaattcgcacgagaccattacctagaacatcctaatcgaaaaagagagagaaaggggagggaggggcagataaagaacactgcaccatttgtgtgctcacttgctttcaaacgtgcacctcccctcttcttcctcctcccctcatctccttccaacaacgccataaccacagcttccctctcctcctctctcttgttgcacgaatatgacgccataaccacagcttccccgtgaacgacaaggagaagcagagagtgctacataggtacatgtagggtactataggataagaactatacagctaggaggtagcggagggaggagcacgccgccagcagtagggatgtacaagaaccagctccaagaactggcgcagaggagctgcttcagcctgccgtcgtacgtgtgcacgcgcgaggggcccgaccacgcgccgcgcttccgggcggccgtcaccttcaacggcgagaccttcgagggccccagcggttgcaccacgcttccgcaggccgaacacgccgctgtccgaagtcgccctccccccgctctcccttcggggggccgcccactaccctc

SEQ ID NO: 19578 - protein, 77 aa, Zea mays
  misc_feature: Ceres CLONE 1387054-F
  misc_feature (2)..(62): Pfam Name: dsrm Pfam Description: Double-stranded RNA binding motif
  misc_feature: SWISSPROT Homolog: EC 3.1.26.3 Ribonuclease III
MYKNQLQELAQRSCFSLPSYVCTREGPDHAPRFRAAVTFNGETFEGPSGCTTLPQAEHAAVRSRPPPALPSGGRPLP

SEQ ID NO: 19579 - DNA, 656 bp, Zea mays
  misc_feature: Ceres CLONE 1387065-F
  misc_feature: Encodes the peptide sequence at SEQ ID NO. 19580
  misc_feature (367)..(367): n is a, c, t, g, unknown, or other
  misc_feature (368)..(368): n is a, c, t, g, unknown, or other
  misc_feature (403)..(403): n is a, c, t, g, unknown, or other
  misc_feature (455)..(455): n is a, c, t, g, unknown, or other
ggagctccccgcggtggcggccgctctagaactagtggatcccccgggctgcaggaattcgcacgagaccattacctagaacatcctaatcaaaaaaaaaaagtcttcacttccattccaccggctccgatcccaactggcatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcggcggcttcagcgagatcgtgccggacaccgtcnntgtcgatgatttcgagaggtcgcacccacgacggncacagtgagctcgtcgctgctgcttgggatcactgggctccagacactaagntcaggagtgcgatagatactgcactgggaaaatggggagggcacccaacctgaaaaagctgaggaagggaagtcctgttaacctcaccaaggttcttggaaatggtggggcttaactgggtcatccaggcctggggaaaagttccaacggaaaaaaaggtccggttaatttaggacccccgggggtatacccagggggaat

SEQ ID NO: 19580 - protein, 89 aa, Zea mays
  misc_feature: Ceres CLONE 1387065-F
  misc_feature (76)..(76): Xaa is any aa, unknown, or other
  misc_feature (88)..(88): Xaa is any aa, unknown, or other
MALSIYTPTSSSLVPPSIQEVRLTSRPPKPATFSLRRPHLAARAAAGNAPTSPVREVVTELDAVGGFSEIVPDTVXVDDFERSHPRRXQ

SEQ ID NO: 19581 - DNA, 656 bp, Zea mays
  misc_feature: Ceres CLONE 1387067-F
  misc_feature: Encodes the peptide sequence at SEQ ID NO. 19582
  misc_feature (586)..(586): n is a, c, t, g, unknown, or other
  misc_feature (628)..(628): n is a, c, t, g, unknown, or other
  misc_feature (633)..(633): n is a, c, t, g, unknown, or other
aaagctggagctccccgcggtggcggccgctctagaactagtggatcccccgggctgcaggaattcgcacgagaccattacctagaacatcctaatcgaaaaatttgaacctccaagttcagaaactgaccccctcgtccctccccaccatcgcgatggctgacgacgccgcggcggcggcgttcgcgccctctccctcgccaccgtcacccgtagcgcaacctctgcccgacctctccccgccgccgcccttctccccaccagccggcacccctgcttccggggcgcagacgccgagcctcccggacaccccggcctccctagatccggacacccccttctccgacgccaccccgacccccgccgacgcctccgacgccggcctcgcttcggacgacggcatcaccaacccgtcggggggcaccgccggcaagcacatgacgctcgcgccgcccgccccgcccgccaagaaaccgtccaagaagaagggcggcaacagcgtctggacccgcccggcctcccgcaagggcaagaagaaggcgaggcagccgggcggctcgcaccgggttttctcgggggtccccgncgggggcccgccagaggctccaaccctaggcccaacgccggngggtnaaggaggagttccctcgtcgtcc

SEQ ID NO: 19582 - protein, 73 aa, Zea mays
  misc_feature: Ceres CLONE 1387067-F
  misc_feature (50)..(50): Xaa is any aa, unknown, or other
  misc_feature (64)..(64): Xaa is any aa, unknown, or other
  misc_feature (66)..(66): Xaa is any aa, unknown, or other
MTLAPPAPPAKKPSKKKGGNSVWTRPASRKGKKKARQPGGSHRVFSGVPXGGPPEAPTLGPTPXGXGGVPSSS

SEQ ID NO: 19583 - DNA, 604 bp, Zea mays
  misc_feature: Ceres CLONE 1387070-F
  misc_feature: Encodes the peptide sequence at SEQ ID NO. 19584
  misc_feature (523)..(523): n is a, c, t, g, unknown, or other
aagctggagctccccgcggtggcggccgctctagaactagtggatcccccgggctgcaggaattcgcacgagaccattacctagaacatcctaatcgaaaaatcgaaaacccaccgcaccctttcatcagcctgcctgtccactgttggcttggtgacttcctccgctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgccctcggcgtacgacaagaaccctggaggaccaggtgcggcccggcgttccgtgcccggacaatgtgatcgggaagcggcggggagccccccaaaaagtaactgggaaccccccccccccaaaaaacgggggtttttttccgcccccggggggggggggaaaccccaaatttggcccctttgtggggggggggccccacaaaaaccccggggggntttttttgttttttaaaaaaaaaaccggggggtgttaaaacaaaaaaagggggggggtcccccccccccccctaaaagaaa

SEQ ID NO: 19584 - protein, 55 aa, Zea mays
  misc_feature: Ceres CLONE 1387070-F
MAAAAGSKGRAIAGSFVSRVLAGKAASPRRAVHALGVRQEPWRTRCGPAFRARTM

SEQ ID NO: 19585 - DNA, 867 bp, Zea mays
  misc_feature: Ceres CLONE 1387071-F
  misc_feature (22)..(22): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (265)..(265): n is a, c, t, g, unknown, or other
  misc_feature (268)..(268): n is a, c, t, g, unknown, or other
  misc_feature (270)..(270): n is a, c, t, g, unknown, or other
  misc_feature (273)..(273): n is a, c, t, g, unknown, or other
  misc_feature (280)..(280): n is a, c, t, g, unknown, or other
  misc_feature (282)..(282): n is a, c, t, g, unknown, or other
  misc_feature (284)..(284): n is a, c, t, g, unknown, or other
  misc_feature (289)..(289): n is a, c, t, g, unknown, or other
  misc_feature (290)..(290): n is a, c, t, g, unknown, or other
  misc_feature (297)..(297): n is a, c, t, g, unknown, or other
  misc_feature (298)..(298): n is a, c, t, g, unknown, or other
  misc_feature (303)..(303): n is a, c, t, g, unknown, or other
  misc_feature (304)..(304): n is a, c, t, g, unknown, or other
  misc_feature (306)..(306): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (333)..(333): n is a, c, t, g, unknown, or other
  misc_feature (341)..(341): n is a, c, t, g, unknown, or other
  misc_feature (345)..(345): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (361)..(361): n is a, c, t, g, unknown, or other
  misc_feature (362)..(362): n is a, c, t, g, unknown, or other
  misc_feature (370)..(370): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (383)..(383): n is a, c, t, g, unknown, or other
  misc_feature (385)..(385): n is a, c, t, g, unknown, or other
  misc_feature (386)..(386): n is a, c, t, g, unknown, or other
  misc_feature (391)..(391): n is a, c, t, g, unknown, or other
  misc_feature (392)..(392): n is a, c, t, g, unknown, or other
  misc_feature (396)..(396): n is a, c, t, g, unknown, or other
  misc_feature (406)..(406): n is a, c, t, g, unknown, or other
  misc_feature (408)..(408): n is a, c, t, g, unknown, or other
  misc_feature (409)..(409): n is a, c, t, g, unknown, or other
  misc_feature (418)..(418): n is a, c, t, g, unknown, or other
  misc_feature (419)..(419): n is a, c, t, g, unknown, or other
  misc_feature (425)..(425): n is a, c, t, g, unknown, or other
  misc_feature (429)..(429): n is a, c, t, g, unknown, or other
  misc_feature (437)..(437): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (452)..(452): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (491)..(491): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (504)..(504): n is a, c, t, g, unknown, or other
  misc_feature (506)..(506): n is a, c, t, g, unknown, or other
  misc_feature (512)..(512): n is a, c, t, g, unknown, or other
  misc_feature (513)..(513): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (531)..(531): n is a, c, t, g, unknown, or other
  misc_feature (533)..(533): n is a, c, t, g, unknown, or other
  misc_feature (537)..(537): n is a, c, t, g, unknown, or other
  misc_feature (538)..(538): n is a, c, t, g, unknown, or other
  misc_feature (543)..(543): n is a, c, t, g, unknown, or other
  misc_feature (546)..(546): n is a, c, t, g, unknown, or other
  misc_feature (551)..(551): n is a, c, t, g, unknown, or other
  misc_feature (555)..(555): n is a, c, t, g, unknown, or other
  misc_feature (556)..(556): n is a, c, t, g, unknown, or other
  misc_feature (563)..(563): n is a, c, t, g, unknown, or other
  misc_feature (564)..(564): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (610)..(610): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (622)..(622): n is a, c, t, g, unknown, or other
  misc_feature (624)..(624): n is a, c, t, g, unknown, or other
  misc_feature (630)..(630): n is a, c, t, g, unknown, or other
  misc_feature (631)..(631): n is a, c, t, g, unknown, or other
  misc_feature (637)..(637): n is a, c, t, g, unknown, or other
  misc_feature (646)..(646): n is a, c, t, g, unknown, or other
  misc_feature (647)..(647): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (660)..(660): n is a, c, t, g, unknown, or other
  misc_feature (666)..(666): n is a, c, t, g, unknown, or other
  misc_feature (667)..(667): n is a, c, t, g, unknown, or other
  misc_feature (673)..(673): n is a, c, t, g, unknown, or other
  misc_feature (698)..(698): n is a, c, t, g, unknown, or other
  misc_feature (706)..(706): n is a, c, t, g, unknown, or other
  misc_feature (707)..(707): n is a, c, t, g, unknown, or other
  misc_feature (717)..(717): n is a, c, t, g, unknown, or other
  misc_feature (743)..(743): n is a, c, t, g, unknown, or other
  misc_feature (746)..(746): n is a, c, t, g, unknown, or other
  misc_feature (790)..(790): n is a, c, t, g, unknown, or other
  misc_feature (805)..(805): n is a, c, t, g, unknown, or other
  misc_feature (844)..(844): n is a, c, t, g, unknown, or other
  misc_feature (848)..(848): n is a, c, t, g, unknown, or other
gccgcccccttccggggcgttntgagacgatccccccccccncnnccaaaactgggactccccgcggtggcggccgctctagaactagtggatcccccgggctgcaggaattcgcacgagaccattacctagaacatcctaatcgaaaaatcgatcgccaatgcaagtttgtccattccccttgatctgaatactgtggctactagcgagaatgcaactgtggcgaagctgggtggtcgccattactgccagctgggggcaaganagntnaantagggtncntngtaannggagccnnttaannanttagnnnnnactaccaaaggggggggnaggaatcngganaaagataannnggggnntagctaantgagnnnnngggnannaaaanngggnggggattggnannaaacatggnnggaggncggngccggggngctgaggnnncggtnatggtacgtcgttcggnnnngggggnnnnngggnnnntngnnnnnnngaagnangttttnntcaccgnnnnngannnananaaannccaantgnggggngggnnaccgggnngcggannnnnnnnaaacttcccggggggcgccccccacccnnnggncctnnncggggntnagaagnngaggancgaagaccnnggcccgnnngggngaaatnnattaanccgcgccgtgcgcgagcacggaacngcgccggnnccaccaatanggccagggaacagatggctgcgattnagngtgaagccaatatgagcgacggccctgtcgtggaagagaatggngctgcaaaagtgaanattaagaggagagaaagtaaaactgtgcgccatgaaganctcnctttttcaattgcagagat

SEQ ID NO: 19586 - DNA, 747 bp, Zea mays
  misc_feature: Ceres CLONE 1387074-F
  misc_feature: Encodes the peptide sequence at SEQ ID NO. 19587
aagctggagctccccgcggtggcggccgctctagaactagtggatcccccgggctgcaggaattcgcacgagaccattacctagaacatcctaatcgaaaacttttgagaactccccttctccgccactaccgaagcccttgtacccctcaccgccgccgctgctgctagggagcttccatccgcgcgcgcctacaacgagagctagcagcggtagcggccgttatcttgtcgctccggctccgttcgtgtacccaagtcccagcctagatgccgcagatggaggggtccactgatcagatcgccgccggctggttcgctaaggagccggcttccgagcggcccgtgggcttgccgaggaccggctcttccagtcgcctcaacgcgcaggcgccggagttcgtgccgcgggggccgccgccaccggcgccggcggttgtgctgccgcctccgccgcaggtgatccgcatgttcgccgcgcctccccccgccgccgcgtgggggcttcttctccgcgccgcagccccggccgttcgagtactatgcgcctatcggggaacgcagcggatttgctgccaaggagccacaggcgccggagctggaaccggagatgctcccgccccccgccggggaaaaggagccggtggtggatgggcctcgaccaccagcgggggcacaagaacccccagcaagggggaataacattttagtggacatcaaccttggctactaacggaacatccggatg

SEQ ID NO: 19587 - protein, 143 aa, Zea mays
  misc_feature: Ceres CLONE 1387074-F
  misc_feature (32)..(49): Pfam Name: PAM2 Pfam Description: Ataxin-2 C-terminal region
MPQMEGSTDQIAAGWFAKEPASERPVGLPRTGSSSRLNAQAPEFVPRGPPPPAPAVVLPPPPQVIRMFAAPPPAAAWGLLLRAAAPAVRVLCAYRGTQRICCQGATGAGAGTGDAPAPRRGKGAGGGWASTTSGGTRTPSKGE

SEQ ID NO: 19588 - DNA, 614 bp, Zea mays
  misc_feature: Ceres CLONE 1387088-F
  misc_feature: Encodes the peptide sequence at SEQ ID NO. 19589
  misc_feature (132)..(132): n is a, c, t, g, unknown, or other
  misc_feature (309)..(309): n is a, c, t, g, unknown, or other
  misc_feature (354)..(354): n is a, c, t, g, unknown, or other
  misc_feature (374)..(374): n is a, c, t, g, unknown, or other
  misc_feature (489)..(489): n is a, c, t, g, unknown, or other
tcacccgcggtggcggccgctctagaactagtggatcccccgggctgcaggaattcgcacgagaccattacctagaacatcctaatcgaaaaacgcactccgcaattccgcatcacgcaccccaccccaccngcccgcaaccgcaagctcagattccctcccaccccaccccaccgtcccgctcactccagcccagcccgcgtccccacagcccagcgacagcgagcaccggcggcatccagccatgtgcggcggcgccatcctgtcggacatcatcccgccgccgccgccgcggcgggtcacggcggnccacctctggcccgagagcaagaagccgaggagggctgcagccgncaggaggagagcccccgtgnagcaggagcaggaggaggatttcgaggccgacttcgagggagtcgaggtggagtccggcgagtcggagctcgagtccgaggacgagccccaagcccagccttttcgcgccccagnagggcgctcggcagaggtggactaaacactggtgcagctgggtggcaatggccctgctgcaatttcagttaagggagagggagaaaccggttcaggggtatccgcccgggccggggggcaaaagg

SEQ ID NO: 19589 - protein, 89 aa, Zea mays
  misc_feature: Ceres CLONE 1387088-F
  misc_feature (22)..(22): Xaa is any aa, unknown, or other
  misc_feature (37)..(37): Xaa is any aa, unknown, or other
  misc_feature (44)..(44): Xaa is any aa, unknown, or other
  misc_feature (82)..(82): Xaa is any aa, unknown, or other
MCGGAILSDIIPPPPPRRVTAXHLWPESKKPRRAAAXRRRAPVXQEQEEDFEADFEGVEVESGESELESEDEPQAQPFRAPXGRSAEVD

SEQ ID NO: 19590 - DNA, 656 bp, Zea mays
  misc_feature: Ceres CLONE 1387093-F
  misc_feature: SWISSPROT Homolog: EC 2.7.2.3 Phosphoglycerate kinase
gctctagaactagtggatcccccgggctgcaggaattcgcacgagaccattacctagaacatcctaatcgaaaaaacccagggtgagtctccggatccgtcgccgtctggtctccgtgtgctctcgtcgccgtcgccgtcgccgccgtctgactgaccccctcgcctcccgcggcgtcgggtctctggtgctgctgctactgctgctgcgtgcagggctgtgatggcgacgaagaggagcgtgggcaccctcggcgaggcggatctgaaggcggaagaaggtgttcgtgcgcgccgacctcaacgtccctctcgacgacgcccagaagatcaccgacgacacccgggggtggggggctccgtccccaccatcaagtccctccctcgagaaggggcgccaaggttcttcctcgccggcccgcctgggtccgggccacgagggtgtcacccccaaagggacggggttggcccctcctggtttcccggcctcggcccgtccctcccttgcgcgcccccccccggtccctgggtcaattgctctcttctcgcctggcacgtcgttttcgccaccgtcgcgcccccgggcctagccccaggatcccgcgccacccttgagttcacgccggtgccgcctctcctttttcgcccgcgcgcctc

SEQ ID NO: 19591 - DNA, 693 bp, Zea mays
  misc_feature: Ceres CLONE 1387100-F
  misc_feature: Encodes the peptide sequence at SEQ ID NO. 19592
  misc_feature (488)..(488): n is a, c, t, g, unknown, or other
  misc_feature (495)..(495): n is a, c, t, g, unknown, or other
  misc_feature (540)..(540): n is a, c, t, g, unknown, or other
  misc_feature (645)..(645): n is a, c, t, g, unknown, or other
tccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacgggcgcgacgtctanctttccntggtgttcccatctgggccccggggggggggtgggcccgcgcccntccaagccgtggcgggccggggcccccacggggccgcgccctgggggccaacgacaggcctgggccaccaaacggccggcggtcgtcggctcattcgccctgggnccaatcacgggcgcctcgccccttcggggcttgggccttgccaaggaa

SEQ ID NO: 19592 - protein, 120 aa, Zea mays
  misc_feature: Ceres CLONE 1387100-F
  misc_feature (52)..(52): Xaa is any aa, unknown, or other
  misc_feature (55)..(55): Xaa is any aa, unknown, or other
  misc_feature (70)..(70): Xaa is any aa, unknown, or other
  misc_feature (105)..(105): Xaa is any aa, unknown, or other
MAGIGRNMVAPLLVLNLIMYIIVIGFASWNLNHFINGQTNYPGVAGNGRDVXLSXVFPSGPRGGGGPAPXQAVAGRGPHGAAPWGPTTGLGHQTAGGRRLIRPGXNHGRLAPSGLGPCQG

SEQ ID NO: 19593 - DNA, 626 bp, Zea mays
  misc_feature: Ceres CLONE 1387103-F
  misc_feature: Encodes the peptide sequence at SEQ ID NO. 19594
  misc_feature (218)..(218): n is a, c, t, g, unknown, or other
  misc_feature (239)..(239): n is a, c, t, g, unknown, or other
  misc_feature (278)..(278): n is a, c, t, g, unknown, or other
  misc_feature (279)..(279): n is a, c, t, g, unknown, or other
  misc_feature (287)..(287): n is a, c, t, g, unknown, or other
  misc_feature (288)..(288): n is a, c, t, g, unknown, or other
  misc_feature (291)..(291): n is a, c, t, g, unknown, or other
  misc_feature (297)..(297): n is a, c, t, g, unknown, or other
aaagctggagctccccgcggtggcggccgctctagaactagtggatcccccgggctgcaggaattcgcacgagaccattacctagaacatcctaatcgaaaaataatatcgccgcggcctcgcacctccatctgttctatatcgccccattgctcgctcgccaagagttcttcttgttaggcaaggcaaaagcagaagcaaaaaaagaaaggtcttgntgccgatggggagctcagggntctcgtggacgcttccggaccacccccagctccccaggnngaaaacgnntgnctgccntcctgcttgacggatggggcgaaggccaccccggacaagtacactggattcatgtccgctacaactcctggactggactctcttaagaatgcggctcctgaaaaatgagacctaatggagggtcctggacagcttgtggggctcccatctgaggatgacatggccacaagggaaattggcacaatggccttgggggttgtgcccaatttttccccaaggggtaaaacttttgcaattaaagtcttggcttccgaaaagattttgttgggggggggggggttcaactacatcaaaaaatcttttttaaaaggggactctccccctaatgt

SEQ ID NO: 19594 - protein, 71 aa, Zea mays
  misc_feature: Ceres CLONE 1387103-F
  misc_feature: SWISSPROT Homolog: EC 5.4.2.1 Phosphoglycerate mutase
MEGPGQLVGLPSEDDMATREIGTMALGVVPNFSPRGKTFAIKVLASEKILLGGGGFNYIKKSFLKGDSPPN

SEQ ID NO: 19595 - DNA, 719 bp, Zea mays
  misc_feature: Ceres CLONE 1387105-F
  misc_feature: Encodes the peptide sequence at SEQ ID NO. 19596
ctagaactagtggatcccccgggctgcaggaattcgcacgagaccattacctagaacatcctaatcgaaaaatcagccttttccaatcaatcaccagctcaaacttgtacccaaaaccctacaccggagggagagggatggtcaagaaagccgtctccaccgcgccagcagacgccgaggccgacgagcgccgccgcctccgctcgctcgccttctccaacggcctgctccagcgaggcgaccccgcggcgccgcgggcgccgctcgcgccggaggctgccgtcacgcgcctacagggacgcgacgtcgtccgccgtggcggccagcgaaagagccgctacctcttctccttccctggcctcctcgcgccagaagcctcgggtggccgggtcggagagctcgccgacctcgggaccaagaaccccctgctgtacctcgagttcccatagggaaggatgaagctcttcggtacgcacgtttaccccagaacaagtacctcacgctggagatgaccagatcgggcaagggcgtcgactgtgaggaactcttttgagagcctgattgtgttttctgaagcccggggggcgcgaaccaaggaagatatcccggacagcgtcaacctggagtttccaaaagaattccaaaatcgaggcgacgacaggaggactgggatttccacagggggggggccggggggggccccatcgatgacaagcaac

SEQ ID NO: 19596 - protein, 103 aa, Zea mays
  misc_feature: Ceres CLONE 1387105-F
MVKKAVSTAPADAEADERRRLRSLAFSNGLLQRGDPAAPRAPLAPEAAVTRLQGRDVVRRGGQRKSRYLFSFPGLLAPEASGGRVGELADLGTKNPLLYLEFP

SEQ ID NO: 19597 - DNA, 698 bp, Zea mays
  misc_feature: Ceres CLONE 1387119-F
  misc_feature: Encodes the peptide sequence at SEQ ID NO. 19598
  misc_feature (428)..(428): n is a, c, t, g, unknown, or other
tggagctccccgcggtggcggccgctctagaactagtggatcccccgggctgcaggaattcgcacgagaccattacctagaacatcctaatcgaaaaatcaaccatattattgagaccaacaagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagccccttcaccctacaggctccaacaagcaatcgcaacaagcaacttacctttatcacccctgttcttttcacaatcggcagccctatctttggtgcagtcattggtacnaaccatcagggcacaacagctggagcaactcgtgctaccaaggatcagccaagaagctctggaaaacctttctcccaactctcagaacaaaaattcttccattcaacacatggttaacctggacctgggtggttaatttgaaaaaaaaaaaataatacctttcggccggttggtttctggcctcttccccacaaaaaaaatttttctcctttaaacaattccgcccaaggaaccccctttgttttttccccgaaaaaatcataaaccctg

SEQ ID NO: 19598 - protein, 132 aa, Zea mays
  misc_feature: Ceres CLONE 1387119-F
  misc_feature (88)..(88): Xaa is any aa, unknown, or other
MAAKIFSILMLLALSACVANATIFPQYSQAPIAALLPPYLPSMTASVCENPAPSPYRLQQAIATSNLPLSPLFFSQSAALSLVQSLVXTIRAQQLEQLVLPRISQEALENLSPNSQNKNSSIQHMVNLDLGG

SEQ ID NO: 19599 - DNA, 652 bp, Zea mays
  misc_feature: Ceres CLONE 1387122-F
  misc_feature: Encodes the peptide sequence at SEQ ID NO. 19600
  misc_feature (486)..(486): n is a, c, t, g, unknown, or other
  misc_feature (519)..(519): n is a, c, t, g, unknown, or other
tccccgcggtggcggccgctctagaactagtggatcccccgggctgcaggaattcgcacgagaccattacctagaacatcctaatcgaaaaataggaaaaacgactccacacggtccacggcgtcgtctccggcgaaccttcgcgagccctcggctcccctctaccaccgctgccgcgaccccgcctacggagcatcctcgggtagcgctctggcttcccgtgccggcggacgtcctgcaggaggcggcggcctccgtggcatgttgatgagggccgccgctgccctccctcgccgatcgtcgcggccctcggagccggggtcctcctcctcccgggctcccgcccctggggcctcctccagccgggctcctgcccccggggcctccttcgaccccttcgatgtcgataccgacccgccatcgcggcttgagctgacgcccgagcagatcgggctctgcgttgacgcgctcgcgcatttcgagtancaggggaagcgccgggatgacttgtccgacgangtcagaagcctctcggtatcggatattagacatatggaaacgatcagtgtagctcattatcctggtaatagaggaaaggaacgaaatattgatggcttacctttggcggatcccgaggacggctaaaatcctc

SEQ ID NO: 19600 - protein, 127 aa, Zea mays
  misc_feature: Ceres CLONE 1387122-F
  misc_feature (75)..(75): Xaa is any aa, unknown, or other
  misc_feature (86)..(86): Xaa is any aa, unknown, or other
MLMRAAAALPRRSSRPSEPGSSSSRAPAPGASSSRAPAPGASFDPFDVDTDPPSRLELTPEQIGLCVDALAHFEXQGKRRDDLSDXVRSLSVSDIRHMETISVAHYPGNRGKERNIDGLPLADPEDG

SEQ ID NO: 19601 - DNA, 799 bp, Zea mays
  misc_feature: Ceres CLONE 1387123-F
  misc_feature: Encodes the peptide sequence at SEQ ID NO. 19602
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (774)..(774): n is a, c, t, g, unknown, or other
nnnnncccccccccccccccnnnccccccccgcccgcgggggctttnnnnnnnnaaaagctggagctccccgcggtggcggccgctctagaactagtggatcccccgggctgcaggaattcgcacgagaccattacctagaacatcctaatcgaaaaacacactcgcgaaccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggacgccaaaacccttctctttgttgagagggagggttggctgtgtttggctgcaggaccctgagggattcccgggggggggtttccggttggtgctggaaaaatggttggtgagccccaaacggggggtttttcaccggacccagggagaaaggctggagcctcacttggggaaggggggcgggcccagggaaggggggggcttcctgcgggtgcgtaggggggggaggggccgcccggggggggggtggggggggggggggggcgggggaacggagggggcgggggcgggggagtggggaccggtggggctgccagaggggaaggggggggaagaggcgagggnccggttggtcccctctcttgtgaag

SEQ ID NO: 19602 - protein, 84 aa, Zea mays
  misc_feature: Ceres CLONE 1387123-F
  misc_feature (4)..(85): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLVARVALQSDDVELVAVNDPFISTDYMTYMFKYDTVHGQWKHHEVKVKDAKTLLFVEREGWLCLAAGP

SEQ ID NO: 19603 - DNA, 725 bp, Zea mays
  misc_feature: Ceres CLONE 1387132-F
  misc_feature (679)..(679): n is a, c, t, g, unknown, or other
tccccgcggtggcggccgctctagaactagtggatcccccgggctgcaggaattcgcacgagaccattacctagaacatcctaatcgaaaaactggcatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacccggtcggccacggcctgcccctaggcgttgacatccagatccatctcgctccgatctacattcgagaagtttgtctccgacatcgattccccagtctgaatcgttgtcgacgtcttctttgggtggacggtcgaagtcacgcgcacgcacatcccacacttgttcctccccggcggtgcattcagcaacactgtcttcttctccgtgtcggagcacctcgggccacaggggcggacccgtgaacgacgttctttcggcgtgtcacgatctccggtcgcaagctcgatgctctccccatcgacacgcgagnccccttggaggggccccgacctagattttactgagatttctcctca

SEQ ID NO: 19604 - DNA, 732 bp, Zea mays
  misc_feature: Ceres CLONE 1387134-F
  misc_feature: Translation starting site: 226
  misc_feature: SWISSPROT Homolog: EC 1.1.1.1 Alcohol dehydrogenase
  misc_feature (683)..(683): n is a, c, t, g, unknown, or other
aagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagtagtagagagtgtcggtgaaggtgtgaccgagttccaagtcggtgaccacgttctcactgtcttcattggggaatgcaagagctgcaagcactgcgtctcagggaagagcaacatgtgccagaagctcggtctgggagaaggaaggntgtcatgcacagcgatcagaagacacgcttctctgtcaaggggaaacct

SEQ ID NO: 19605 - DNA, 694 bp, Zea mays
  misc_feature: Ceres CLONE 1387136-R
  misc_feature: Pfam Name: UPF0057 Pfam Description: Uncharacterized protein family UPF0057
ccgattgggtaccgggccccccctcgaggtcgacggtatcgatattttttttttttttttttctaataaccatctgcagtttcatttcacaagcaaaactgaacgaggtagcaaagtaaccctaattaactccacagatcccgcaacaccagatcttagtttatggaatgaatccgtccagattgtcagattcgacatacgaatttacagtttacagaaggccacaggatggatttagtttgctaaaccaaacaaaaagatgcacacagcacagcggacggaggtagcagcagagacacggaccagagcaccacggggaccggtccatctgtcatgcgacgtagacgtagtcgtcgtcgtcgcggtggcggtgggggtcgacggagcagatgacgtagacggcgtagaggacgccggggaggtagccgaggatggtgagcagcacactgatccagaactccatctgcccagaaaggcaacgggctgtaagagcagagcaaagcaagcagggaaggggaggatagagcgggactcacggagcagcagccgtggcggaggcagacgccgagggggggaggaggaccgagcacagcagctccaggcaccggcagcagcacgagcacaggcccatctccttcctccacctgcgggcgacggcgcgcgtgcaagtgctgattgatggcgtctcctccga

SEQ ID NO: 19606 - DNA, 630 bp, Zea mays
  misc_feature: Ceres CLONE 1387136-F
agagctggagctccccgcggtggcggccgctctagaactagtggatcccccgggctgcaggaattcgcacgagaccattacctagaacatcctaatcgaaaagagatttgaagttccaggcttccagccgtgctcgtgtaggcgaccagtgaggcagcgaccagcgagcagccagccgctagcacagggtgccgcagagcagctgagtagccgaggcagccgccgccgagcacagggcgcagccgagcagccgagcattctctggcctaatacacgtactcaactgccggcaccaatcgtgtccatgcgcaatggtagtctttaatttcctccctgcaagctacctatcgatcgaccgcacaaccccacgagtttatgtgcagtgcagtactgcagttttatttgctctcagactctagagcatgcggctggatcgcccctcgtctgccgggtgttgtaagagctgcatccagggcacttgtgcgccaagatgtggaactgcacgttggacgtcacgccacagtcgttgcaaaggatccatacctgaacgagaacgcaggaacaaggctgaatgctgccagttcgacagagaaacaacccagggggacggggaggcagacagagacagag

SEQ ID NO: 19607 - DNA, 607 bp, Zea mays
  misc_feature: Ceres CLONE 1387139-F
  misc_feature: Encodes the peptide sequence at SEQ ID NO. 19608
  misc_feature (322)..(322): n is a, c, t, g, unknown, or other
  misc_feature (325)..(325): n is a, c, t, g, unknown, or other
  misc_feature (342)..(342): n is a, c, t, g, unknown, or other
  misc_feature (388)..(388): n is a, c, t, g, unknown, or other
aagctggagctccccgcggtggcggccgctctagaatagtggatcccccgggctgcaggaattcgcacgagaccattacctagaacatcctaatcgaaaaagtctatcttctcggctcgcacacctcagacacagccaggcagcggagcgctcccccttcccctcgattctttcgcttccttctagaaccttccgctccctccgctgcaacagtaacactgagcttcctcctcctcccaccccgaagatgacgaccatggagaacgtgatcgtgctcgtgaaccgcatccagcgtggctggaacgtcctcggcgaccacggnggnggggaaggcggcggctncctttcctaccctctgggagcgctcccgacggtcgccgtcgtcggnggtcaaagatcgggaaatcatcggtgctcgagaggatcgtggggggagaattctggctcgaggatcagggatcgtgacacgtaaggcactcggcctgtgagtgacaagaagaaggccggggggaagaaaattttccaggtcccttacatggccaagcgccgggtcactgattctctatgggggggggaggaaaccaggatgagaatgtgagggtgagag

SEQ ID NO: 19608 - protein, 74 aa, Zea mays
  misc_feature: Ceres CLONE 1387139-F
  misc_feature (32)..(32): Xaa is any aa, unknown, or other
MTTMENVIVLVNRIQRGWNVLGDHGGGEGGGXLSYPLGALPTVAVVGGQRSGNHRCSRGSWGENSGSRIRDRDT

SEQ ID NO: 19609 - DNA, 658 bp, Zea mays
  misc_feature: Ceres CLONE 1387147-F
  misc_feature: Encodes the peptide sequence at SEQ ID NO. 19610
aaagctggagctccccgcggtggcggccgctctagaactagtggatcccccgggctgcaggaattcgcacgagaccattacctagaacatcctaatcgaaaaccctgatccactctccgcttcccgctccgatcgacctgctccctccccaccaccgagcccatggcggaccagctcaccgacgaccagatcgccgagttcaaggaggccttcagcctcttcgacaaggacggggatggttgcatcacgaccaaggagctgggcactgtcatgcgctcgctggggcaaaatcctacagaagctgagctccaggacatgatcaacgaggtcgatgctgatggaaacggcaccatcgatttcccagagtttctcaaccttatggctcgcaagatgaaggacaccgactctgaggaagagctcaaggaggcctccgtgtgtttgacaggaccagaacggtttcttctcggcggcgaggtccgcatgtcatgacaaatctgggtgagagcttactgatgaggaggggaaccaaatgatcgggaggcttaaggccaaggggatggccaaacaacaaaaaaggatttgccagggcttgatggcccaggggacccccaaaacctaatttggaagggaaaaaaattccgctattgaaattaaacca

SEQ ID NO: 19610 - protein, 108 aa, Zea mays
  misc_feature: Ceres CLONE 1387147-F
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELQDMINEVDADGNGTIDFPEFLNLMARKMKDTDSEEELKEASVCLTGPERFLLGGEVRMS

SEQ ID NO: 19611 - DNA, 625 bp, Zea mays
  misc_feature: Ceres CLONE 1387159-F
  misc_feature: Encodes the peptide sequence at SEQ ID NO. 19612
tccccgcggtggcggccgctctagaactagtggatcccccgggctgcaggaattcgcacgagaccattacctagaacatcctaatcaaaattattcatagaagcacggctcctttccaagacaatcagcgaacgaaacgaaccctaagcaaatcgaggtcgaggggtggtccgatctcggtggctactgattatcggccgcccttcccgcgacgcggtctgcgctttggccggtcctgcggcgccttgacatccgcccggctgcccgtcagccatatcaactgaatatcccattcaaagggcggcagcagcgtacgtgtaccaccaccgtgttccggccgtccaccgtttccagcacacagggtaaaggcgagcgaaacgagcgctgagacgcctagcccgcaatacaaaatccggaggaactcccaggaggcgaaaagcagatccgtctcccccgaccggcgatcgctatcgacttgtagcgtaagccatggcgtctgaagcgctaatctgcgatacggagcagtggaatgccctccaggcgcacgtcggcgcgattcacaagacgcacctgcgcgacctgatggccgacgccgaccgatgcaagactatgacgcctgagtatg

SEQ ID NO: 19612 - protein, 45 aa, Zea mays
  misc_feature: Ceres CLONE 1387159-F
  misc_feature: SWISSPROT Homolog: EC 5.3.1.9 Glucose-6-phosphate isomerase
MASEALICDTEQWNALQAHVGAIHKTHLRDLMADADRCKTMTPEY

SEQ ID NO: 19613 - DNA, 662 bp, Zea mays
  misc_feature: Ceres CLONE 1387163-F
aaagctggagctccccgcggtggcggccgctctagaactagtggatcccccgggctgcaggaattcgcacgagaccatacctagaacatcctaatcgaaaaaccatcacagtacgcacgcacgcacacaccagcccagcagcagaagcgcccctcggccctcgctcccacaacaagctcaagccagccttctctctctgctccaatggcgcgcttccagctcgcagccgtggccatggccatgctcttcgccgcggcggcggcgcaggccccgaccgccaccccgacgccggctcccaaggcgtcccccccgccggcgacgccgccgccgacccccgcgccggtgtctccgcccgtgccgcccccgaccatgcctccgccggcgcccgcgcccacccccaaggcaccggccccagggcccgaggcccccaccccggcgcccacggccgaggctcccactcccaaggtgagctccccgccaatgcccacagagggcgccgctccaacgccttctgcggaggcggcaccaaccccgtgcgccaccagagacgggaacagcccccgggcagggaaagtcttggcctcaggcttcgcgggcaaccccaggggacgcgccgcggtacaaaaaggggaagggccaaaacccccaacccccgacaaagg

SEQ ID NO: 19614 - DNA, 632 bp, Zea mays
  misc_feature: Ceres CLONE 1387165-F
  misc_feature: Encodes the peptide sequence at SEQ ID NO. 19615
  misc_feature (360)..(360): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
tccccgcggtggcggccgctctagaactagtggatcccccgggctgcaggaattcgcacgagaccattacctagaacatcctaatcaaaaaatattagaaaagaaaactctgttcaaccacccgccgagttcagcagcactctcctccgccctcttccaggtccagcagagattgggggcgcgtgggcatcggagattgcctcgggagcgcgtttcctggtcaactaaggccggcatgaagggctgctcagagcgcttgctgtttctgctgctgctgctggcatcgtcgtcgttactgtccgctgtgattgccgcgcagcagacttgccccgccgacctcgacagcaaatgcgatggtgncgcgctggatgatgattgnnnagnnnnattcttccccggcgtcccgaaaatcaagtatgagggtccaacaagcaagaaccctcttgcttataagtggtataacaagggaggagtgattctcggtaagaagatgaaggattggatgcgcttcagtgtttgcgtctggcacacgttccgcggtactggcgctgatccttttcgtgctcctacaaagacttggccttgggagatggcacaaatcgttggccatggctaaaagagaaggaagctcc

SEQ ID NO: 19615 - protein, 126 aa, Zea mays
  misc_feature: Ceres CLONE 1387165-F
  misc_feature: SWISSPROT Homolog: EC 5.3.1.5 Xylose isomerase
  misc_feature (42)..(42): Xaa is any aa, unknown, or other
  misc_feature (48)..(48): Xaa is any aa, unknown, or other
  misc_feature (49)..(49): Xaa is any aa, unknown, or other
  misc_feature (50)..(50): Xaa is any aa, unknown, or other
  misc_feature (51)..(51): Xaa is any aa, unknown, or other
MKGCSERLLFLLLLLASSSLLSAVIAAQQTCPADLDSKCDGXALDDDXXXXFFPGVPKIKYEGPTSKNPLAYKWYNKGGVILGKKMKDWMRFSVCVWHTFRGTGADPFRAPTKTWPWEMAQIVGHG

SEQ ID NO: 19616 - DNA, 678 bp, Zea mays
  misc_feature: Ceres CLONE 1387182-F
  misc_feature: Translation starting site: 240
  misc_feature (528)..(528): n is a, c, t, g, unknown, or other
  misc_feature (532)..(532): n is a, c, t, g, unknown, or other
  misc_feature (649)..(649): n is a, c, t, g, unknown, or other
tggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataaggaccgcgggacatcacgatgatgccttcagcaccttcttcagccagactggtgctggggaagcacgttccccgtgcaaatcttcgttgatctagaacccactggggattcgatgagggtgcgcactgggcacgtaccgccagctcttccaccctgagcagctcatcagngggncaggggggatgccgctaacaaatttcgcccgtggccactaccaattgggaaaggagaaattggttgatctggtgcccttgaccggatccggcaaggtttgctgacaaatgaaccggnctcaaggggctttcctgcctgccaaaggc

SEQ ID NO: 19617 - DNA, 643 bp, Zea mays
  misc_feature: Ceres CLONE 1387186-F
  misc_feature: Encodes the peptide sequence at SEQ ID NO. 19618
  misc_feature (419)..(419): n is a, c, t, g, unknown, or other
  misc_feature (420)..(420): n is a, c, t, g, unknown, or other
  misc_feature (471)..(471): n is a, c, t, g, unknown, or other
gctctagaactagtggatcccccgggctgcaggaattcgcacgagaccattacctagaacatcctaatcgaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactcccaagacccttctcttcggtgacaagccggtcaccgtctttggctcaggaaccctgaggaaatcccgtggnngtgaggctggcgctgagtatggtcgtggagtccaccggcgtcttcactgancaggacaaggctgctgcacatcttccaagggtggtgcccaagaagggttgttatctctgcccccaaggaaagatgcaccccatgttttggttggttggtggtcaatgaggacaaggaccccctgcggagggtaacattgggttcccaaggggtaagttggcaccacaaaacg

SEQ ID NO: 19618 - protein, 72 aa, Zea mays
  misc_feature: Ceres CLONE 1387186-F
  misc_feature (4)..(70): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSQDPSLR

SEQ ID NO: 19619 - DNA, 683 bp, Zea mays
  misc_feature: Ceres CLONE 1387188-F
  misc_feature: Encodes the peptide sequence at SEQ ID NO. 19620
  misc_feature (267)..(267): n is a, c, t, g, unknown, or other
  misc_feature (300)..(300): n is a, c, t, g, unknown, or other
  misc_feature (381)..(381): n is a, c, t, g, unknown, or other
tccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcaggggcttgtacggcgctggcngccggctgacgacgatgatggggcgccggcggnctgtacccctacgcggagtacctgaggcagccgcagggcagccccgctggcggcggcgccctaactacgccggggtgtggncagcccgagcgccatggttcagccgctccgggcaacagtggtgccagcagcagattgagaatgatggacgtgcagtccggcccgcagaagttggagatgatgaatgcaactttgagcgggcccgtgcccgccagaacaaacctgtacgaggccagttcgggaggcggcagaaagaagcgggttggtggggaagccccaggggtcccccccccagggccaggggggggggggcaaaaatgcgggcccatggggggacctccccaagacccattggcccgttaccggcccaccccggggggggc

SEQ ID NO: 19620 - protein, 56 aa, Zea mays
  misc_feature: Ceres CLONE 1387188-F
  misc_feature (38)..(38): Xaa is any aa, unknown, or other
  misc_feature (49)..(49): Xaa is any aa, unknown, or other
MKMVIVLVVCLALSAASASAMQMPCPCAGLQGLVRRWXPADDDDGAPAXCTPTRST

SEQ ID NO: 19621 - DNA, 704 bp, Zea mays
  misc_feature: Ceres CLONE 1387193-F
  misc_feature: Encodes the peptide sequence at SEQ ID NO. 19622
  misc_feature (333)..(333): n is a, c, t, g, unknown, or other
gctctagaactagtggatcccccgggctgcaggaattcgcacgagaccattacctagaacatcctaatagaaaaaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcggggccgatggctacctgtactgcgagggagtgcggntgcagcacgcgatgacgggtgccgagcgcagccccttctacctctacagcaagccacagatcctccgcaacttcgccgcctaccgcgatgctctccaggggctccgctccatcatcgggtatgccgtgaagggcaacaacaacctccccgtgctacgcgtcctgcgtgagcttggctgcggcgcccgtcctcgtcagcggcaaccgagctccgactcgccctccaggcgggattcgaccccgcccgggtgcatattaaccgggaaatggggaagacactcgaaacatcttaaattagctgcttgagaagtgggaggaattggtaaatgggggaatagagcaaattttgattttgggagcaaaattggcccg

SEQ ID NO: 19622 - protein, 184 aa, Zea mays
  misc_feature: Ceres CLONE 1387193-F
  misc_feature: SWISSPROT Homolog: EC 4.1.1.20 Diaminopimelate decarboxylase
  misc_feature (84)..(84): Xaa is any aa, unknown, or other
MASASMLARSLLRTPDPTQTSHPNRRSAAVVSFPRRHRRLSVRASVSTASPSPPPQPAAAAAGVPKHCFRRGADGYLYCEGVRXQHAMTGAERSPFYLYSKPQILRNFAAYRDALQGLRSIIGYAVKGNNNLPVLRVLRELGCGARPRQRQPSSDSPSRRDSTPPGCILTGKWGRHSKHLKLAA

SEQ ID NO: 19623 - DNA, 711 bp, Zea mays
  misc_feature: Ceres CLONE 1387199-F
  misc_feature: Encodes the peptide sequence at SEQ ID NO. 19624
  misc_feature (711)..(711): n is a, c, t, g, unknown, or other
tggagctccccgcggtggcggccgctctagaactagtggatcccccgggctgcaggaattcgcacgagaccattacctagaacatcctaatcaaaaagacacacctcccaaaccctacactcccggcggcggcggcggcggcgcagcagcggcagcagcatccgaagatggtgaagttcctcaagcccggcaaggccgttatcctcctccagggccgcttcgccggcaggaaggcagttatcgtgcgcgtgttcgaggagggcacccgcgaccgcccctatggccactgcctcgtcgcaggcctcgccaagtacccaaagaaggtgatccgcaaggactccgccaagaagactgcgaagaagtcgcgcgtcaagtgcttcatcaagctcgtcaacttcactcacctcatgcccacccgctacaccctcgacgtcgatttcaaggatgtcgccaccggtgggcccgacgcactctctacccacgacaagaaggtcgccgcctgcaagacggccaaagcgcgcctttgaggagaggttcaagaccggcaagaacaggtggttctttaccaagctccgcttctagatgctcggcctccccgaaagcctgctttagctggccgaatttgtgtatccgaccactccatctctggtttcgattacatgggaaaattttcgtggtaagtcctgcggctcccaaagataattgtagaan

SEQ ID NO: 19624 - protein, 119 aa, Zea mays
  misc_feature: Ceres CLONE 1387199-F
  misc_feature (52)..(119): Pfam Name: Ribosomal_L27e Pfam Description: Ribosomal L27e protein family
  misc_feature (7)..(40): Pfam Name: KOW Pfam Description: KOW motif
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVATGGPDALSTHDKKVAACKTAKARL

SEQ ID NO: 19625 - DNA, 728 bp, Zea mays
  misc_feature: Ceres CLONE 1387202-F
  misc_feature: Encodes the peptide sequence at SEQ ID NO. 19626
  misc_feature (652)..(652): n is a, c, t, g, unknown, or other
ggagctccccgcggtggcggccgctctagaactagtggatcccccgggctgcaggaattcgcacgagaccattacctagaacatcctaatcgaaaaattgagtctaagacgtcgtctgcgtttggtaccaaaatatttgtgtgttaattcgctcccttcaaaactcaaaatgaagttccagtacaaggaagagcacgcgtttgagaagaggaagagcgagggcgagaagatcaggaggaaataccccgacagagtgcctgtcattgtagagaaggcacctaaagcaaggattggggatcttgacaagaagaaatatttagtgccgtctgacttgactgttggtcagttctacttcttgatccgcaagcgtatccatcttcgacctgaggatgcccttttcttcctcgtaaacagtgtagttccacccagcagtgccaccatgggttcactctatcaggagcaccatgaagaggactttttcttgtacattgcttacagtgatgagaatgtttatggaaaattataacttaaacacctaaactacagccaggaatttcgaagcagaatcaacaaaatgaaaaaatcaacaaaaagcttaaaacctacttagaaaccttacaaaaaaaaattaaaaaccctctgaggcatctgnctttttagaatggatcttattttaattgtagaggttttatcttcactcttttgacttgaaccagtggtttggtttc

SEQ ID NO: 19626 - protein, 118 aa, Zea mays; identical to SEQ ID NO: 12523
  misc_feature: Ceres CLONE 1387202-F
  misc_feature (13)..(116): Pfam Name: MAP1_LC3 Pfam Description: Microtubule associated protein 1A/1B, light chain 3

SEQ ID NO: 19627 - DNA, 737 bp, Zea mays
  misc_feature: Ceres CLONE 1387204-F
  misc_feature: Encodes the peptide sequence at SEQ ID NO. 19628
  misc_feature (663)..(663): n is a, c, t, g, unknown, or other
  misc_feature (716)..(716): n is a, c, t, g, unknown, or other
  misc_feature (733)..(733): n is a, c, t, g, unknown, or other
caaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacagggcccccgtgaaaggcgaagcaggcgcttctactcgagggacctcgctcgcaacctgcgcttcgcctccaacttcgacctcttcaaggctgctggcggccgactggcgcgacactcctttcctgcgaaggtggctccgaaccgccgnccgcggggaggagctgccggagccactcaggaaacgtgatgctggagtaccgncgcggcggtgaaaaaanctgg

SEQ ID NO: 19628 - protein, 192 aa, Zea mays
  misc_feature: Ceres CLONE 1387204-F
  misc_feature: SWISSPROT Homolog: EC 1.14.11.20 Desacetoxyvindoline 4-hydroxylase
  misc_feature (172)..(172): Xaa is any aa, unknown, or other
  misc_feature (190)..(190): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNRAPVKGEAGASTRGTSLATCASPPTSTSSRLLAADWRDTPFLRRWLRTAXRGEELPEPLRKRDAGVPXRR

SEQ ID NO: 19629 - DNA, 752 bp, Zea mays
  misc_feature: Ceres CLONE 1387208-F
  misc_feature: Translation starting site: 219
  misc_feature (387)..(387): n is a, c, t, g, unknown, or other
  misc_feature (458)..(458): n is a, c, t, g, unknown, or other
  misc_feature (485)..(485): n is a, c, t, g, unknown, or other
aaagctggagctccccgcggtggcggccgctctagaactagtggatcccccgggctgcaggaattcgcacgagaccattacctagaacatcctaatcgaaaactaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagacattggggggaggtgatgatgctttcacaccttctcagtgagactggntgctggagcacgtgccccgggctggtttttgttgaccttgacccactgtcatcgatgaggtgagaactggnacctacgggcagctcttcaacctgagnagctcatcagggggaaggaggatgccagccacacttttgccggtggtcactacaccatggcaagggagatgggtgaccggggccttgatcgcaatcggaaagtttgcggacattggcaggggtcccaaggggttcctcggtttaaaggggtggggggggggggaaacgggcttggggccttggctccctcctccaaagggggctgggtttgggggatctaggcaaaaaaacccagggtggggggcccctgggggcccctcccccccc

SEQ ID NO: 19630 - DNA, 707 bp, Zea mays
  misc_feature: Ceres CLONE 1387209-F
  misc_feature: Encodes the peptide sequence at SEQ ID NO. 19631
  misc_feature (512)..(512): n is a, c, t, g, unknown, or other
  misc_feature (534)..(534): n is a, c, t, g, unknown, or other
  misc_feature (632)..(632): n is a, c, t, g, unknown, or other
aagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccgtcacagngcccccgggaaggggggaaaancaagcctttttacctcgagggaacctcgctcgcaacctggcgcttcgcctccaactttcgactcttcagggctgctggcggccgactggcgcacagcncttttttggggaagttggctccgacccgccccccgcgggaaggagctgcccgagcactcaggaacgtgatggtgg

SEQ ID NO: 19631 - protein, 184 aa, Zea mays
  misc_feature: Ceres CLONE 1387209-F
  misc_feature: SWISSPROT Homolog: EC 1.14.11.20 Desacetoxyvindoline 4-hydroxylase
  misc_feature (122)..(122): Xaa is any aa, unknown, or other
  misc_feature (130)..(130): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRRHXAPGKGGKXSLFTSREPRSQPGASPPTFDSSGLLAADWRTALFWGSWLRPAPRGKELPEHSGT

SEQ ID NO: 19632 - DNA, 608 bp, Zea mays
  misc_feature: Ceres CLONE 1387211-F
  misc_feature: Encodes the peptide sequence at SEQ ID NO. 19633
  misc_feature (323)..(323): n is a, c, t, g, unknown, or other
  misc_feature (364)..(364): n is a, c, t, g, unknown, or other
aagctggagctccccgcggtggcggccgctctagaactagtggatcccccgggctgcaggaattcgcacgagaccattacctagaacatcctaatcgaaaactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacataaagggtctcgccgcggtgccgncgaagcctggcgctgagtttcctaatgcgcccgctggtacnaaaacgcttctggggttgtacctcaaggaatccctggaagcttggtgggggaaatctggcggggggaatcagttccgggggaaatttgcccccggggattgaggtttaagaacaaaaaaaacccttgaatctctttttgggaggggaaaccgggggggggcacaaaaaaaggccctctttttagggggggggccccccccccttttcaaaaaaaaccccccctttttttaaaaaaaagaaaaga

SEQ ID NO: 19633 - protein, 90 aa, Zea mays
  misc_feature: Ceres CLONE 1387211-F
  misc_feature (44)..(44): Xaa is any aa, unknown, or other
MAVFSDLHTADGLKSLEAHLAGKTYVSGDSITKDDIKGLAAVPXKPGAEFPNAPAGTKTLLGLYLKESLEAWWGKSGGGNQFRGKFAPGD

SEQ ID NO: 19634 - DNA, 755 bp, Zea mays
  misc_feature: Ceres CLONE 1387213-F
  misc_feature: Translation starting site: 167
  misc_feature: Pfam Name: KNOX2 Pfam Description: KNOX2 domain
  misc_feature: Pfam Name: Homeobox Pfam Description: Homeobox domain
  misc_feature: Pfam Name: KNOX1 Pfam Description: KNOX1 domain
  misc_feature (397)..(397): n is a, c, t, g, unknown, or other
  misc_feature (716)..(716): n is a, c, t, g, unknown, or other
aaagctggagctccccgcggtggcggccgctctagaactagtggatcccccgggctgcaggaattcgcacgagaccattacctagaacatcctaatcgaaaacgccgcctacctcgactgccagaaagtgggcgcgccgccggacgtgctggagaggctgacggccatggcggcaaagctggacgcgcgcccgccgggccgccacgagccgcgcgacccggagctggaccagttcatggaggcgtactgtaacatgctcgtcaagtaccgggaggagctcacccggccgatcgacgaggccatggagttcctcaagcgggtggaggcgcagctcgactgcatctccggcggcggcggctcctcctcagcgcgcctctcgctcgccgatggtaaatcnagaaggtgttggctcttctgaagatgacatggacccgaatggtcgcgagaacgatccggccggagattgacccacgagcggaggacaaggagctcaagtaccagtgggctgaaagaagtacagtggctacctgagcagcttcagggcaggagttttcccaagaagaagaaagaaagggaagctcccaaaggaggccaggcagaactcctcccactgggtgggagctgcactaacagtggccgtacccttcaaagaaacgggagaagattgcgctcgcggaatcaacgggcctagacccagagcagaatcaacaactggntcatcaacccagaggaaccggcactggaaaagccatcgg

SEQ ID NO: 19635 - DNA, 675 bp, Zea mays
  misc_feature: Ceres CLONE 1387215-F
  misc_feature: Encodes the peptide sequence at SEQ ID NO. 19636
  misc_feature (150)..(150): n is a, c, t, g, unknown, or other
  misc_feature (153)..(153): n is a, c, t, g, unknown, or other
  misc_feature (160)..(160): n is a, c, t, g, unknown, or other
  misc_feature (372)..(372): n is a, c, t, g, unknown, or other
  misc_feature (424)..(424): n is a, c, t, g, unknown, or other
tggagctccccgcggtggcggccgctctagaactagtggatcccccgggctgcaggaattcgcacgagaccattacctagaacatcctaatcgaaaaaattagccagcccacctctgctctgcgggcgcttcagatggaagcactaagcnccnatttggngaattccgcgcctcgccgtccgggcgcaaggtactcccaactccgccgccccggaaccctcgccgtcaccaccacagccacagttgcatgccgccccctcacggcgccctccatggacgccgccgttggccgcccgagccgcgcgcctatccgctgcaccagcgcggagacggactcggtggatgaggtcgcgacgagctcgcacgccgcgnaggccaacgcggggggcaccacggagcaagagggcaacgggagccccgtggnccgcgctgccgcgtactcccccgtggtcgccggcgtcgacgggaataggatcccggcggcggccggtgacgggggcccgcggtgcaactaccgtggggcccgttcccagattccgcctccgaaaaacgaaggggaacaacgcccgcgggaaaattcccttcaaaaaaatccctttggaaacaaggggaccgtccagagttttcccccaaaatttgaaggggaaaaggggggccccctgggaattatggtgt

SEQ ID NO: 19636 - protein, 134 aa, Zea mays
  misc_feature: Ceres CLONE 1387215-F
  misc_feature (34)..(34): Xaa is any aa, unknown, or other
  misc_feature (51)..(51): Xaa is any aa, unknown, or other
MDAAVGRPSRAPIRCTSAETDSVDEVATSSHAAXANAGGTTEQEGNGSPVXRAAAYSPVVAGVDGNRIPAAAGDGGPRCNYRGARSQIPPPKNEGEQRPRENSLQKNPFGNKGTVQSFPPKFEGEKGGPLGIMV

SEQ ID NO: 19637 - DNA, 715 bp, Zea mays
  misc_feature: Ceres CLONE 1387217-F
  misc_feature: Encodes the peptide sequence at SEQ ID NO. 19638
  misc_feature (387)..(387): n is a, c, t, g, unknown, or other
  misc_feature (388)..(388): n is a, c, t, g, unknown, or other
  misc_feature (495)..(495): n is a, c, t, g, unknown, or other
aaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctatagggctccacaagcaatcgcagcaagcaacatacctttatcacccttgnntgttcacaaatcgcagccctatcttttgtgcagtcattggtacaaaccatccaggcacagcagctgcagcaactcgtgctacctgtgatcaaccaagtagctctggnaaccttttctccctactctcagaacaacaatttctttcactccaaccaactggctaacctggaaccttggtgctttatttggggaaacaactttaccattcagccggtttgttctggctaatctcaaaaaaaaaaatttttcccttttaacaaatggccgactggaaccccctgtgtttttttgggcgcaaaaaaccaaaaccttttacgcggtgggggg

SEQ ID NO: 19638 - protein, 101 aa, Zea mays
  misc_feature: Ceres CLONE 1387217-F
  misc_feature (73)..(73): Xaa is any aa, unknown, or other
MATKIFSLLMLLALSACVANATIFPQCSQAPIASLLPPYLPSMIASVCENPALQPYRAPQAIAASNIPLSPLXVHKSQPYLLCSHWYKPSRHSSCSNSCYL

SEQ ID NO: 19639 - DNA, 759 bp, Zea mays
  misc_feature: Ceres CLONE 1387218-F
  misc_feature: Encodes the peptide sequence at SEQ ID NO. 19640
  misc_feature (593)..(593): n is a, c, t, g, unknown, or other
  misc_feature (691)..(691): n is a, c, t, g, unknown, or other
  misc_feature (692)..(692): n is a, c, t, g, unknown, or other
aagctggagctccccgcggtggcggccgctctagaactagtggatcccccgggctgcaggaattcgcacgagaccattacctagaacatcctaatcgaaaactctgtctctctagggtttttgattttagccgccgccgctgctcatctcacatccctcgagaagacgcctgctactcgccgatcgatacgatggccgtcttctccgacctccacaccgccgacggcctcaagtccctcgaggctcacctcgccggcaaaacctatgtgtctggtgacgccattagtaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgccgctgccaaggcctcttctaaaaagaaagaaagtggtaaatcctccgtcccnttatggatgtcaaaccatggggacgatgagactgatatgaagaagctggggaggaggcttgtccgcagtgccccagatggaaagggtcctgacttggnngagcatcaaagccttgtggcctgtttggatacggcaatcaagaagatgactatcatgttgaccaatt

SEQ ID NO: 19640 - protein, 189 aa, Zea mays
  misc_feature: Ceres CLONE 1387218-F
  misc_feature (167)..(167): Xaa is any aa, unknown, or other
MAVFSDLHTADGLKSLEAHLAGKTYVSGDAISKDDIKVFAAVPSKPGAEFPNAARWYETVSAAVASRFPGKAVGVNLPAGSAPAAAAPADEAEDDDDLDLFGDETEEDKKAADERAAAAKASSKKKESGKSSVPLWMSNHGDDETDMKKLGRRLVRSAPDGKGPDLXEHQSLVACLDTAIKKMTIMLTN

SEQ ID NO: 19641 - DNA, 739 bp, Zea mays
  misc_feature: Ceres CLONE 1387219-F
  misc_feature: Encodes the peptide sequence at SEQ ID NO. 19642
  misc_feature (415)..(415): n is a, c, t, g, unknown, or other
  misc_feature (535)..(535): n is a, c, t, g, unknown, or other
  misc_feature (573)..(573): n is a, c, t, g, unknown, or other
  misc_feature (574)..(574): n is a, c, t, g, unknown, or other
  misc_feature (590)..(590): n is a, c, t, g, unknown, or other
tccccgcggtggcggccgctctagaactagtggatcccccgggctgcaggaattcgcacgagaccattacctagaacatcctaatcgaaaaaaattgtgcgagtacttgggaaggcaccaacaatagcagctgctgcctacttgagattagcaggaagacctcccgtccttcctttaaatactctatcttattcagagaacttcttgtacatgctggactctttgggtgacagaacatataaaccaaatcctcgacttgctcgagctctagatattctttttattctgcatgctgaacatgaaatgaactgctccactgctgctgttaggcaccttgcttcaagtggtgtggatgtatttactgctctttctggtggtgttggagctctatatggtcctctgcatggcggcgcanacgaggcagtacttaaaatgttaaatgagattggaagcatgggaaatattccagatttcattgtaggagtgaagaacaggaagaggaagatgtcccggttttgggcaccgtgtgtataanaactatgaccctcgtgctaaagtcataagggaatgggnnggatgagtggtctcanttggttggagggatcaaccttattgaggtgggcattgccctagaaaggggagcgctggccgacgaatatttatcaggagggagctgatcccaaatgtgggattccaactctgggcttatttataggggcagtgggatcccctacgaatt

SEQ ID NO: 19642 - protein, 107 aa, Zea mays
  misc_feature: Ceres CLONE 1387219-F
  misc_feature: SWISSPROT Homolog: EC 2.3.3.1 Citrate (Si)-synthase
  misc_feature (69)..(69): Xaa is any aa, unknown, or other
MLDSLGDRTYKPNPRLARALDILFILHAEHEMNCSTAAVRHLASSGVDVFTALSGGVGALYGPLHGGAXEAVLKMLNEIGSMGNIPDFIVGVKNRKRKMSRFWAPCV

SEQ ID NO: 19643 - DNA, 762 bp, Zea mays
  misc_feature: Ceres CLONE 1387220-F
  misc_feature: Encodes the peptide sequence at SEQ ID NO. 19644
  misc_feature (762)..(762): n is a, c, t, g, unknown, or other
aagctggagctccccgcggtggcggccgctctagaactagtggatcccccgggctgcaggaattcgcacgagaccattacctagaacatcctaatcgaaaagcaccggcaccagcacggcgaccaaccctctcccaacccgactagtcggactcgcagctccgccccaagtccaggtcgaagcatggaagtcgcggcggcgtcggcgaggcccgtcctgcgcgtggctgccatctgcggctccctccgcaaggcctccttcaaccgcggactcctccgcgccgccgcggaggtgtgcgaggactccatcgcggggctccgcatcgacgagctcgacatctccgacctgcccatcatcaacaccgacctcgagaccggcagcggtagcagaaccggtcttcctgcccgccggcaaggcctttccgcgccaagttctgccagggctgactgcttccttcttcgggggggcccgagtacaataacttcaatcgccaccccgggtgaagaaacgcactttgaactgggcctctaaaaggaaagaaactggtgggccaaaaaaaccctggttggaatacgggaggggaggggggggggcttttgggcgggggggagggccccagtacccttctcccgacagggtggggggttttcccggggctccccctttccttataaaaggccacaaagtgggggggtccaaagcctttcccaaaaccccccccaatgttgggcgcgggggggaaatcctgggccaagggcttan

SEQ ID NO: 19644 - protein, 115 aa, Zea mays
  misc_feature: Ceres CLONE 1387220-F
  misc_feature: SWISSPROT Homolog: EC 1.6.5.2 NAD(P)H dehydrogenase (quinone)
MEVAAASARPVLRVAAICGSLRKASFNRGLLRAAAEVCEDSIAGLRIDELDISDLPIINTDLETGSGSRTGLPARRQGLSAPSSARADCFLLRGGPSTITSIATPGEETHFELGL

SEQ ID NO: 19645 - DNA, 755 bp, Zea mays
  misc_feature: Ceres CLONE 1387221-F
  misc_feature: Encodes the peptide sequence at SEQ ID NO. 19646
  misc_feature (305)..(305): n is a, c, t, g, unknown, or other
  misc_feature (393)..(393): n is a, c, t, g, unknown, or other
  misc_feature (405)..(405): n is a, c, t, g, unknown, or other
  misc_feature (406)..(406): n is a, c, t, g, unknown, or other
  misc_feature (447)..(447): n is a, c, t, g, unknown, or other
  misc_feature (461)..(461): n is a, c, t, g, unknown, or other
  misc_feature (462)..(462): n is a, c, t, g, unknown, or other
  misc_feature (489)..(489): n is a, c, t, g, unknown, or other
  misc_feature (496)..(496): n is a, c, t, g, unknown, or other
  misc_feature (516)..(516): n is a, c, t, g, unknown, or other
  misc_feature (559)..(559): n is a, c, t, g, unknown, or other
  misc_feature (634)..(634): n is a, c, t, g, unknown, or other
  misc_feature (694)..(694): n is a, c, t, g, unknown, or other
  misc_feature (725)..(725): n is a, c, t, g, unknown, or other
  misc_feature (740)..(740): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagngacggagtggtcgaacgggaccgcaaggagggacctgcggtggtgcaagcaggcgtgcgagtggcagtacggaaaggacaccccgcgnaagagggaagcnnagagcgagtgccgcgagcggcaccagcaagctgacgcgggncgaggacggcgacnnagcggcgtgggacgcctacgtctccgncttcggnagggggggggaagtggccgncgcccagtgcctgcgcccgccacgagggccaggccgtgggagnacccaggagtggcatgagggcggtgccgccgcccgcggactggccgtcgacatggaagcaagagtacggtcgcgncagcgagagcgcgggcaagtgcccgggagaggtgcgagcgccaccaccgccgggactggntgggagaggcagcgctgcctgatggatgcanaaacccgggaggggnaaagaagaaggcgca

SEQ ID NO: 19646 - protein, 180 aa, Zea mays
  misc_feature: Ceres CLONE 1387221-F
  misc_feature (31)..(31): Xaa is any aa, unknown, or other
  misc_feature (60)..(60): Xaa is any aa, unknown, or other
  misc_feature (64)..(64): Xaa is any aa, unknown, or other
  misc_feature (78)..(78): Xaa is any aa, unknown, or other
  misc_feature (83)..(83): Xaa is any aa, unknown, or other
  misc_feature (92)..(92): Xaa is any aa, unknown, or other
  misc_feature (101)..(101): Xaa is any aa, unknown, or other
  misc_feature (115)..(115): Xaa is any aa, unknown, or other
  misc_feature (171)..(171): Xaa is any aa, unknown, or other
  misc_feature (176)..(176): Xaa is any aa, unknown, or other
MGKGSVGASWWAFLLLAGVLLVVAATAGAEXRSGRTGPQGGTCGGASRRASGSTERTPRXRGKXRASAASGTSKLTRXEDGDXAAWDAYVSXFGRGGEVAXAQCLRPPRGPGRGXTQEWHEGGAAARGLAVDMEARVRSRQRERGQVPGRGASATTAGTGWERQRCLMDAXTREGXRRRR

SEQ ID NO: 19647 - DNA, 734 bp, Zea mays
  misc_feature: Ceres CLONE 1387222-F
  misc_feature: Encodes the peptide sequence at SEQ ID NO. 19648
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (490)..(490): n is a, c, t, g, unknown, or other
  misc_feature (493)..(493): n is a, c, t, g, unknown, or other
  misc_feature (495)..(495): n is a, c, t, g, unknown, or other
  misc_feature (497)..(497): n is a, c, t, g, unknown, or other
  misc_feature (498)..(498): n is a, c, t, g, unknown, or other
  misc_feature (620)..(620): n is a, c, t, g, unknown, or other
  misc_feature (716)..(716): n is a, c, t, g, unknown, or other
aagctggagctccccgcggtggcggccgctctagaactagtggatcccccgggctgcaggaattcgcacgagaccattacctagagcatcctaatcgaaaactcacacaaccaagctcgatcgatctcactctcagctggtcgctcactcttgcagctccacccttcactcagtcttaggctcttagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgaggctgctgctcctgctgatcccgaggagcttcccgcggccgagcagcaggcagccgccgagcccgaggccgctgctcctgctgggcgaggaaaacccggcgcgcnnnccnatncngnncgcgaggctgaagctgctgctcctgctggtcccgaggagactcccgcggccgagcaggaggcagccgccgaggaagaggctgctgctgctcctcctgctggagccgaggaacccgccgcgcnccgagccggtcgcccaggcagagggtgctgcacccgaagaggtcggcggcggacgagccggatttcctggacctgctggtccccagaaccggccgncaaagtggagaatgttaa

SEQ ID NO: 19648 - protein, 161 aa, Zea mays
  misc_feature: Ceres CLONE 1387222-F
  misc_feature (79)..(79): Xaa is any aa, unknown, or other
  misc_feature (80)..(80): Xaa is any aa, unknown, or other
  misc_feature (81)..(81): Xaa is any aa, unknown, or other
  misc_feature (82)..(82): Xaa is any aa, unknown, or other
  misc_feature (83)..(83): Xaa is any aa, unknown, or other
  misc_feature (124)..(124): Xaa is any aa, unknown, or other
  misc_feature (156)..(156): Xaa is any aa, unknown, or other
MATAEVQTPTVVAAEEAPVVETPPPAVVPEESAPAEAEAEAEAEAAAPADPEELPAAEQQAAAEPEAAAPAGRGKPGAXXXXXREAEAAAPAGPEETPAAEQEAAAEEEAAAAPPAGAEEPAAXRAGRPGRGCCTRRGRRRTSRISWTCWSPEPAXKVENV

SEQ ID NO: 19649 - DNA, 777 bp, Zea mays
  misc_feature: Ceres CLONE 1387224-F
aagctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaagggataggatagggagagatgaagcaatcaatttcttcgtcccgcttcgcccctggtttacgtccccggtactaaccctaagaacattctggcttttcccggttccttaacccaactcttcttcggtttatggcaaacaagtaaggagggttgaaccccctccaaaagtttccccaacaaaaataagggaaaaaagaaaactggtcccagttaaattgggggggaaaaataaatccccgggccccggggttatattccgtaaaaaaaaaaggggcggcgaaaaaagaaaaaattttttggttgattgtggaaaaaaaataattatacctctcaaaaaaaggggggaacccccccccccaaaaacgtggggggggatttccccccccccctggttgtcccccaaagctggggggtgtttctgtggggaaaaccccttccctaaaaaaaacccgccgggggaattctcttccccctcctccaacgagggg

SEQ ID NO: 19650 - DNA, 696 bp, Zea mays
  misc_feature: Ceres CLONE 1387227-F
  misc_feature: Encodes the peptide sequence at SEQ ID NO. 19651
  misc_feature (445)..(445): n is a, c, t, g, unknown, or other
  misc_feature (451)..(451): n is a, c, t, g, unknown, or other
  misc_feature (470)..(470): n is a, c, t, g, unknown, or other
  misc_feature (473)..(473): n is a, c, t, g, unknown, or other
  misc_feature (505)..(505): n is a, c, t, g, unknown, or other
  misc_feature (513)..(513): n is a, c, t, g, unknown, or other
  misc_feature (519)..(519): n is a, c, t, g, unknown, or other
gctctagaactagtggatcccccgggctgcaggaattcgcacgagaccattacctataacatcctaatcaaaaaagggccggacactacactaccatttttcctttcgcagcgtcccgtctgtctgtctgtctgcctccctccgctcacctcctctgcttcttctcgctttcttccatcttggtccagcctccactcttcctgctgagccatggcggctgccgaagaagggccagagccactcaggtatcagactctggccctgagggtgagcatccactgcgagggttgcaagaagaaggtgaagaaggtgctccacagcatagaaggggtgtacaagacggacatagacacgcagcagcagaaggtggtggtcataggcaacgtctctgcagacgcgctcgtcaagaagctcccctcagtcgggaagcacgcgaagccgtggncgtagnctgctccagccccaccggncgncgacagcccgcccgggccccgacgatctcccngcagcgcnagcaangagaaagaaaaaaaagaaggggcaacagagccccggaggggggaaacaacaagcccgccgaatcgggggcaggggcccgggcccgggccgggggaggggaaaggggggaaccaaccccccggagacaaacaaaaagggtgaaggggggggccccgggggaaaagggatccgatgggg

SEQ ID NO: 19651 - protein, 78 aa, Zea mays
  misc_feature: Ceres CLONE 1387227-F
  misc_feature (17)..(77): Pfam Name: HMA Pfam Description: Heavy-metal-associated domain
MAAAEEGPEPLRYQTLALRVSIHCEGCKKKVKKVLHSIEGVYKTDIDTQQQKVVVIGNVSADALVKKLPSVGKHAKPW

SEQ ID NO: 19652 - DNA, 758 bp, Zea mays
  misc_feature: Ceres CLONE 1387232-F
  misc_feature: Encodes the peptide sequence at SEQ ID NO. 19653
  misc_feature (399)..(399): n is a, c, t, g, unknown, or other
  misc_feature (401)..(401): n is a, c, t, g, unknown, or other
ggagctcaccgcggtggcggccgctctagaactagtggatcccccgggctgcaggaattcgcacgagaccattacctagaacatcctaatcgaaaaaactactccggcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggagggcggcgccccgaatgggtgagccagggggaacggggatgcttcccacgacaagggggccgacgggcgtccgcagggggccttgaagaggggggccgcaaaacccctttggttatccccccccncncgtttggggggggggcggggcgaggcaggacggtcgcgggcagcggatgcgcgacagcttccgggggggcgggcggcgtccgcgggcgcctcgcgccggaggggcggcccgcaccttgtgggtctccggcggggaccgcggacagaaaaacggtgcgcggggtcgccgcccacgcagtgggagcctcacgcgccagggagcctaggggcaggacgtgtgcgtgggggacccgcgcagggacttgaccccggggacggtcgaggggctacgccggaccggttgttggagggcgggagtacaacgggcccgacacatcccggagagggcagccccgcggcggggtaaagatagactggg

SEQ ID NO: 19653 - protein, 148 aa, Zea mays
  misc_feature: Ceres CLONE 1387232-F
  misc_feature (67)..(67): Xaa is any aa, unknown, or other
  misc_feature (68)..(68): Xaa is any aa, unknown, or other
MADRDRSGIYGGAHATYGQQQQQGGGRRPEWVSQGERGCFPRQGGRRASAGGLEEGGRKTPLVIPPXXFGGGAGRGRTVAGSGCATASGGAGGVRGRLAPEGRPAPCGSPAGTADRKTVRGVAAHAVGASRAREPRGRTCAWGTRAGT

SEQ ID NO: 19654 - DNA, 723 bp, Zea mays
  misc_feature: Ceres CLONE 1387234-F
  misc_feature: Encodes the peptide sequence at SEQ ID NO. 19655
  misc_feature (695)..(695): n is a, c, t, g, unknown, or other
aaagctggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactcctcctcctcctcctcctcctcgccggcggcggcgccgctgtcctccatcggccgctccatccgctcgctccgccgtgaccagaaccagatccactccttcccgccgccgccagacgccacagacgccttccagcgccgcgccgcccaactcctggccgacctcccggcagccgacgacgtcctctccctcgcctggacgcgccgcctcctcgaatccttcctcctctgcctcgaggagttccgcgccctgctcttcggctccggggactcgcccgctgctcggcccccgctcgaccgcctcgtcgccgacttctccgaccgcgccgtcaaggcgctcgacctctgcaacgccgtccgcgacggcctcgacctcgtccgccagtggcgcaagcacctcgncatcgccgcagccgtcctcgcctcgtcc

SEQ ID NO: 19655 - protein, 148 aa, Zea mays
  misc_feature: Ceres CLONE 1387234-F
  misc_feature (1)..(148): Pfam Name: DUF793 Pfam Description: Protein of unknown function (DUF793)
  misc_feature (139)..(139): Xaa is any aa, unknown, or other
MPATDSSSSSSSSPAAAPLSSIGRSIRSLRRDQNQIHSFPPPPDATDAFQRRAAQLLADLPAADDVLSLAWTRRLLESFLLCLEEFRALLFGSGDSPAARPPLDRLVADFSDRAVKALDLCNAVRDGLDLVRQWRKHLXIAAAVLASS

SEQ ID NO: 19656 - DNA, 720 bp, Zea mays
  misc_feature: Ceres CLONE 1387238-F
  misc_feature: Encodes the peptide sequence at SEQ ID NO. 19657
  misc_feature (457)..(457): n is a, c, t, g, unknown, or other
  misc_feature (458)..(458): n is a, c, t, g, unknown, or other
  misc_feature (460)..(460): n is a, c, t, g, unknown, or other
  misc_feature (461)..(461): n is a, c, t, g, unknown, or other
  misc_feature (464)..(464): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (472)..(472): n is a, c, t, g, unknown, or other
  misc_feature (475)..(475): n is a, c, t, g, unknown, or other
ggagctccccgcggtggcggccgctctagaactagtggatcccccgggctgcaggaattcgcacgagaccattacctagaacatcctaatcgaaaaacacaagcaaagcagcagcaacagccaacacctaaactaaagaacactagtccctgtgtacgtctagcaacgatccgcaccgagctcgccagttttgctcgttagtttggggacggcgatggcgtccggtcaggaaagcagggaggagctggcgcgcatggccgaggaggggcagaccgtcgtccccggcggcaccggcggcaagaccctcgaggcgcaggagcacctcgccgaagggcgcagccacggcgggcagacccggagtgagcagctaggccatgaggggtacagcgagatgggcagcaagggcgggcagacgcgcaaagagcagctgggccacgagggacaagcgaagatgggnnannaangcnnnccngancaccatgccaggaacccggcggcgaacgcccccccccggaaggcatccaagatcgacgaagcccaggtcacggaccaaggccaaaactgatgccggccccccctaacatggaaaacctaacttgcaaaaagggagggggccccgaaaaaagggagggtgggaaccctcctctcgggaacccccccgggaggggaaacataattgcgccgtaggacccggccgggttgtgtttaaaaaaggtcggg

SEQ ID NO: 19657 - protein, 116 aa, Zea mays
  misc_feature: Ceres CLONE 1387238-F
  misc_feature (1)..(93): Pfam Name: LEA_5 Pfam Description: Small hydrophilic plant seed protein
  misc_feature (82)..(82): Xaa is any aa, unknown, or other
  misc_feature (83)..(83): Xaa is any aa, unknown, or other
  misc_feature (84)..(84): Xaa is any aa, unknown, or other
  misc_feature (85)..(85): Xaa is any aa, unknown, or other
  misc_feature (87)..(87): Xaa is any aa, unknown, or other
MASGQESREELARMAEEGQTVVPGGTGGKTLEAQEHLAEGRSHGGQTRSEQLGHEGYSEMGSKGGQTRKEQLGHEGQAKMGXXXXPXHHARNPAANAPPRKASKIDEAQVTDQGQN

SEQ ID NO: 19658 - DNA, 692 bp, Zea mays
  misc_feature: Ceres CLONE 1387240-F
  misc_feature: Encodes the peptide sequence at SEQ ID NO. 19659
cgcggtggcggccgctctagaactagtggatcccccgggctgcaggaattcgcacgagaccattacctagaacatcctaatcgaaaaaacagcagcagaagcaaaagccgcaggccgcaactactccgatctgagtatcacagtcacagctaatagctagccagcagcccagcacccagcaactacccgtacgtacgaacgtgcgcttccgatggcgaccacggtgatggcctccgcgaacgcgagctcccccgccttctccgcccccggagcgcgcgacaggggcgccgcccggtttccggcggtgatccgcgggcgaggcgacgcggcgccgcgccgactcgcactgctcgccatggactcctgacaggccgatgactctgccgccaacacgagcgcgatggcattgtcggctgctcggagaatgaagctctgggacgcactggcaaccagaggtaccgcgccggagcgtagtcacgggcggcagattgtgaggtttttcatgcccgcgctcaacgtcgaagacaaccgcgacgatgacatcctctcccacgccagcaacggagcacggctcacgtgcctccggtaaacaggcggagatccggacgatgtgacactgagggaactgctccgcgggagagcacctagtggatgaaccgaccgaaaatgagcgacaactcccaggtcaggaa

SEQ ID NO: 19659 - protein, 51 aa, Zea mays
  misc_feature: Ceres CLONE 1387240-F
MATTVMASANASSPAFSAPGARDRGAARFPAVIRGRGDAAPRRLALLAMDS

SEQ ID NO: 19660 - DNA, 713 bp, Zea mays
  misc_feature: Ceres CLONE 1387245-F
  misc_feature: Encodes the peptide sequence at SEQ ID NO. 19661
  misc_feature (539)..(539): n is a, c, t, g, unknown, or other
  misc_feature (639)..(639): n is a, c, t, g, unknown, or other
tccccgcggtggcggccgctctagaactagtggatcccccgggctgcaggaattcgcacgagaccattacctagaacatcctaatcaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacgtacccgctaacttgctcgtgctttgatcgggttgagcgctgctccgacgcctgtaaggagtgcgtggaaacggaggactcgcgccacgtctgcgtcgacaggtaccgtggcgaccccgggccccagtgcacgacgnagacgggaggagcggcggacccgctgacgacgacgctggtgggcaggcgacgccaacggcagtgatgcaaaatgacagaaagcaggcggcggcgacgacnacaaaaaaaaagccgggggaaatgctggaacggcccatctgacccagtcctggccctccggtgggccctggcgg

SEQ ID NO: 19661 - protein, 142 aa, Zea mays
  misc_feature: Ceres CLONE 1387245-F
  misc_feature (122)..(122): Xaa is any aa, unknown, or other
MAMGAASILLMMVSLEALLLAAAAGGGTIRLPSDVGGVAADLVTAMARARARAKHQLRDEERPWGECCDLAVCVKTYPLTCSCFDRVERCSDACKECVETEDSRHVCVDRYRGDPGPQCTTXTGGAADPLTTTLVGRRRQRQ

SEQ ID NO: 19662 - DNA, 660 bp, Zea mays
  misc_feature: Ceres CLONE 1387246-F
  misc_feature: Encodes the peptide sequence at SEQ ID NO. 19663
aagctggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcttctcctccttcccccgggcgctcccgccgccgccgccctgggcgcgcatcacctcgccagcctccacctccggggccctacctacctctgagatcgaggagcggctcgccggggtgcccgtgtacgcgctcgccaacgccgcccaggagttcgtgcttgtgtcgtccacacgcgtgggagggcaagggggcgagagcgtgagtccaacgccggcgctcgggctgctctgcttccggaaggaagatgctgacgcgctgctggagcagatggatggcgatatgcgcgccggctctggtgtcgttcctgtcgcgctgaccaggttat

SEQ ID NO: 19663 - protein, 152 aa, Zea mays
  misc_feature: Ceres CLONE 1387246-F
MPFRFQFPWLKNPTTNGGTSNIDTNPSPRFPNPFLPIQAHVTSFFSSFPRALPPPPPWARITSPASTSGALPTSEIEERLAGVPVYALANAAQEFVLVSSTRVGGQGGESVSPTPALGLLCFRKEDADALLEQMDGDMRAGSGVVPVALTRL

SEQ ID NO: 19664 - DNA, 718 bp, Zea mays
  misc_feature: Ceres CLONE 1387255-F
  misc_feature: Encodes the peptide sequence at SEQ ID NO. 19665
tggagctccccgcggtggcggccgctctagaactagtggatcccccgggctgcaggaattcgcacgagaccattacctagaacatcctaatcgaaaagtctccaacccgactctgaaatccacgagctcttccccctcgtccacaccccgcccctccctgctctccgcctccccgtccccgcccccatcgctacccacaagcaccttcggaggctccaggcaacccacctcctgcacccggcgtccctcgcggcggcgacgcgcgaacgtcccgctccccggtgagtaacggagagacggagccatgagcggaggggtggagccggataccccgcccggtagcagcagcagcagcagcaggagcgggggcagcacgcccgtgggcggcaagccgccacgccaccacctcacgtccatccgccactgcgccagcagtgcccgcatcgccgctgcctccgccgaattcgtaagcaagctcgctgccacccaagccatctatccctaacacgaatttgatgtctgcccttctgttctcctgcaggggctggagtcggggacgctcagcttgatttcacctaccgcagacatccgtccgggcttcttgcctgtgttcaggtcggggagtttcgcggatattggacccaaatccttcatggaggacgagcatgtctgtgtggacaacctcgtcgagcaccttggactccgtggcccggcatcc

SEQ ID NO: 19665 - protein, 66 aa, Zea mays; identical to SEQ ID NO: 17379
  misc_feature: Ceres CLONE 1387255-F

SEQ ID NO: 19666 - DNA, 749 bp, Zea mays
  misc_feature: Ceres CLONE 1387258-F
  misc_feature: Encodes the peptide sequence at SEQ ID NO. 19667
  misc_feature (377)..(377): n is a, c, t, g, unknown, or other
  misc_feature (380)..(380): n is a, c, t, g, unknown, or other
  misc_feature (381)..(381): n is a, c, t, g, unknown, or other
  misc_feature (385)..(385): n is a, c, t, g, unknown, or other
  misc_feature (392)..(392): n is a, c, t, g, unknown, or other
  misc_feature (393)..(393): n is a, c, t, g, unknown, or other
cacccgcggtggcggccgctctagaactagtggatcccccgggctgcaggaattcgcacgagaccattacctagaacatcctaatcgaaaaatccagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgntgnngacnagcacgnngcgtctctgccggccaacttcaagaagatgctttccatcccagctccgtgggtccgcaaccaagggcaagctcgggaaggtcaaggtcttcgtaacaagctctcggacgccggcaagaagggatccccccaaaccaaggttaacccggaaaaggccccccgttgccaaaaacacccccccccaaaccgggcaaggccccccccccaaataaaaaaaaggaggggtttgcaaaccaaaaaaaggcccttggttggggaacaaaccaaaagggcccaaaaaaaaggtgggggaaaaacaaaaaaaacccccccccccagggcgggggccacccaaaaacgggaaaccccctgccccaa

SEQ ID NO: 19667 - protein, 188 aa, Zea mays
  misc_feature: Ceres CLONE 1387258-F
  misc_feature (35)..(91): Pfam Name: Linker_histone Pfam Description: linker histone H1 and H5 family
  misc_feature (65)..(65): Xaa is any aa, unknown, or other
  misc_feature (66)..(66): Xaa is any aa, unknown, or other
  misc_feature (68)..(68): Xaa is any aa, unknown, or other
  misc_feature (70)..(70): Xaa is any aa, unknown, or other
MPALAKPASRTAKPAAAPKPKPAAAKPKAATAGASHPPYFEMIKEAITALKERTGSSSQAIAKYXXDXHXASLPANFKKMLSIPAPWVRNQGQAREGQGLRNKLSDAGKKGSPQTKVNPEKAPRCQKHPPPNRARPPPQIKKRRGLQTKKRPLVGEQTKRAQKKGGGKTKKTPPPRAGATQKRETPCP

SEQ ID NO: 19668 - DNA, 635 bp, Zea mays
  misc_feature: Ceres CLONE 1387260-F
  misc_feature: Encodes the peptide sequence at SEQ ID NO. 19669
  misc_feature (354)..(354): n is a, c, t, g, unknown, or other
  misc_feature (439)..(439): n is a, c, t, g, unknown, or other
gctctagaactagtggatcccccgggctgcaggaattcgcacgagaccattacctagaacatcctaatcgaaaaacttctacctggcctcgcaggcttcgcaaggcggccacacgccgatacctcctccttcacccgctccgtcgtcccccccagccggccacgccaccatgctgccaccggccgcgcgccttgcggcccgccgcctcctcggcctcgcctccgcatctgcgtcggaagccgccggccgccgggtagcttcctctccgatcgcttccgcaggctactccgccgccgcgtccaggggctccgtctccagcaccaggcccttctccacggctcttaactaccaccnttgactcgcccggagaacaagcccggacatggaaatgggaggtctcacaggcgaatatggaagaaggggcaatgaggattctggnctcactattcaaggcaactaccagcaaatctgggaattattcccggctggcttgaactttgcaaaagaaacaaaaattggggggagggggggccccttttccccaaagggggggggatttttgcaaaaaagtgggcgaaagggggcccccaaaagggggggtaataaaaaagagggcccccccccttttaaaaaag

SEQ ID NO: 19669 - protein, 61 aa, Zea mays
  misc_feature: Ceres CLONE 1387260-F
MLPPAARLAARRLLGLASASASEAAGRRVASSPIASAGYSAAASRGSVSSTRPFSTALNYH

SEQ ID NO: 19670 - DNA, 716 bp, Zea mays
  misc_feature: Ceres CLONE 1387270-F
  misc_feature (699)..(699): n is a, c, t, g, unknown, or other
tccccgcggtggcggccgctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaaatcaaaataataaaaaaaataataaaaactagtactacgcaatccagctttctccttataaagaaatcaatggataaatttaaaaaaagcagagcatcaaaccaagaagaaaaactgatgtcacgaacttgacagttgacttttcgcgcaaacaaacaaacaaacactacgtactgtgctctgcttatggatacatacatgcatactagtagctcatatatgcgtacaagggccgccccgcaggcccaccttcgtgggcatctgggaagaagcgtggcggtggagcagtactccgccgatcccgtacgtggcgacgctgctgaactgcatggatggtgggtgctgtacgggnctgccgctggtgcaccc

SEQ ID NO: 19671 - DNA, 738 bp, Zea mays
  misc_feature: Ceres CLONE 1387274-F
  misc_feature: Encodes the peptide sequence at SEQ ID NO. 19672
  misc_feature (426)..(426): n is a, c, t, g, unknown, or other
aaactggagctccccgcggtggcggccgctctagaactagtggatcccccgggctgcaggaattcgcacgagaccattacctagaacatcctaatcgaaaaatcacactcgcgaaccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaaagtcaggtgaaggactccaaaaccctttctcttggtgagaaaagagtttgctgtgttggctgcnagaacccctgagagatccgtgggggtcgggtggtgctgattaatggtgtgaggctactggtggtttcactgaccagaagaaggctgagctcccttgaagggtggggcaagaaaggttggcttcccggtcctaaaaaggagccccaatgtttggccttgggtgcaaccaaaaggagaaaagttggaattaaaattggctccaagggtatgggaaaaacaagtgcgtgggccctttggaaaaggaaaaaagaaaaattcggaaccttggggggtggaaaaaccgtggcttggctctctgttcaccaaaaaatgg

SEQ ID NO: 19672 - protein, 84 aa, Zea mays
  misc_feature: Ceres CLONE 1387274-F
  misc_feature (4)..(85): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (82)..(82): Xaa is any aa, unknown, or other
MAKIKIGINGFGRIGRLVARVALQSDDVELVAVNDPFISTDYMTYMFKYDTVHGQWKHHESQVKDSKTLSLGEKRVCCVGCXNP

SEQ ID NO: 19673 - DNA, 683 bp, Zea mays
  misc_feature: Ceres CLONE 1387275-F
  misc_feature: Translation starting site: 198
  misc_feature: SWISSPROT Homolog: EC 5.3.1.1 Triose-phosphate isomerase
  misc_feature (410)..(410): n is a, c, t, g, unknown, or other
  misc_feature (466)..(466): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (535)..(535): n is a, c, t, g, unknown, or other
  misc_feature (540)..(540): n is a, c, t, g, unknown, or other
  misc_feature (544)..(544): n is a, c, t, g, unknown, or other
  misc_feature (565)..(565): n is a, c, t, g, unknown, or other
  misc_feature (633)..(633): n is a, c, t, g, unknown, or other
tggagctccccgcggtggcggccgctctagaactagtggatcccccgggctgcaggaattcgcacgagaccattacctagaacatcctaatcgaaaaacaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatggttgcggctcagaaactgctggggttaangaagggaggtgcttttcaccggtgaagtcagtgctgagatgctcgtccaccttggntgtcccctgggtcatttctggacactctgaaaggagagctctgctgggagaatcaatgaattnnngtgnagacnaggntgcgtatgccctgtctcaggnactaaaggtcattgcatgggtgtggtgagacacttgagcaaagggaggctgggtctaccatgggaggntgtgctgcacaaacaaagcattgctgagaagatcaggactggaggccact

SEQ ID NO: 19674 - DNA, 688 bp, Zea mays
  misc_feature: Ceres CLONE 1387277-F
  misc_feature: Encodes the peptide sequence at SEQ ID NO. 19675
  misc_feature (634)..(634): n is a, c, t, g, unknown, or other
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcgaaaaacacaaacaagaagcttgcattgttcgtttgctcgatcgttgcagataatggagaaccctgctccgagtatcgtagtgccccccattgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggccggcaggctcaagggctccacgctccttaccgaaggagtggtgacggatggatcagatgaatgggcaatctacggcgggaccggagagtttgctatgggcgagaggtgtcgtcaaaagaagtaccttgccggatagggatggcgccgggaacactgacgagctcagcatgcagtttcctgggcccggntgtttggctcatcacagcaaccaaacaagcagcattctgtcacccagaatgggn

SEQ ID NO: 19675 - protein, 143 aa, Zea mays
  misc_feature: Ceres CLONE 1387277-F
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGRLKGSTLLTEGVVTDGSDEWAIYGGTGEFAMGERCRQKKYLAG

SEQ ID NO: 19676 - DNA, 724 bp, Zea mays
  misc_feature: Ceres CLONE 1387279-F
  misc_feature: Encodes the peptide sequence at SEQ ID NO. 19677
tcaccgcgggtggcggccgctctagaactagtggatcccccgggctgcaggaattcgcacgagaccattacctagaacatcctaatcgaaaaccccatttcgaagcccaccgaattccctgcgattcctctcccctcgcctcctcgtctccccctagggttagcacctcgctgcctccgattcaatcataatatggtctcttctccctttgatctgtagatttggggctttggctccgcctcgcgcgcccgatccgggccgtcctccttttttcccctcttatatttgatcggtttctttgcgtcgttcacgcagggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcagcccgctgatgttgccggacccagcgagggggtggcggcgatctccaaagggggggaaggtagggccgaaccggtgcagcgcctgg

SEQ ID NO: 19677 - protein, 118 aa, Zea mays
  misc_feature: Ceres CLONE 1387279-F
  misc_feature (14)..(38): Pfam Name: zf-A20 Pfam Description: A20-like zinc finger
MEHKEAGCQAPEGPILCINNCGFFGSAATMNMCSKCHKEMITKQDQAKLAASSIDSIVNGSDAVMEPVVAGSNTVVAVAQVELQTMNVQQPADVAGPSEGVAAISKGGEGRAEPVQRL

SEQ ID NO: 19678 - DNA, 721 bp, Zea mays
  misc_feature: Ceres CLONE 1387280-F
  misc_feature: Encodes the peptide sequence at SEQ ID NO. 19679
tggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggatgcttccgcggggtcgcgtagaggaccccccccgggggggggggggaaagaaaaaacaggggtctcctactggggggaaccctcgctcgaaacctggcgcttccgccctccaacttcgaccttcttcaagggttgctggcggccgactgggcgcgacacgtctttttgggtggggaggggggcttccgaaccccgcccgcgcggcgggggagggaagctggccgggagccaacttcaggg

SEQ ID NO: 19679 - protein, 119 aa, Zea mays
  misc_feature: Ceres CLONE 1387280-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGCFRGVA

SEQ ID NO: 19680 - DNA, 682 bp, Zea mays
  misc_feature: Ceres CLONE 1387283-F
  misc_feature: Encodes the peptide sequence at SEQ ID NO. 19681
  misc_feature (493)..(493): n is a, c, t, g, unknown, or other
  misc_feature (574)..(574): n is a, c, t, g, unknown, or other
  misc_feature (617)..(617): n is a, c, t, g, unknown, or other
  misc_feature (632)..(632): n is a, c, t, g, unknown, or other
  misc_feature (662)..(662): n is a, c, t, g, unknown, or other
tggagctccccgcggtggcggccgctctagaactagtggatcccccgggctgcaggaattcgcacgagaccattacctagaacatcctaatcgaaaaatcatacctccgaggctccgaccaaaacaccagggtcccagtgctcttggctctaagatggcggcgccggaaccggaggccaagctggaagccgtaaccccatctcggtcccacgagctgccaccggagtccgaatccgacgcccctgcctccaccggcagccaggagctaaagccgtgggagcagcacgccgcggtgatcaacctcccgcgctacgactaccgcgcatcagggtccctcctcctccgttcgcattccggcttcctcatcacgtgccccatcaagcgtgaaaaaagtgcaaccaaggaagccattcccatccttgaagagtaccatgcaaattgctgtgtttctgaacatgcagaaccatgtgatgtgaaaaatgcaattaagaanagaaaactgtgctcggaggcatcaggaagtttagaagaggcagtaacgaatgggaatagtagcagtgtttcagaatcattnggaagcaccggaaacacaagctcaccccagtccaaggtgaatnggacatgtgacaggncttcaaatctctcactggttaagctatcangaagtggcttgctcttcttt

SEQ ID NO: 19681 - protein, 176 aa, Zea mays
  misc_feature: Ceres CLONE 1387283-F
  misc_feature (113)..(113): Xaa is any aa, unknown, or other
  misc_feature (140)..(140): Xaa is any aa, unknown, or other
  misc_feature (155)..(155): Xaa is any aa, unknown, or other
  misc_feature (160)..(160): Xaa is any aa, unknown, or other
  misc_feature (170)..(170): Xaa is any aa, unknown, or other
MAAPEPEAKLEAVTPSRSHELPPESESDAPASTGSQELKPWEQHAAVINLPRYDYRASGSLLLRSHSGFLITCPIKREKSATKEAIPILEEYHANCCVSEHAEPCDVKNAIKXRKLCSEASGSLEEAVTNGNSSSVSESXGSTGNTSSPQSKVNXTCDRXSNLSLVKLSXSGLLFF

SEQ ID NO: 19682 - DNA, 972 bp, Zea mays
  misc_feature: Ceres CLONE 1387296
  misc_feature: Encodes the peptide sequence at SEQ ID NO. 19683
ccagtctccaccgtccacgccgaccccgcctcctccaaacacggccacccactcacccgtgctccgtttaaaataggcatagcatagccatcccacgagcaccgcatgcacgcatgtagtttctgcagaagctagccaggcagacgagagagcgagtcaccgcgagaaggggatcgcggaaagtgagagcagaatcaacaatccacctgctcatcgagtcgatggagatgaaggttgctgcctcacggccaggatgcaagaaacgccccccgagccgtctccagaagcatgcgccagcgtcgctgcaactggagcaggctgtcgccagtgcggggacgggagcaccgcccgcggtgtggggtgacgggagggcgccgatcccgctcctgtcgccgctcgtcgtgtcgcccatggtgccggtctgggaggcggaccagacggggggcgccaggaaggagggaggaggggaccaggccgagggcaggagcggtgccgagcagcagcagcgcggcgccgccgctcggcatggcagcagtggggagcaccaggtgcacgacgtgacaccgaggccgtcggcgcccgcgctcggcatggggtggcggcacccagcgatgtcgacgcccgtggcggagccggcgtcccttgtgcccttattccagtcgcagtgcgcgttggaggtgcgcaactcgcagcagtgagggggaatcatttgctcaaccaagcagccatgcccatagtagtgcgctcgagctcgtgctcacgacaggcgccgctacgatgtgagaagacgatgacgctttcgtcctcgcaggctattctcgtcgtgatctatctttgaacaactagcattggttttgctgctcttcatcagtttatcgtaatatctttacaatgtggtcacagttctttgtgaatataatttaaacctatatggtttagcgatggctggatgttcgaaaaaaaaaaaaaaaa

SEQ ID NO: 19683 - protein, 158 aa, Zea mays
  misc_feature: Ceres CLONE 1387296
MEMKVAASRPGCKKRPPSRLQKHAPASLQLEQAVASAGTGAPPAVWGDGRAPIPLLSPLVVSPMVPVWEADQTGGARKEGGGDQAEGRSGAEQQQRGAAARHGSSGEHQVHDVTPRPSAPALGMGWRHPAMSTPVAEPASLVPLFQSQCALEVRNSQQ

SEQ ID NO: 19684 - DNA, 709 bp, Zea mays
  misc_feature: Ceres CLONE 1387297-F
  misc_feature: Encodes the peptide sequence at SEQ ID NO. 19685
ggagctccccgcggtggcggccgctctagaactagtggatcccccgggctgcaggaattcgcacgagaccattacctagaacatcctaatcgaaaaatcatgcacccaaaccctttcgatctgcgcaactaccatactctgctcctccctgcttccgacacgcgagagcactccactcccacgcgaaccctagcagtggttctccctcggggccccgctaagaagcttgggtcccagctgtataagcatctccgatcccatccgcggaggattgaggccatcagctccggcttctgcacccggatttggtgatccgcgagatgtcttggtccgcggccgatgacatcctcctctccacctccctcgacgggttcttggacacaaatgttgatcttcatgttgcttgtgaacgagcgattgcgcagcaacaatattgtgatgctcctcttgagctgcacgtaatccgcttagagaacggtgttctatctccagaattggatcgcgaagaggatgaactccctgctctaatgacctgtgattccgaagcagaaataagacagggtgaacagctcgaacgggaagcttcagatctgaccgggacgatgaggaaacggatggagttcctggacttcgattaccaccgtcaccgcgaacgttgccgctccccattgtggcgcgatctttagtggcgggctgtgtgccatacatg

SEQ ID NO: 19685 - protein, 121 aa, Zea mays
  misc_feature: Ceres CLONE 1387297-F
MSWSAADDILLSTSLDGFLDTNVDLHVACERAIAQQQYCDAPLELHVIRLENGVLSPELDREEDELPALMTCDSEAEIRQGEQLEREASDLTGTMRKRMEFLDFDYHRHRERCRSPLWRDL

SEQ ID NO: 19686 - DNA, 687 bp, Zea mays
  misc_feature: Ceres CLONE 1387300-F
  misc_feature: Encodes the peptide sequence at SEQ ID NO. 19687
  misc_feature (683)..(683): n is a, c, t, g, unknown, or other
aagctggagctccccgcggtggcggccgctctagaactagtggatcccccgggctgcaggaattcgcacgagaccattacctagaacatcctaatcgaaaaaaccgttctctgccttctccatcctaaaccctcctagtcctctccatccccatcccctccaatggcggcgactgccacgtccttcgccactctcgccgtcgcgcgctcggcggggcagcggtccctccttgcctccaaggccgccccctcgccgctcctctccctccgcggcgcccgcctcccctcgcagggcgtctccttatctgggggcctcgcggcgtcgccctctcatagccgcgcgcgcttcgccacatcagccagcgccgagcccaaggaagcagaccttcagtctaaaatcacaaacaaggtgtactttgacataagcattgggaaccctgtgggcaagaatgttgggaggatcgtcatcggcttgtacggggatgatgttccacagacaacagagaacttccgtgctctttgcactggagagaaagggtttggatacaggggatccagtttccatcgtgtcatcagcgactttatgatttcaggcggagattttgacaagggcaatggtaccggtgggaagagcatatatggacgcacctttcaagatgagaactttcaattggtcacactggnactg

SEQ ID NO: 19687 - protein, 175 aa, Zea mays
  misc_feature: Ceres CLONE 1387300-F
  misc_feature (82)..(175): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
  misc_feature (174)..(174): Xaa is any aa, unknown, or other
MAATATSFATLAVARSAGQRSLLASKAAPSPLLSLRGARLPSQGVSLSGGLAASPSHSRARFATSASAEPKEADLQSKITNKVYFDISIGNPVGKNVGRIVIGLYGDDVPQTTENFRALCTGEKGFGYRGSSFHRVISDFMISGGDFDKGNGTGGKSIYGRTFQDENFQLVTLXL

SEQ ID NO: 19688 - DNA, 678 bp, Zea mays
  misc_feature: Ceres CLONE 1387302-F
  misc_feature: Translation starting site: 163
  misc_feature (424)..(424): n is a, c, t, g, unknown, or other
ggagctccccgcggtggcggccgctctagaactagtggatcccccgggctgcaggaattcgcacgagaccattacctagaacatcctaatcgaaaactcgccatcctacgcctcgcgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgcgcctcaccgggcactcccacttcgtcccaggacgtcggtctttaggtccgacggncagttcgcactctctggctcctgggacggcgagctcggccttttgggacctctccaccgggctcaccacccgccgcttcgtcgggcacgagaaggacgtcatctccgtccgcttcttccgtcaacaaccgcagatcgtctccgggtcccgggaaagaacatcaagttctgggacactcttcgcgagtgcaagtacacatcgggggggaactcggggggggggagggccacaaaggttgggtcccttgcgtaagg

SEQ ID NO: 19689 - DNA, 698 bp, Zea mays
  misc_feature: Ceres CLONE 1387304-F
  misc_feature: Encodes the peptide sequence at SEQ ID NO. 19690
  misc_feature (698)..(698): n is a, c, t, g, unknown, or other
ggagctccccgcggtggcggccgctctagaactagtggatcccccgggctgcaggaattcgcacgagaccattacctagaacatcctaatcgaaaaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcgttgagctgcggcgaggtgacgtcgtcggtggcgccgtgcctcgggtacgcgatgggcagcgcggcgtccccctccgcggcgtgctgcagcggagtgcgctcgctcaacagccgcgcgtcgtcgacggcggaccggcaggccacctgcaactgcctcaagaagatgacgggcccgatcggcggcggcgtcagtatggccaacgccgccaacatccccggaaaggggggtgtctccgtccgcgtgcccatcagccccgaccgtggaatggcccagaaccaacctggatcgatggaccgtagggggagggaagctatggcctctggatgctcctttggaagggcagactggcccatccagaaaaatgggcggcccggcctccacccgtccaaaccaggaggaccn

SEQ ID NO: 19690 - protein, 167 aa, Zea mays
  misc_feature: Ceres CLONE 1387304-F
  misc_feature (36)..(122): Pfam Name: Tryp_alpha_amyl Pfam Description: Protease inhibitor/seed storage/LTP family
MAARSSSQQLVAAAVLAAALLLLAAGAGTASAALSCGEVTSSVAPCLGYAMGSAASPSAACCSGVRSLNSRASSTADRQATCNCLKKMTGPIGGGVSMANAANIPGKGGVSVRVPISPDRGMAQNQPGSMDRRGREAMASGCSFGRADWPIQKNGRPGLHPSKPGGP

SEQ ID NO: 19691 - DNA, 676 bp, Zea mays
  misc_feature: Ceres CLONE 1387313-F
  misc_feature: Encodes the peptide sequence at SEQ ID NO. 19692
  misc_feature (336)..(336): n is a, c, t, g, unknown, or other
  misc_feature (463)..(463): n is a, c, t, g, unknown, or other
  misc_feature (493)..(493): n is a, c, t, g, unknown, or other
tccccgcggtggcggccgctctagaactagtggatcccccgggctgcaggaattcgcacgagaccattacctagaacatcctaatcgaaaaaagctcctccctttcgctcctcctgattcttgctctgtcagcccagaggcagagcaagcaagcatcggcggccatggcggcgccaggtcgagcggcgctcctggccgccgcgctcctgttcggcactttcttcccatccgcgtcctctgcgtcctcgtaccccgcaaggattgtgggcaggctcctgtccaccacggcgtcggcagtggccaagcagctgtggtcgctcaaatcggcccgcaccnaagacgcgacgacggcagtgacggggcggtccatggtgaggtacgagggcgggtacgcggtggacacgttgtttcgacgcagcaagctggggatcgagccgcacgccgtcgagatcaccccggcggnaacctcctcgtgctcgactccatcaacagnaacatctacggggtacagctggccgtgtcacccataagcaaaacaaagttccttgctggttccccaaaaggttaacctggccctggggatgggaaaactggcaaaaaccaggtgaaccctccctaaaggggttcccttggggacaaaaggggcaaaattttttttttccaaacccatgaaata

SEQ ID NO: 19692 - protein, 121 aa, Zea mays
  misc_feature: Ceres CLONE 1387313-F
  misc_feature (58)..(58): Xaa is any aa, unknown, or other
  misc_feature (100)..(100): Xaa is any aa, unknown, or other
  misc_feature (110)..(110): Xaa is any aa, unknown, or other
MAAPGRAALLAAALLFGTFFPSASSASSYPARIVGRLLSTTASAVAKQLWSLKSARTXDATTAVTGRSMVRYEGGYAVDTLFRRSKLGIEPHAVEITPAXTSSCSTPSTXTSTGYSWPCHP

SEQ ID NO: 19693 - DNA, 673 bp, Zea mays
  misc_feature: Ceres CLONE 1387318-F
  misc_feature: Translation starting site: 210
  misc_feature: SWISSPROT Homolog: EC 1.1.1.1 Alcohol dehydrogenase
  misc_feature: SWISSPROT Homolog: EC 1.1.1.90 Aryl-alcohol dehydrogenase
  misc_feature (291)..(291): n is a, c, t, g, unknown, or other
  misc_feature (292)..(292): n is a, c, t, g, unknown, or other
agagctggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtgnnagtagcgcctccgcaggccatggaggtgcgcgtcaagatcctcttcacctcgctctgccacaccgacgtctacttctgggaggcccagggggcagactcccgtgttccctcggatctttggccacgaggctggaggtatcatagagagtgtttgagagggtgtgactgacttaactccgggcgaccatgtccctccctgtggtccctggggaggcaaggagtggtcccacctgcagtcggaaaaaacaacatgtgtgatctgcctcagatcaacaccgaccgcggggtgatgatggcccatggaaatccccgttttcaatcaatggaaacccatctacccctttgttgggacttccccctcaagggaggacccggtattgg

SEQ ID NO: 19694 - DNA, 676 bp, Zea mays
  misc_feature: Ceres CLONE 1387326-F
  misc_feature (402)..(402): n is a, c, t, g, unknown, or other
  misc_feature (575)..(575): n is a, c, t, g, unknown, or other
tggagctccccgcggtggcggccgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcgggcccctccatccctgacgcagcggcgccagcctgcaggaagccagcccctattcgagancaggtcgatcttttgctgcttggcgagcttcagccgaaatcaggtcgagcatggcggcagggcagtaaatagagcaacacaaaccccttcaaattaatggagacctctgcaggaaacccgacccggccgccaaaccagggggccattccccatcgccatcgccctcctcgtcnttgaggttgggaaggcagggggcaaccaaacatggcaaataaggggcccctctgaaccccacaaggaacatggttggccccccttttttaacgcccccccc

SEQ ID NO: 19695 - DNA, 661 bp, Zea mays
  misc_feature: Ceres CLONE 1387327-F
  misc_feature: Translation starting site: 199
  misc_feature: Pfam Name: GRIM-19 Pfam Description: GRIM-19 protein
  misc_feature (635)..(635): n is a, c, t, g, unknown, or other
ggagctccccgcggtggcggccgctctagaactagtggatcccccgggctgcaggaattcgcacgagaccattacctagaacatcctaatcgaaaaaattcgcaacacaatcgtcctccgccaccctccattaaccctagcggcagcagcgctcgtttgatccccgcggcggtccggcgtccgggtaggggagcgaggatgacggagtccctggtgcggaacaagccggggatggccagcatcaaggagatgccggtgctgcaggacgggccgccgccgggcggtttcgcgcccgtgcgctacgcgcgccggattcccacctcgggccccagcgccactgccatcttcctcacggccttcggcgccttcgcgtatggcatgtaccaggtcggtcaggggaacaagggcactcaaagaagagaaaattgctgctcgtagtgctatactgccgatgctccaagctgaagaggatgaaagatttgtcaaagagtggaagaagtatcttgaggaggaggcgaggattatgaaagatgttccagggtggaaggttggcgagagtgtgtacaattccgggaaatggatgcccccggccaccggtgagctccgccctgaggtgtggaaaggggctgttgtangcattgagaaatgcatcatgtcatga

SEQ ID NO: 19696 - DNA, 717 bp, Zea mays
  misc_feature: Ceres CLONE 1387342-F
  misc_feature: Encodes the peptide sequence at SEQ ID NO. 19697
  misc_feature (623)..(623): n is a, c, t, g, unknown, or other
  misc_feature (663)..(663): n is a, c, t, g, unknown, or other
gctctagaactagtggatcccccgggctgcaggaattcgcacgagaccattacctagaacatcctaatcaaaagtgttcttgttcgtctccgcctcaggcaactccacacggacacggtcacacctcgctcgctctcgctcccgtatcgcggtttccttttcgaagccttgctaggtttagctggggcctccgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcggtcaacttctctgaccgggtgttgcggatcgagatcgtcgctggggatgacgccctcggggccaagggcgccaccggcgaggggtgctcatctcttgccgactgggcgtgccaccgcaagcgacgacgggaggagctccgacgcgacaaagaatctagaaaatacatgccagatccagcaaactgcaaagttgaagctgaagaatgtgatgccctacgaggaaggcaatgagcctgtagctatgatagaagaatctccgcctgatattgangccagatgggtgaggatggaaaaagcagcgctcgtacggnaaaaatgagagggggcacctcggtttttggagagttaagtctatgtacatcagc

SEQ ID NO: 19697 - protein, 96 aa, Zea mays
  misc_feature: Ceres CLONE 1387342-F
MDPDFSPASGGPSFEFAFNSVNFSDRVLRIEIVAGDDALGAKGATGEGCSSLADWACHRKRRREELRRDKESRKYMPDPANCKVEAEECDALRGRQ

SEQ ID NO: 19698 - DNA, 774 bp, Zea mays
  misc_feature: Ceres CLONE 1387344-F
  misc_feature: Encodes the peptide sequence at SEQ ID NO. 19699
  misc_feature (487)..(487): n is a, c, t, g, unknown, or other
tccccgcggtggcggccgctctagaactagtggatcccccgggctgcaggaattcgcacgagaccattacctagaacatcctaatcgaaaactcttctccaaaccccactcaccgcaacgagccgccggatccatggccggcaaagacggctccgtcccttccccgcctcctccccggctcccatcctaccctgagatgatcgtggaggcaatccgggcgctgggactccgagaacggctgcaacaagactgcgatctcggactacattcaggggcagctacggctccaacctccctggccaggacaacgccgtcctcacgggccaccctcgcccgcatgaaggctaccggtgagctcgcccttcctcaggaacaactatcctcgtgcccaaaggaggaacgaagcctcccccgcttaagcacccgggggggcacaagggccccccgccgcccgccgaagaagtcctaatgggcgtggttggaacgnttggggaacgaagggggttgctttgcttcccccccccccggcatccaaacgctgacgcccgcgaaacatttgaacgggcctgcctccagcttccccgttggccaccagcttgatggccaaagaactttgagctggcttgctccccacctccccgttggccagcggtggatggccaccccggggtccttaccagagggggggaaccccggaccggccccccaagccccagggaccccccggttgctgaaggggcacaccggggtgaacaccccctacgcgcccccgat

SEQ ID NO: 19699 - protein, 111 aa, Zea mays
  misc_feature: Ceres CLONE 1387344-F
MAGKDGSVPSPPPPRLPSYPEMIVEAIRALGLRERLQQDCDLGLHSGAATAPTSLARTTPSSRATLARMKATGELALPQEQLSSCPKEERSLPRLSTRGGTRAPRRPPKKS

SEQ ID NO: 19700 - DNA, 748 bp, Zea mays
  misc_feature: Ceres CLONE 1387345-F
  misc_feature: Encodes the peptide sequence at SEQ ID NO. 19701
  misc_feature (379)..(379): n is a, c, t, g, unknown, or other
  misc_feature (403)..(403): n is a, c, t, g, unknown, or other
  misc_feature (416)..(416): n is a, c, t, g, unknown, or other
  misc_feature (505)..(505): n is a, c, t, g, unknown, or other
  misc_feature (591)..(591): n is a, c, t, g, unknown, or other
  misc_feature (595)..(595): n is a, c, t, g, unknown, or other
tccccgcggtggcggccgctctagaactagtggatcccccgggctgcaggaattcgcacgagaccattacctagaacatcctaatcgaaaaaaccatattattgagaccaacaagcaacatagaaagtggaatccagtagcaacaatagagcaacaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtncacaatcgccagccctatcttggntgcagtcattggntacaaccatcagggcacaacagctgcagcaactcgtgctacctgtgatcaaccaagtagctctgggaaacctttctccctactctcagnaaacaacatttctttcatttcaaccaattggctaacctgaaccttgcttggtaatttgcacaacaacttattacaattaaaccagntagntactgcctaattctcaaaaaaaaaaattttttcatttaaacaatttggccgcctgaacccgcgtggtttatttgaaaaaaaaaaaaagcgggggggttcgcccaaaaattttcccccttggcccccccccccccggggggggggggggggaaa

SEQ ID NO: 19701 - protein, 127 aa, Zea mays
  misc_feature: Ceres CLONE 1387345-F
  misc_feature (75)..(75): Xaa is any aa, unknown, or other
  misc_feature (83)..(83): Xaa is any aa, unknown, or other
  misc_feature (87)..(87): Xaa is any aa, unknown, or other
  misc_feature (117)..(117): Xaa is any aa, unknown, or other
METKIFSLLMLLALSTCVANATIFPQCSQAPIASLFPPYLPSIIASVCENPALQPYRLQQAIAASNIPLSPLLCXQSPALSWXQSLXTTIRAQQLQQLVLPVINQVALGNLSPYSQXTTFLSFQPIG

SEQ ID NO: 19702 - DNA, 716 bp, Zea mays
  misc_feature: Ceres CLONE 1387351-F
  misc_feature (626)..(626): n is a, c, t, g, unknown, or other
tccccgcggtggcggccgctctagaactagtggatcccccgggctgcaggaattcgcacgagaccattacctagaacatcctaatcgaaaaaagaaaagaacagccggctgcaactgcaatcggcggacggagaaccatagagcagccggcagtgtcgccgtcgggccgctaccgcactgatcccctgccccggccgccgccgccgtcgtactacgaccactcacagctgatctatgaccgcccgttctggagctcagtcttcgccccgattctgccctcgcccctcaaccgcctcgacgcctgtacgagaccgacgtacctctctccatccagtcatgagaccagctcgactgctctagctcgtgctctccgccgtggatttgatttcttccttgcagcccaacccagcccaaagtcgacagatcagcggcactccgtccaaccctcgatgccactcgatggccttctccaccccctctcctcctcgtagataggtgaagatgattccccagagtcagagcagctccctgcagcgacttcaaacgtcagaagcgggaaaagggcggtggctggagctttgcggaagcgttgatggtaggacctggaatactctcaggacctcgtnaccgatgtagcggcgcgaacgtgcgcgaggttcatgaggggttatgaaggaaattctatcgacactgcgtgagggagtcaaagtgtttga

SEQ ID NO: 19703 - DNA, 727 bp, Zea mays
  misc_feature: Ceres CLONE 1387365-F
  misc_feature: Encodes the peptide sequence at SEQ ID NO. 19704
  misc_feature (569)..(569): n is a, c, t, g, unknown, or other
  misc_feature (590)..(590): n is a, c, t, g, unknown, or other
  misc_feature (615)..(615): n is a, c, t, g, unknown, or other
  misc_feature (693)..(693): n is a, c, t, g, unknown, or other
  misc_feature (727)..(727): n is a, c, t, g, unknown, or other
tcaccgcggtggcggccgctctagaactagtggatcccccgggctgcaggaattcgcacgagaccattacctagaacatcctaatcgaaaaaggcttcagctgtccgcccgcggcccacccctccgccgtctccaccattccgccgttcccaccacgccactcgccagttcggcactccctcctgtctcccccccttgccgagacggcgcggacgccccgtcgcccaccccgatggctgccactctcctccacgccgccaccgcctcgctccagagctcctcccagcccgcacgcgcgggcgccgccaccgcctttcaccccctcgcgtccaccccatccatacgcctcgcgcgctcctcgttctcgtccaatcgccgcctcgaggtttcactccgggcggtttcggccggtcacttgtttcgcggggaggggagcaccccggggccgccgcgtcgtcgccgccctagcagggagcaaactgagggttcagaggtgggcgatgacaaggataacagcaacgaggagataaagcccgaagaggctcagaaagcttggaaagtatggctgnagcagttcaaggctgaggccntgcggatgcaggccctgtcatgcanggcatatgatgctactcaagagggggcgaagggaggtcttgctggaagcctctgagaagctgaagatacaggcagacnaagcacaaaaggactcacgtgttccgctaccgan

SEQ ID NO: 19704 - protein, 145 aa, Zea mays
  misc_feature: Ceres CLONE 1387365-F
  misc_feature (113)..(113): Xaa is any aa, unknown, or other
  misc_feature (120)..(120): Xaa is any aa, unknown, or other
  misc_feature (128)..(128): Xaa is any aa, unknown, or other
MAATLLHAATASLQSSSQPARAGAATAFHPLASTPSIRLARSSFSSNRRLEVSLRAVSAGHLFRGEGSTPGPPRRRRPSREQTEGSEVGDDKDNSNEEIKPEEAQKAWKVWLXQFKAEAXRMQALSCXAYDATQEGAKGGLAGSL

SEQ ID NO: 19705 - DNA, 656 bp, Zea mays
  misc_feature: Ceres CLONE 1387367-F
  misc_feature (352)..(352): n is a, c, t, g, unknown, or other
tggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctaggccttgtcaatcgccccacggcgaatcgcgcgctgcatgttcgctcgcgcaccaccatctcctcacaatgttcaaactgccaacacaacatcctccctcatagccccgactctcacacattccaacttggtgcggcgtaaacgcgcancagcactttcgacccggtcggccacggcctgcccctaggggttgacatccagattcatctcccgtcgatttacattcgagaagtttggctccgacatcgattccccagtctggatccgtggccaacggcttccttgggggggacggcccaagtccacgccaaccccccttcccaactttgttcccccccggggggggaatttaagaaaaactggttttcttttccccggggggaaaaccctcgggccccaggggggggacccccggaaaaaaggttttttttgggggggggcccaaattcccgg

SEQ ID NO: 19706 - DNA, 666 bp, Zea mays
  misc_feature: Ceres CLONE 1387373-F
  misc_feature: Encodes the peptide sequence at SEQ ID NO. 19707
  misc_feature (322)..(322): n is a, c, t, g, unknown, or other
tggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggntggctgtgcgcgatgtcatgcgctccacgatcccgtcgcagcccgccgtggcgccggcgtccacggagaggcaggcgcccgccgcggcgttgcaggggttcctgtgcctggaggaggtggacgggaggcggtgaagctacgtggtggacggtggggccgccaagggggaggaccaggggcggggccgtccccgctggggccgccgtcagggccgggccgctgaagtcgccgcttccgccggcggagaaaatatgggcatccataaaacatatggggggcctgaagggttccaaacagggtactcccttcatatgaccttacatgacctggagggtcctgaaact

SEQ ID NO: 19707 - protein, 67 aa, Zea mays
  misc_feature: Ceres CLONE 1387373-F
  misc_feature (24)..(24): Xaa is any aa, unknown, or other
MAPAVGLKRSATQTITLPPPDTRXAVRDVMRSTIPSQPAVAPASTERQAPAAALQGFLCLEEVDGRR

SEQ ID NO: 19708 - DNA, 809 bp, Zea mays
  misc_feature: Ceres CLONE 1387375-F
  misc_feature: Encodes the peptide sequence at SEQ ID NO. 19709
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
ccccccctatttcccccgacggcgtnnnnnnnnntcgccnnnnnaaaagctggagctccccgcggtggcggccgctctagaactagtggatcccccgggctgcaggaattcgcacgagaccattacctagaacatcctaatcgaaaaaccaaaaccatcctattcctcccaaggcaagaaaccaagaccatggctggcacggccaagacccccggcctcggcttcctccttgctcttgctcttgaggccacctcgacgccgggtgcggacaccacgctgacgctccacaacctgtgtccgaaccccgtgtggccgctggagagcccgaacgccgcgttccccgccatatccgagaacacgggccgcctcgacggcgccgtgcgcggcctgatctccttccgcttcccggacggcttctgcccgccccgcgcggagcagcgaagggaatggctatccagcgattcccaggagcgataatggaagcgaaacctctaccaatccggaaaagccggggggtgacccttcccggatcccggccccgggggccaaaaagcgggaacccggtggaaggggattgaagaagccccatcatcgttatgccgaaaagaagaggtgggggccaaccaaaagcccaaacccggggggaggcccccctggacccccaacggggcccggagccgccccccggattaaagtccgggagaggagagggggtgagaaataaaactttgcaaaatcttggggtaaaataaggggggataaaaggaggagctccaaaacacggaaaaaaacatatccccaaaaaaaag

SEQ ID NO: 19709 - protein, 95 aa, Zea mays
  misc_feature: Ceres CLONE 1387375-F
MAGTAKTPGLGFLLALALEATSTPGADTTLTLHNLCPNPVWPLESPNAAFPAISENTGRLDGAVRGLISFRFPDGFCPPRAEQRREWLSSDSQER

SEQ ID NO: 19710 - DNA, 624 bp, Zea mays
  misc_feature: Ceres CLONE 1387378-F
  misc_feature: Encodes the peptide sequence at SEQ ID NO. 19711
  misc_feature (383)..(383): n is a, c, t, g, unknown, or other
  misc_feature (388)..(388): n is a, c, t, g, unknown, or other
  misc_feature (426)..(426): n is a, c, t, g, unknown, or other
  misc_feature (497)..(497): n is a, c, t, g, unknown, or other
  misc_feature (528)..(528): n is a, c, t, g, unknown, or other
  misc_feature (624)..(624): n is a, c, t, g, unknown, or other
tggagctccccgcggtggcggccgctctagaactagtggatcccccgggctgcaggaattcgcacgagaccattacctagaacatcctaatcgaaaaatccaaatcccgatcagtcgccgcccaagcctagcagatccgccggcgagcgcgcgggggcaatgggtgtcgtctcggcagcggcggacgcgattgtcgcggttttctccctcaccatcgtcgtcgcggcgccgctactcgacgcgcagtccgtcctcccgcataccctctacccggcgccgctcctggaactcaagcgctggtacgccgccgagtttggcgactacctcgtggcccagtcccccggcttcttccgtggccttgtttgcctcgagctcgccttccnatggncgctcgccgtcgccacactctacggcatcctcacccgncgccgctgggctgccaccacctccctcatgggcggggttggcaccctcacctccatgtctgcatttctggntgagatggtaggttcagggcaatcaacaccnaagtggcttcagatggatggtccttatgctgttttggctggcattgctattctacggggactttgctcatgctctggacgcactactggtgggtcn

SEQ ID NO: 19711 - protein, 155 aa, Zea mays
  misc_feature: Ceres CLONE 1387378-F
  misc_feature (75)..(75): Xaa is any aa, unknown, or other
  misc_feature (77)..(77): Xaa is any aa, unknown, or other
  misc_feature (113)..(113): Xaa is any aa, unknown, or other
MGVVSAAADAIVAVFSLTIVVAAPLLDAQSVLPHTLYPAPLLELKRWYAAEFGDYLVAQSPGFFRGLVCLELAFXWXLAVATLYGILTRRRWAATTSLMGGVGTLTSMSAFLXEMVGSGQSTPKWLQMDGPYAVLAGIAILRGLCSCSGRTTGGS

SEQ ID NO: 19712 - DNA, 703 bp, Zea mays
  misc_feature: Ceres CLONE 1387379-F
  misc_feature (604)..(604): n is a, c, t, g, unknown, or other
  misc_feature (703)..(703): n is a, c, t, g, unknown, or other
gctctagaactagtggatcccccgggctgcaggaattcgcacgagaccattacctagaacatcctaatcgaaaaaccagtactagcagtggcgcaaaaacttttttattacaacttcccggcaggacccgtttcgttcggtccaagtctccaacccctagcagcccacccacatacaattccgtttgcccgggtcctctcctcgcccgcgaccgccgtttgactcccggacccgacccactcccaccaatcggaggcaaagatcgcgtgaaatcccgggtctcgcgcgcccatttcagccggacgctgaccaagacaaccccggcgatccccacacccgcacacacaaagacgcagaccacacaacggctcggcaagcggcagcaagcccagaccagagcgaaaacccaccgttccagcacccgattttgaaccaccgcgacactcccaagtcccaaccaaatctacgacccctccgaccgaaacgagatctccgcctcccctcacggaaaggaaagaaacgctctccccccggggcaaagggaaccgtcgccgcgtcgcggaaactgaaagcgggcacaggaggaggagaggccgaggcaggnagagggttccgcggcgatggagcggtacaacccctccgaagtgtacgagctcttcgtgcgcacatgaaaacccgaggtaaggaagccggggggccattn

SEQ ID NO: 19713 - DNA, 599 bp, Zea mays
  misc_feature: Ceres CLONE 1387381-F
  misc_feature: Encodes the peptide sequence at SEQ ID NO. 19714
  misc_feature (237)..(237): n is a, c, t, g, unknown, or other
  misc_feature (238)..(238): n is a, c, t, g, unknown, or other
  misc_feature (254)..(254): n is a, c, t, g, unknown, or other
  misc_feature (300)..(300): n is a, c, t, g, unknown, or other
tccccgcggtggcggccgctctagaactagtggatcccccgggctgcaggaattcgcacgagaccattacctagaacatcctaatccaaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacgnnacggtccagacagcanggagatggtgactgtggagggaaaaaaaggctctagtgatcaaacnggcgacatgagggacctgagtgacttccccgtctacaatgcccggggctccaaccccggtctggtgggtcggggggagggggtcacaacccgtttcgggaaatctcaccagttcttacccgtggcctttcaggggtggaagggtaaaggggttcccccctcctttacccaaggggggtgggagcgggtggatcccccttatagggcgaattaccgcggggacccgcgaaatttttcttttggggagaagtgttgtccaaaaaaaagaaactctttctccataaagaggcgcccccccca

SEQ ID NO: 19714 - protein, 153 aa, Zea mays
  misc_feature: Ceres CLONE 1387381-F
  misc_feature (34)..(34): Xaa is any aa, unknown, or other
  misc_feature (39)..(39): Xaa is any aa, unknown, or other
MENPAPSIVVPPIAAPVSANFSRLAFRNLYIRRXGPDSXEMVTVEGKKGSSDQTGDMRDLSDFPVYNARGSNPGLVGRGEGVTTRFGKSHQFLPVAFQGWKGKGVPPSFTQGGWERVDPPYRANYRGDPRNFSFGEKCCPKKRNSFSIKRRPP

SEQ ID NO: 19715 - DNA, 714 bp, Zea mays
  misc_feature: Ceres CLONE 1387382-F
  misc_feature: Pfam Name: Alba Pfam Description: Alba
  misc_feature (382)..(382): n is a, c, t, g, unknown, or other
tccccgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtaacactatttctagggttttacacgtaccaataggagccccttccgccacttcccctccagcaacagtagcgccgccaccgccgccgccgccgcttgctcgccgggatcgtcgccggaggaaagcgccatggatcggtaccaacgggtgtagaagccgccgcccgaggccgccgccatcggtgagaatgagatccgcatcaccactcgaggactcgtccgaaantacttgacctatgccagctccctcgtacaggaaaaacagtgaaggaaattgtgatgaatgctatgagacaggctatcagcaagggagtggctatggctgacatcataaagaagagggattcctggtttgcatcaagatacaatactcagttcctgtcataatcactgaagaatggcaaccattgagggacgacttgtaacattggaaaggactccgcgtgtttcaagaaaatccatttcccttgccccctagggacctaaccagaaatcccctgggaagccacgtcccccaccttccggtttttaacacaaaaaaattccggccaactcaca

SEQ ID NO: 19716 - DNA, 678 bp, Zea mays
  misc_feature: Ceres CLONE 1387384-F
  misc_feature (363)..(363): n is a, c, t, g, unknown, or other
  misc_feature (511)..(511): n is a, c, t, g, unknown, or other
  misc_feature (515)..(515): n is a, c, t, g, unknown, or other
  misc_feature (530)..(530): n is a, c, t, g, unknown, or other
  misc_feature (588)..(588): n is a, c, t, g, unknown, or other
tctgaacaagtggatcccccgggctgcaggaattcgcacgagaccattacctagaacatcctaatcgaaaaaggacctgcttgtttgattgtttcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcagaacatggtgncgccgctcctggtgctcaacctcatcatgtacatcatcgtcatcggcttcgcgagctggaaactgaaccacttcatcaacgggcagacaactaccccggcgtggcccgcaacggcgcgacgttctacttcctggtgtcgccatctggnccgnggtgtggggcccgcntccaagctggcggcgtggcacacgtggcggctggggccaggaaggctgccccaaaggncgggtgtcgtcatggctgggcataaggggttcccttccggtgccttggaagaaacccattgggaaacccggtgggccctgccttttttaa

SEQ ID NO: 19717 - DNA, 706 bp, Zea mays
  misc_feature: Ceres CLONE 1387389-F
  misc_feature: Encodes the peptide sequence at SEQ ID NO. 19718
  misc_feature (613)..(613): n is a, c, t, g, unknown, or other
  misc_feature (659)..(659): n is a, c, t, g, unknown, or other
tccccgcggtggcggccgctctagaactagtggatcccccgggctgcaggaattcgcacgagaccattacctagaacatcctaatcgaaaagtgttacctcacccatacatggcaccatctactgcttccctatcccccgcctgctgtgttcactaacccacctccgtcccccgttgcgggtccccctccccgtcagaaggttccccagatttatagcccggagtagcggcggcgacggggcatgcgctcggagcccaaaccagcttacaacgagagcaaggccatccctgatgccttcttccttgagaaggcctccgcggaggcgttcacggagcgagtcgagtcggtattggcctagtgggcgaggtattcaacatcgtcaggcagtggcaaactcagcagcagaagcaggtctaggagttccagaagtagcaaagttttattatttcctggctggagagcagtttacatgaaaagataattgaggcatgcaacaaccttattgcaaagctcaagtaagtgaggtagtcacgaatggctcagttgatgaattccctgaatcacattttccatatggctcggaacaaacggtgggtggaaatgccccactgnagtatgcaagctttacaataagatttggctcattgaatgtgacccnatgcttttactcgtcaccaaacatcttgaagcaagctcagcgaagta

SEQ ID NO: 19718 - protein, 38 aa, Zea mays; identical to SEQ ID NO: 17402
  misc_feature: Ceres CLONE 1387389-F

SEQ ID NO: 19719 - DNA, 700 bp, Zea mays
  misc_feature: Ceres CLONE 1387396-F
  misc_feature: Pfam Name: Ribosomal_L12 Pfam Description: Ribosomal protein L7/L12 C-terminal domain
  misc_feature (540)..(540): n is a, c, t, g, unknown, or other
  misc_feature (582)..(582): n is a, c, t, g, unknown, or other
  misc_feature (587)..(587): n is a, c, t, g, unknown, or other
  misc_feature (596)..(596): n is a, c, t, g, unknown, or other
tccccgcggtggcggccgctctagaactagtggatcccccgggctgcaggaattcgcacgagaccattacctagaacatcctaatcgaaaaaacaacaaagctaacacattcacagagagagacacacacacacacaaaagctaaagagcgaaaatggcagcgacggctctctccaccgcaagctcaatcctttcctcatcatctcccactctcacctccgcccaccccttcctctcccgacccaccacactcgaattcccatctcgcttcggtctttcctcctcctcctcgaccctcacccaccgcgcgacccacctccgccccctcgccgccgtcgaagccccggagaaaattgagaaaatcggatccgagatctcgtccctcaccctcgaggaagcccgcatcctcgtcgactacctccaggacaagttcggcgtctcgcctctctccttggctcccgccgcagcggctgtcgctgctccgggagacggcggcggcgcggcggctgtcgtcaaggagcagacggagttcgatgtggntgataacgaggtgcctagcagctcgcgtatcgcggtgataanggcgntgagggcgntgactaacttggcgttgaaggaagcgaagggagctaatcgaaggcctgccgaaaaaagtcaagggaagtgtgaccaaagatggagctggaggagctaaaacagc

SEQ ID NO: 19720 - DNA, 702 bp, Zea mays
  misc_feature: Ceres CLONE 1387398-F
  misc_feature: Encodes the peptide sequence at SEQ ID NO. 19721
  misc_feature (362)..(362): n is a, c, t, g, unknown, or other
  misc_feature (546)..(546): n is a, c, t, g, unknown, or other
  misc_feature (558)..(558): n is a, c, t, g, unknown, or other
acccgcggtggcggccgctctagaactagtggatcccccgggctgcaggaattcgcacgagaccattacctagaacatcctaatcgaaaaaaacatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccggcgccgtcgcaggcgtgctgcgacngcgctggcgggggcggacctcaagtgcctgtgcggctacaagaactcgccgtgggatgggcgtctacaacatcgaccccaagcgcgccatggagcttccggccaagtgcggcctcgccacgccgcccgactggctagcagtgtgctagccaagcaagcccaagcaggaaggcccccggcatgcntagctgggaccngggtctgtgtgtgcatctgcagcaggttggcaggcagggggccccctaacgaaacggggctctttctctctctcatcttgtcacgaccctatacttggaggggggggggtgttcgtacctattaaaaaggtctcttgggccgtc

SEQ ID NO: 19721 - protein, 120 aa, Zea mays
  misc_feature: Ceres CLONE 1387398-F
  misc_feature (72)..(72): Xaa is any aa, unknown, or other
MAATSSKSSSSSSSAQRAAAALLVAAAVAVSVLVVGAAAVCDMSNEQFMSCQPAAAKTTDPPAGAVAGVLRXRWRGRTSSACAATRTRRGMGVYNIDPKRAMELPAKCGLATPPDWLAVC

SEQ ID NO: 19722 - DNA, 699 bp, Zea mays
  misc_feature: Ceres CLONE 1387399-F
  misc_feature: Translation starting site: 158
  misc_feature (320)..(320): n is a, c, t, g, unknown, or other
  misc_feature (331)..(331): n is a, c, t, g, unknown, or other
  misc_feature (332)..(332): n is a, c, t, g, unknown, or other
  misc_feature (392)..(392): n is a, c, t, g, unknown, or other
  misc_feature (399)..(399): n is a, c, t, g, unknown, or other
  misc_feature (534)..(534): n is a, c, t, g, unknown, or other
  misc_feature (565)..(565): n is a, c, t, g, unknown, or other
ggagctccccgcggtggcggccgctctagaactagtggatcccccgggctgcaggaattcgcacgagaccattacctagaacatcctaatcgaaaaaaggaaacagtcacgtctcccagatctaactgccccccgactcacgaatcccaaagcctccatggcgacgcaccgccactgcctcccactcctcctcctcgtggccgccgccctcgccgccgtccctgctcgcgcggcgctgggcggcgggcgcggcccgctgctgggcgggtggaacccgatccctgacgtgagcgactcgcacatccagagctaaggcgggntggggcgctgnngcaggcgaagcaccagaagctggccgccgacgggctgcggttccgccgcgtggtgcgcgncgagcancaggtcgtgtccgggatgaactaccgcctctacgtcgacgccgccgaccccgccggccgcaccgtgccctacgtcgccgtcgtgtacgagcaggtctggacccgcacccgccaggtcgcctccttcaacccggtnccccgcgcccactgaaacatacgcacacggntgagccgaagcgacggtctccgtcaattacgggcgagctaatcttattattggttccaatataatataatgcttctccctgtcctatggacctatagagaatactaggatgttgcgagggagcaagaaaaacgg

SEQ ID NO: 19723 - DNA, 705 bp, Zea mays
  misc_feature: Ceres CLONE 1387401-F
  misc_feature: Translation starting site: 137
  misc_feature: SWISSPROT Homolog: EC 2.4.2.30 NAD(+) ADP-ribosyltransferase
  misc_feature (495)..(495): n is a, c, t, g, unknown, or other
  misc_feature (554)..(554): n is a, c, t, g, unknown, or other
  misc_feature (662)..(662): n is a, c, t, g, unknown, or other
gcggtggcggccgctctagaactagtggatcccccgggctgcaggaattcgcacgagaccattacctagaacatcctaatcgaaaaaactctagtctctagccacaactcgaagtacgagtacctccggagtccggatggctgcagcgatggacgtcgacgaagccggcggcgaggagaggcgaccgtcggagaaggagctcttccgcgccgccgagtccggcgacgccgccgcgttcgcctccctcgcccccgccgacctctccctgcgcaacgaggacggccgctccctcctccacgtcgccgccgctgccggccatccccaggtggtgctcgcgcttgcccagtgcggtggtgacgccgcggctagcgtgctgaatgcgcaggacgaggaggggtgggcgccgatccactccgccgcgagctccggcaactctcaaatcgtcgacatcctgcttgagcgaggtgctgatgttaacctgggtactgatggtgntcgaactgcccttcattatgctgcgagtaaagggaggcttaacatagctgaaaaactantagcccatggtgctaatgtcacaagaaaagacagtttggctgcacacctttgcatagagctgcagcactggaaacgcggagctgtgtgaattctcatttgaagaaggngctgaagttgatgctgttgacaggaaggacaacaccctctact

SEQ ID NO: 19724 - DNA, 675 bp, Zea mays
  misc_feature: Ceres CLONE 1387408-F
  misc_feature: Encodes the peptide sequence at SEQ ID NO. 19725
tggagctccccgcggtggcggccgctctagaactagtggatcccccgggctgcaggaattcgcacgagaccattacctagaacatcctaatcgaaaacatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgatgccgccaagacatggatggcgattcctgctccaaagcgaggagagatcgttaggcaaatcggtgatgcactgagagcaaagctccatcaccttggcaggcttgtgtcacttgagatggggaaaattcttcctgaagggatcggtgaggttcaggaaatcatcgacatgtgtgattatgctggtggggctaagtcgccaactaaatggatccattataccatctgaacgaccaaacatatgatgatggaggggtggatccccttgggagtggtggtgttataacggcatttaatttccccttgtgctgtgcttgggt

SEQ ID NO: 19725 - protein, 142 aa, Zea mays
  misc_feature: Ceres CLONE 1387408-F
  misc_feature: SWISSPROT Homolog: EC 1.2.1.3 Aldehyde dehydrogenase (NAD(+))
MGAFAKEEHQFLAELGLAQRNPGAFACGAWGGSGPTVTSTSPTNNQVIAEVVEASVHDYEEGMRACFDAAKTWMAIPAPKRGEIVRQIGDALRAKLHHLGRLVSLEMGKILPEGIGEVQEIIDMCDYAGGAKSPTKWIHYTI

SEQ ID NO: 19726 - DNA, 845 bp, Zea mays
  misc_feature: Ceres CLONE 1387409-F
  misc_feature: Encodes the peptide sequence at SEQ ID NO. 19727
  misc_feature (1)..(1): n is a, c, t, g, unknown, or other
  misc_feature (6)..(6): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (21)..(21): n is a, c, t, g, unknown, or other
  misc_feature (34)..(34): n is a, c, t, g, unknown, or other
  misc_feature (36)..(36): n is a, c, t, g, unknown, or other
  misc_feature (45)..(45): n is a, c, t, g, unknown, or other
nttttnaaggggnnnttttnnttcggcataggcngnggcgggggnggccaaaactcggactccccgcggtggcggccgctctatactaaagcatcccccgggctgcaggaatttacacgagaccattacctagaacatcctaatcgaaaaacgatcacacaccactccacagcagtagcaagagggatagagcaaggccacacacacacacacaccactaggaggctagcctagccttttagtcgtcgaggaggagcaagaagggcgcgcacgcaagcaggcaagcaagaagagagccgatcgaccgagagctagcacgcgatggcgaggtcttccaagatgatggtggggggcagctctggctggccttggcccctggccgtgtccgaccgccgaggcggaggaacatcaaggaccgcgacgaccggagaagagcgggggggggggcgggtgcaagccgcaagaccttccccgccccttccaaccggctgcgagagggggggcgccggccccccggcggttgcggggggcccctcccccggggggcgcagcacttccggcggaagggaggcaattcgccgggggttgccgggcactggcccccggccagcccgctgagcaagccctaacccggggggctcgggcgttggcccccggcaagagggaaaagagtgggacccgttcttggggggggggggggctcccccgggcggtttccgggggggcgtccggcggggggaggggccgcgggggtgcgcccacgcggccgcgggctctccgccccccgggaaggacggcgcaagaaggggcccgtaaaggagcccacaagaaggcgctggagagga

SEQ ID NO: 19727 - protein, 98 aa, Zea mays
  misc_feature: Ceres CLONE 1387409-F
MARSSKMMVGGSSGWPWPLAVSDRRGGGTSRTATTGEERGGGRVQAARPSPPLPTGCERGGAGPPAVAGGPSPGGRSTSGGREAIRRGLPGTGPRPAR

SEQ ID NO: 19728 - DNA, 761 bp, Zea mays
  misc_feature: Ceres CLONE 1387410-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
nnnnnnnnccccnnccccncccccccccgggctnnnnccnnnnnnnnnnnaaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcagggggggctagctagctgagctcgtgcgacaaaaaatggccggcattggcaagaacatggtggcgccgctcctggtgctccaccctcatcatgaacctcatcggcatcgggtttcccgagctggaacctgaaccacttcctcaaacgggcaaaaccaactacccccggggtgggccgggaaccggcgcaaccttctaccttcctggggttcccccatccctggcccggcgggggggggcccgacttccaaacttggcggggcggggaccaccgtggggggcccttgcggcccccaaaaggcctgggccccccaaaggcggggttcatccgtttcattcccctgggggccattacagggcgcttcgccccttcggggctttggccctggaaaaggaaaaatcc

SEQ ID NO: 19729 - DNA, 766 bp, Zea mays
  misc_feature: Ceres CLONE 1387415-F
  misc_feature: Encodes the peptide sequence at SEQ ID NO. 19730
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nnnnnnnnnnnnnnnnnnnnggggaggggggnnnnctctccannnnnaaaagctggagctccccgcggtggcggccgctctagaactagtggatcccccgggctgcaggaattcgcacgagaccattacctagaacatcctaatcgaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccggcgggccatgtgccgccgccggttcatctgccgccgccaccatggcactacccctactcaaccgccccggcctcagcctcctcccccagccacacccatggcccggggccaacagcccgcgtcccagccccggggccagctgccagggaacctggggggggttggaagccaccccggaaccctggggccggggggggccgaggcccccggaaggcatcaagtgcaagccccggacgggcgacccccccaacttgctccgccttcaataggccccgccctttggcgcgccacaagggttcgccaggacactttcagggaggggtgggagcccgccacaacccgg

SEQ ID NO: 19730 - protein, 182 aa, Zea mays
  misc_feature: Ceres CLONE 1387415-F
MRVLLVALALLALAASATSTHTSGGCGCQPPPPVHLPPPVHLPPPVHLPPPVHLPPPVHLPPPVHLPPAGHVPPPVHLPPPPWHYPYSTAPASASSPSHTHGPGPTARVPAPGPAAREPGGGWKPPRNPGAGGGRGPRKASSASPGRATPPTCSAFNRPRPLARHKGSPGHFQGGVGARHNP

SEQ ID NO: 19731 - DNA, 617 bp, Zea mays
  misc_feature: Ceres CLONE 1387420-F
  misc_feature: Encodes the peptide sequence at SEQ ID NO. 19732
  misc_feature (377)..(377): n is a, c, t, g, unknown, or other
  misc_feature (463)..(463): n is a, c, t, g, unknown, or other
  misc_feature (500)..(500): n is a, c, t, g, unknown, or other
gtctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactgggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagaagggaatgcnagagcgagtgccgcgagcggcaccagcaagctgacgcgggcgaggacggcgacagcggcgtggacgcctacgtctcccgctcgggnagggcgagtgccggcgccagtgcctgcgccgccacgnagggcagccgtgggagaccaggagtgcatgaggcggtgccgccgccgcggactggccgtcgactggagcaggatacggtcgcgcagcgagagcgcgggcaagtgccgggagagtgca

SEQ ID NO: 19732 - protein, 74 aa, Zea mays
  misc_feature: Ceres CLONE 1387420-F
  misc_feature (64)..(64): Xaa is any aa, unknown, or other
MGKGSVGASWWAFLLLAGVLLVVAATAGAEDGVVERDRKEDLRWCKQACEWQYGKDTPRKKGMXERVPRAAPAS

SEQ ID NO: 19733 - DNA, 648 bp, Zea mays
  misc_feature: Ceres CLONE 1387421-F
  misc_feature: Translation starting site: 144
  misc_feature (207)..(207): n is a, c, t, g, unknown, or other
  misc_feature (222)..(222): n is a, c, t, g, unknown, or other
  misc_feature (302)..(302): n is a, c, t, g, unknown, or other
  misc_feature (396)..(396): n is a, c, t, g, unknown, or other
ctccccgcggtggcggccgctctagaactagtggatcccccgggctgcaggaattcgcacgagaccattacctagaacatcctaatcgaaaactctcgctcgccaggagaagcagccgccgttgctgctgccgcgtccacagaatggggggtttcgtgaagacccataagaccaatgcgtatttcaacgtttcccaagtgaattcangagaaggcgggctgncaagacagactacagggccaggataaggctgattaaccaagacaaaaaacagtaccacacacccaaatacagatttgttngtgcgatttaccaacaagggacatcactgcacaaatcatatctgctagtatagcgggtgatattggttctggctgctgcctactctcatgagtngccacgatatggtcttggagttggtctgaacaactatgcagctgcctactgcactggacttctgttggctccgccgggtgctaaaaactcgtggtttggataaaggagtattgaggcaaatgtttaaggccactgggggaagactttctcttgtgaccagtttgataaaggagggcccttccgggcttcctttggatggtggcctttatcaggacttacaacagggaaaccgtgtcttttgggcgccctcag

SEQ ID NO: 19734 - DNA, 673 bp, Zea mays
  misc_feature: Ceres CLONE 1387423-F
  misc_feature: Encodes the peptide sequence at SEQ ID NO. 19735
  misc_feature (353)..(353): n is a, c, t, g, unknown, or other
  misc_feature (406)..(406): n is a, c, t, g, unknown, or other
  misc_feature (407)..(407): n is a, c, t, g, unknown, or other
aagctggagctccccgcggtggcggccgctctagaactagtggatcccccgggctgcaggaattcgcacgagaccattacctagaacatcctaatcgaaaacacacaatttcaccgaaatcctccaataccccaccctacgaatcttccaacccctccgacgatgccttccgcgccggcgctcgtccccgcgtgcgacatgcaggagccgttgctggcggagtcgtccgaccgcttctccatgttcccgatccggtacccgcagatttgggagttctacaagaaggcggtggcgtccttctggactgccgaggaggtggacctctccgcggacgcgcgccactgggacgcggncctctcccccgacgagcgccacttcatctcccacgtgctcgccttcctcgccnngctcgacgggatcgtgctcgagaacctcgcctcccgcttcatgtccgatgtccaggtcgccgaggcgcgcgccctttacgggttcccaatcgccatcgaaacctccactcggagatggactccctgttggtcgagacttaactccgggatgggaccaagaaggaccgctttttcgggcattgaaaccgtccccccggaaccccaaggggcattgcccctggctttgatcacaggggggaagctttttccgaggctctttggcttgc

SEQ ID NO: 19735 - protein, 170 aa, Zea mays
  misc_feature: Ceres CLONE 1387423-F
  misc_feature (15)..(168): Pfam Name: Ribonuc_red_sm Pfam Description: Ribonucleotide reductase, small chain
  misc_feature: SWISSPROT Homolog: EC 1.17.4.1 Ribonucleoside-diphosphate reductase
  misc_feature (64)..(64): Xaa is any aa, unknown, or other
  misc_feature (82)..(82): Xaa is any aa, unknown, or other
MPSAPALVPACDMQEPLLAESSDRFSMFPIRYPQIWEFYKKAVASFWTAEEVDLSADARHWDAXLSPDERHFISHVLAFLAXLDGIVLENLASRFMSDVQVAEARALYGFPIAIETSTRRWTPCWSRLNSGMGPRRTAFSGIETVPPEPQGALPLALITGGKLFPRLFGL

SEQ ID NO: 19736 - DNA, 634 bp, Zea mays
  misc_feature: Ceres CLONE 1387424-F
  misc_feature: Encodes the peptide sequence at SEQ ID NO. 19737
  misc_feature (504)..(504): n is a, c, t, g, unknown, or other
tggagctccccgcggtggcggccgctctagaactagtggatcccccgggctgcaggaattcgcacgagaccattacctagaacatcctaatcgaaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctcttcggccgccgcgagtggtacttcttcacgccgcgggaccgcaagtaccccaacggcntcccgccccaaccgcgccgcccgggtcgggcctactgggaagggcacggggcgcgggacaagccccgtgggagcacggggggcccggaacggcgggggaatcaaaaaaaggggcctccggggttccaacc

SEQ ID NO: 19737 - protein, 133 aa, Zea mays
  misc_feature: Ceres CLONE 1387424-F
  misc_feature (21)..(130): Pfam Name: NAM Pfam Description: No apical meristem (NAM) protein
  misc_feature (91)..(91): Xaa is any aa, unknown, or other
MAAVQQQQQQQRRDAEAELNLPPGFRFHPTDEELVAHYLCARAAGRRPPVSIIAEVDLYRFDPWDLPERALFGRREWYFFTPRDRKYPNGXPPQPRRPGRAYWEGHGARDKPRGSTGGPERRGNQKKGPPGFQ

SEQ ID NO: 19738 - DNA, 730 bp, Zea mays
  misc_feature: Ceres CLONE 1387425-F
  misc_feature: Encodes the peptide sequence at SEQ ID NO. 19739
  misc_feature (435)..(435): n is a, c, t, g, unknown, or other
  misc_feature (447)..(447): n is a, c, t, g, unknown, or other
  misc_feature (451)..(451): n is a, c, t, g, unknown, or other
  misc_feature (452)..(452): n is a, c, t, g, unknown, or other
  misc_feature (541)..(541): n is a, c, t, g, unknown, or other
  misc_feature (552)..(552): n is a, c, t, g, unknown, or other
  misc_feature (589)..(589): n is a, c, t, g, unknown, or other
  misc_feature (638)..(638): n is a, c, t, g, unknown, or other
  misc_feature (643)..(643): n is a, c, t, g, unknown, or other
tccccgcggtggcggccgctctagaactagtggatcccccgggctgcaggaattcgcacgagaccattacctagaacatcctaatcgaaaaaattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcanggactaccgtgncaanngatgaactgagctcaccaagatctgtgatggcatcctcaagcttctcgaaatctcaccttgtgccgtcttccaccgctcccgagtccanggtcttctatnctcagatgaagggtgactactacagataccttgctgnagtcaagactggagctgagagaaaagacgctgctgaaaacacatggtgncatancaggctgcccaggacttgctttggctgagcttgctccacctcaccctattagcttgaactggcactcaacttctcagggtccactag

SEQ ID NO: 19739 - protein, 92 aa, Zea mays
  misc_feature: Ceres CLONE 1387425-F
  misc_feature (89)..(89): Xaa is any aa, unknown, or other
MASAELSREENVYMAKLAEQAERYEEMVEFMEKVAKTVDSEELTVEERNLLSVAYKNVIGARRASWRIISSIEQKEEGRGNEDRVTLIXDYR

SEQ ID NO: 19740 - DNA, 717 bp, Zea mays
  misc_feature: Ceres CLONE 1387428-F
  misc_feature: Translation starting site: 214
  misc_feature (463)..(463): n is a, c, t, g, unknown, or other
  misc_feature (555)..(555): n is a, c, t, g, unknown, or other
  misc_feature (569)..(569): n is a, c, t, g, unknown, or other
  misc_feature (605)..(605): n is a, c, t, g, unknown, or other
  misc_feature (662)..(662): n is a, c, t, g, unknown, or other
  misc_feature (663)..(663): n is a, c, t, g, unknown, or other
ggagctccccgcggtggcggccgctctagaactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaaccactgtcatcgatgaggtgaggactggcacctaccngcagctcttccaccctgagcagctcatcagtgggaaaggagatgcagccaacaactttgcccgtggtcactacaccattggcaaggagattnggtgactatgcttngatcgcatcaggaaaagcttgcgacactgcactggntctcagggcttcctcgtcttcaacgctgttggtgggagaaacggcttcggccctggnntcctccttctaggagcgctggtctgtgactacggcaagaagtccaagctggggt

SEQ ID NO: 19741 - DNA, 672 bp, Zea mays
  misc_feature: Ceres CLONE 1387429-F
  misc_feature: Encodes the peptide sequence at SEQ ID NO. 19742
  misc_feature (397)..(397): n is a, c, t, g, unknown, or other
  misc_feature (481)..(481): n is a, c, t, g, unknown, or other
  misc_feature (513)..(513): n is a, c, t, g, unknown, or other
  misc_feature (554)..(554): n is a, c, t, g, unknown, or other
  misc_feature (625)..(625): n is a, c, t, g, unknown, or other
  misc_feature (652)..(652): n is a, c, t, g, unknown, or other
tggagcttcccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcnagagcgagtgccgcgagcggcaccagcaagctgacgcgggcgaggacggcgacagcggcgtggacgcctacgtctccgctcggnaagggggcgagtgccggcgccagtgcctgcgnccgcacgagggccagccgtggggagacccagagtgcatgangcggtgccgccgcgcggactgggcgtcgactggagcaggagtacggtcgcgcagcgagagcgcggcagtgnccgggagagtgcgagcgcacacgcggngactggtgggagagcaggct

SEQ ID NO: 19742 - protein, 155 aa, Zea mays
  misc_feature: Ceres CLONE 1387429-F
  misc_feature (64)..(64): Xaa is any aa, unknown, or other
  misc_feature (92)..(92): Xaa is any aa, unknown, or other
  misc_feature (116)..(116): Xaa is any aa, unknown, or other
  misc_feature (140)..(140): Xaa is any aa, unknown, or other
  misc_feature (149)..(149): Xaa is any aa, unknown, or other
MGKGSVGASWWAFLLLAGVLLVVAATAGAEDGVVERDRKEDLRWCKQACEWQYGKDTPRKRECXSECRERHQQADAGEDGDSGVDAYVSARXGGECRRQCLRPHEGQPWGDPECMXRCRRADWASTGAGVRSRSESAAVXGRVRAHTRXLVGEQA

SEQ ID NO: 19743 - DNA, 709 bp, Zea mays
  misc_feature: Ceres CLONE 1387432-F
  misc_feature: Encodes the peptide sequence at SEQ ID NO. 19744
  misc_feature (427)..(427): n is a, c, t, g, unknown, or other
tggagctccccgcggtggcggccgctctagaactagtggatcccccgggctgcaggaattcgcacgagaccattacctagaacatcctaatcgaaaaattagggttctacttctagcccgggccgactccactccaatccaatcctggggcgggcgactgcctccttccctcgatctattctccatcttgtcctccctttgctaaaaataacgaggcagaggcatcttcgatttgacgtgcgcttcctcttcctcgctcgctctcggtcgcagtgatggctgatgtcgacgagtaccgttgcttcattgggaacctgtcctggtcaacgactgatgaaagcctcaaggatgcgttcagcaaattcggcaacctcactgaggaaaaggtggttcttgacaaattttcaggacgttctccgggtttccngcttttgaaccttttgaggaggagcaaggccatggaggaagctattagaggaattgaatggactggaacttggacgggaagaacattccctggtggaaaaactccacccccaaaggaccttggaaaaaaacccaaatgggggaaccggaatttattaccccgcgaggggggaatctcccttataaaacgggggcccggaccatatggggggggggcccgcccccccgagaagggtgcccccacccccccgcccgcgcgccgcccacctcccctccaaagggg

SEQ ID NO: 19744 - protein, 144 aa, Zea mays
  misc_feature: Ceres CLONE 1387432-F
  misc_feature (51)..(51): Xaa is any aa, unknown, or other
MADVDEYRCFIGNLSWSTTDESLKDAFSKFGNLTEEKVVLDKFSGRSPGFXLLNLLRRSKAMEEAIRGIEWTGTWTGRTFPGGKTPPPKDLGKKPKWGNRNLLPREGGISLIKRGPGPYGGGARPPEKGAPTPPPARRPPPLQR

SEQ ID NO: 19745 - DNA, 701 bp, Zea mays
  misc_feature: Ceres CLONE 1387435-F
  misc_feature: Encodes the peptide sequence at SEQ ID NO. 19746
  misc_feature (326)..(326): n is a, c, t, g, unknown, or other
  misc_feature (380)..(380): n is a, c, t, g, unknown, or other
  misc_feature (381)..(381): n is a, c, t, g, unknown, or other
  misc_feature (403)..(403): n is a, c, t, g, unknown, or other
  misc_feature (416)..(416): n is a, c, t, g, unknown, or other
  misc_feature (423)..(423): n is a, c, t, g, unknown, or other
  misc_feature (426)..(426): n is a, c, t, g, unknown, or other
aagctggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcggtatgtgaaaacccaattcttcaccctacnagatccaacaggcaattgcagctggcatcttacctttatcacccttgtcctccnnacatcatcagccctattacagncagtacctttggntgcattnatngcacaaacatcagggcaacacactaacacaacttggggctaacaaacttgtgctgctacttctcaaaaaattagtttccttcatttcaaccaacaaactgggatggacctctcgttcttaattcgaaaaaaaaaaacatacatttcgcccgtttatttgtgggctaccccacaaaatttctttcctttaccacaagggaaaaattaaaacccccgggttttttttggggggaaaaacaataacctttcccccccttttgggggggccccccctcc

SEQ ID NO: 19746 - protein, 97 aa, Zea mays
  misc_feature: Ceres CLONE 1387435-F
  misc_feature (75)..(75): Xaa is any aa, unknown, or other
  misc_feature (82)..(82): Xaa is any aa, unknown, or other
  misc_feature (89)..(89): Xaa is any aa, unknown, or other
  misc_feature (90)..(90): Xaa is any aa, unknown, or other
MAAKIFCLLMLLGLSASAATATIFPQCSQAPIASLLPSYLSPAVSSVCENPILHPTRSNRQLQLASYLYHPCPPXIISPITXSTFGCIXXTNIRATH

SEQ ID NO: 19747 - DNA, 716 bp, Zea mays
  misc_feature: Ceres CLONE 1387437-F
  misc_feature: Translation starting site: 191
  misc_feature: Pfam Name: IGPS Pfam Description: Indole-3-glycerol phosphate synthase
  misc_feature (691)..(691): n is a, c, t, g, unknown, or other
cgcggtggcggccgctctagaatagtggatcccccgggctgcaggaattcgcacgagaccattacctagaacatcctaatcgaaaaaactaggagagtggtggaggaggagacccaccgtcggctcgcccgtgtcccgattcccactcacgacatcaacctgtccccatccatctcgcccgcgacgtttgatggagtctctcctcgcctcgcgatccattaggtcttccttctccgccgtcgccagcaccaggggcgccgcttcccccaggccctcgcgcgtcgccaccctcgccagcgccggcgccggcgcccgctcccgcgcgctccgtgctggccacacggactcaatccttgaggtgctggcacaggacgatatgctgaacgcaaaggagctggtccaatgggagaatggcttgtcattcaatgacatagcggctaggcaggggattcgcatccgcagacactgccgccccactgcctccttgaaaggagatagagaggagctgggagcccccctaacatcctagagaagatcatttgggacaaggagattgaagtagctgaggggcatgctaagaagccctctgaggaggtgattcaggctgcaacgaaagcccctccttcagagacttctatggcgctttagaaagctgctaacagcgtaatggggtgcctgcattgattgctgnagtcaagaagcatccccgaagtagg

SEQ ID NO: 19748 - DNA, 737 bp, Zea mays
  misc_feature: Ceres CLONE 1387438-F
  misc_feature: Translation starting site: 269
  misc_feature: SWISSPROT Homolog: EC 3.4.25.1 Proteasome endopeptidase complex
  misc_feature (610)..(610): n is a, c, t, g, unknown, or other
  misc_feature (654)..(654): n is a, c, t, g, unknown, or other
  misc_feature (658)..(658): n is a, c, t, g, unknown, or other
ggagctccccgcggtggcggccgctctagaactagtggatcccccgggctgcaggaattcgcacgagaccattacctagaacatcctaatcgaaaaacccttttcattttttcttccccatcttggagaagaagaaggcccgacgccctcgccgctgccaccaaaatcgcacgcgagccccaaagatccccaaaccctacacccgcccgccggcgcactcggggaccgtcgaatcgagcaggttgacggaggagaggaagcctcgaagatgttccggaaccagtacgacaccgacgtgacgacatggagcccccaggggcggctgttccaggtggagtacgccatggaggccgtcaagcagggctcagcctgcgtcgggctccggtccagcactcacgccgtcctcgccgccgtcaacaagcccgtctccgagctctcctcctaccagcggaagggtgtccgcgtcgctgaccacgcccgggtcgcgctcgccggcctcacccgcgacggccgcgttctctcgcgcttcctccgcacgagtgcatcaaccactccttcgtctacgaggcgccgctccccgtctccaggctcgcgctcaagctcgccgacnaggcgcaggtttgcacacagcggtcatggaagaggccctatggntgtnggcctccctagtgctggactggacgagtcaggggctcatctgtactacaactggcccagggggaactactttgagtact

SEQ ID NO: 19749 - DNA, 689 bp, Zea mays
  misc_feature: Ceres CLONE 1387446-F
  misc_feature: Encodes the peptide sequence at SEQ ID NO. 19750
  misc_feature (330)..(330): n is a, c, t, g, unknown, or other
  misc_feature (361)..(361): n is a, c, t, g, unknown, or other
  misc_feature (362)..(362): n is a, c, t, g, unknown, or other
  misc_feature (383)..(383): n is a, c, t, g, unknown, or other
  misc_feature (569)..(569): n is a, c, t, g, unknown, or other
cgcggtggcggccgctctagaactagtggatcccccgggctgcaggaattcgcacgagaccattacctagaacatccaatcgaaaaaactactccgtcactttgtttgtaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgaacgcgtcgcangcgctgacggtggcgacgctgttcccgctgnngcggctgctgctggtgctgtncgggctggcgctgacggcctccgtggtggggctgggccgtgccacgccggttgtcctgatcttcagccccgtgctggtccccgccgcgctgctcatcgggacgggcgtcatggggttcctcacgtcgggcgcgctggggcctcggggcctggtctcgctcacgtgccctcccaaaaccggggcggnaggcgttccagcgcaccccggactacctggagggagggccaccgcaagaatggcgaagccccggcgcacccgggcccaaagaccgggaagtaagccagggcatccaggcagggcgcaggg

SEQ ID NO: 19750 - protein, 166 aa, Zea mays
  misc_feature: Ceres CLONE 1387446-F
  misc_feature (44)..(159): Pfam Name: Oleosin Pfam Description: Oleosin
  misc_feature (47)..(47): Xaa is any aa, unknown, or other
  misc_feature (58)..(58): Xaa is any aa, unknown, or other
  misc_feature (65)..(65): Xaa is any aa, unknown, or other
  misc_feature (127)..(127): Xaa is any aa, unknown, or other
MADRDRSGIYGGAHATYGQQQQQGGGGRPMGEQVKGMLHDKGPNASXALTVATLFPLXRLLLVLXGLALTASVVGLGRATPVVLIFSPVLVPAALLIGTGVMGFLTSGALGPRGLVSLTCPPKTGAXGVPAHPGLPGGRATARMAKPRRTRAQRPGSKPGHPGRAQ

SEQ ID NO: 19751 - DNA, 733 bp, Zea mays
  misc_feature: Ceres CLONE 1387447-F
  misc_feature: Encodes the peptide sequence at SEQ ID NO. 19752
  misc_feature (573)..(573): n is a, c, t, g, unknown, or other
  misc_feature (618)..(618): n is a, c, t, g, unknown, or other
  misc_feature (619)..(619): n is a, c, t, g, unknown, or other
  misc_feature (657)..(657): n is a, c, t, g, unknown, or other
  misc_feature (658)..(658): n is a, c, t, g, unknown, or other
  misc_feature (699)..(699): n is a, c, t, g, unknown, or other
ggagctccccgcggtggcggccgctctagaactagtggatcccccgggctgcaggaattcgcacgagaccattacctagaacatcctaatcgaaaaacacacgcgggcgcgctagctagtgagagtcggagatgtcgtcgccgcggccacacttcctcgtgctcaccttccctttccagggccacatcgccccggctctccgcctcgccaggcagctgctcgcggcggcgcccgacgcgctcgtgaccttctccaccaccgaggtcgcgcacaggcgcatgttcccggcaaagcccaacgacggcgccaaggactccgacgaagacggccgcctcgagttcctcccgttctccgacggcacggaggccgggtacgtccggagcgccgacctgggctcgttcaacgcctacatgacgtctttccacgccgcgggggcgcgcagcgccgcggagatcgtggacgcgtcggccggcgcggggccgccccgtgtcccgcgtcgtgtacacgctgctccctcccgtggggcggcgacgtcgcgcggggaccgcgggatcccgtccgcgctctactggnatcagccgggtctccgtgggtcgcatctaccacactacttcacgnncaccgccggggtcgtcgccgacacctcacgacccgtcnnttcgtcgtggagatgccgggctggcgccacagccggtcggngaactgggcgtcttctcacgactcacgacccctt

SEQ ID NO: 19752 - protein, 200 aa, Zea mays
  misc_feature: Ceres CLONE 1387447-F
  misc_feature (148)..(148): Xaa is any aa, unknown, or other
  misc_feature (163)..(163): Xaa is any aa, unknown, or other
  misc_feature (176)..(176): Xaa is any aa, unknown, or other
  misc_feature (190)..(190): Xaa is any aa, unknown, or other
MSSPRPHFLVLTFPFQGHIAPALRLARQLLAAAPDALVTFSTTEVAHRRMFPAKPNDGAKDSDEDGRLEFLPFSDGTEAGYVRSADLGSFNAYMTSFHAAGARSAAEIVDASAGAGPPRVPRRVHAAPSRGAATSRGDRGIPSALYWXQPGLRGSHLPHYFTXTAGVVADTSRPVXSSWRCRAGATAGRXTGRLLTTHDP

SEQ ID NO: 19753 - DNA, 704 bp, Zea mays
  misc_feature: Ceres CLONE 1387448-F
  misc_feature: Encodes the peptide sequence at SEQ ID NO. 19754
  misc_feature (479)..(479): n is a, c, t, g, unknown, or other
  misc_feature (549)..(549): n is a, c, t, g, unknown, or other
  misc_feature (650)..(650): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccggnaggggcgagtgccggcgccagtgcctgcgccgccacgagggcccagcgtgggagaccccagagtgcatgnagcggtgccgccgcgcggactggccgtcgaatggagcaagagtacggtcgcggcagcgagagcgcggcagtgccggggagaggtggagcgccacaccgcgngactggtggaagcaccgtgtnnnnnnnnnnnnnnnnnnnnnnnnnnnnnnnnna

SEQ ID NO: 19754 - protein, 156 aa, Zea mays
  misc_feature: Ceres CLONE 1387448-F
  misc_feature (116)..(116): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGPAWETPECMXRCRRADWPSNGARVRSRQRERGSAGERWSATPRDWWKHRV

SEQ ID NO: 19755 - DNA, 687 bp, Zea mays
  misc_feature: Ceres CLONE 1387449-F
  misc_feature: Translation starting site: 278
  misc_feature (385)..(385): n is a, c, t, g, unknown, or other
  misc_feature (403)..(403): n is a, c, t, g, unknown, or other
  misc_feature (404)..(404): n is a, c, t, g, unknown, or other
tggagctccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggactagctggnttaaaaaagagggtatgnntccttaccaaaaggacaaagggactgggcggtccaaaaatttgaatatacaggggacaaagttactaatgaaaccaaagggtgatgcaacagtcacctatgagggatcacatgctgcttcagctgctgggggatgggtcgatacaaggatttccatgggagcactattcaggttcacatagctgagtcaaaaagcaagatgcattcgataacccacagtttgacatcattggtggtggtggtgaacaagatgactggataatggaccagcaaaggcagaggcg

SEQ ID NO: 19756 - DNA, 729 bp, Zea mays
  misc_feature: Ceres CLONE 1387460-F
  misc_feature: Encodes the peptide sequence at SEQ ID NO. 19757
  misc_feature (371)..(371): n is a, c, t, g, unknown, or other
tggagctccccgcggtggcggccgctctagaactagtggatcccccgggctgcaggaattcgcacgagaccattacctagaacatcctaatcgaaaattcgggatcgggacgcggagaggggaaaggcgagtcgtcgactcgtcgtccgggcagcttccctccctctcctctccgcccccgcttacctaggccggccccgcctacgcccccctcccgccgccgcacgatgagcacttctcccgccgccgccgacgtttcgcctttgccgcctactgctgccgccgacgaggccgcgcgggcgacagagacggtggtggtcgatgagagggtcgcctcacacgtggacccgttcctcgtcgaggggctcgancaccctcgcgacggtctatggttctacggatgggactggaattacaaaaacttattgcggaaccctcggtgggcgggggttggaattccaaaaatttccggaattttaacctcccggggggggggccacggggggggccacattttggggtttagagtcattatgggccaaatttttttaaaagggcgccctttccgggggttggggggaaaaaaaacaaaaaggggcggtccgccttttttttttttcggggccctcccccccccaaaaaaagggtcttcacccgcggggaaattttttttttttttttttttggccccgcgcccttcttggggggggcgggtttttataaagaggg

SEQ ID NO: 19757 - protein, 45 aa, Zea mays
  misc_feature: Ceres CLONE 1387460-F
MVLRMGLELQKLIAEPSVGGGWNSKNFRNFNLPGGGPRGGPHFGV

SEQ ID NO: 19758 - DNA, 657 bp, Zea mays
  misc_feature: Ceres CLONE 1387462-F
  misc_feature: Encodes the peptide sequence at SEQ ID NO. 19759
gctctagaactagtggatcccccgggctgcaggaattcgcacgagaccattacctagaacatcctaatcgaaaaggggagtgtgcagcagtatgttctcggtctcgccatcgcatctcgcagagtagacactcaaatccgattgtcgagggggagaaggtggagatcgttgtaacggctagttgcgtcggcccgatggacccgtcgtaccatggcggcggcgccgccggtggaagcgccgacgaccatggccaaattctttgggattggacggaacagcattgtgaacctaacgattcaagtcatgatgctactaaatttgtgtgggattgcctcaatcaagatgacaatgagctgttgggattgcttggaaatcaaaccccattgagatactgccgtgatttcttcgctgaccttgatgatatcacatgcaaggagaccctggacctggaggaatctcgggaatcaaagcggcggcgcacatttggagtaccctttggagtctagtcagtcagaagttgggactcatgaaaccggttcacctttcgtcacacctgaggtagcagaaatttcattggtctgcactgataaaccacagaggcttaatttgggatgaagcacccctacaggaaggaagatatccttttggaacattgct

SEQ ID NO: 19759 - protein, 103 aa, Zea mays
  misc_feature: Ceres CLONE 1387462-F
MDPSYHGGGAAGGSADDHGQILWDWTEQHCEPNDSSHDATKFVWDCLNQDDNELLGLLGNQTPLRYCRDFFADLDDITCKETLDLEESRESKRRRTFGVPFGV

SEQ ID NO: 19760 - DNA, 732 bp, Zea mays
  misc_feature: Ceres CLONE 1387465-F
  misc_feature: Encodes the peptide sequence at SEQ ID NO. 19761
  misc_feature (512)..(512): n is a, c, t, g, unknown, or other
  misc_feature (557)..(557): n is a, c, t, g, unknown, or other
  misc_feature (644)..(644): n is a, c, t, g, unknown, or other
  misc_feature (699)..(699): n is a, c, t, g, unknown, or other
  misc_feature (704)..(704): n is a, c, t, g, unknown, or other
  misc_feature (705)..(705): n is a, c, t, g, unknown, or other
ggagctccccgcggtggcggccgctctagaactagtggatcccccgggctgcaggaattcgcacgagaccattacctagaacatcctaatcgaaaatcatttttctctctcctgcgccgcgacgtccctcgccttcgccgccgaatccgagactccgatctcgggttcaccgcagcgcacagagcagccccgactcccggcccgatccgcgctctcctctccgtcgcttcagtcatggcaggaatggcacctgagggttctcagttcgatgctaagcactatgattctaagatgcaggagctgctgagcactggtgagactgaggagttcttcacttcatatgatgaagtttttgagagttttgatgatatgggcctccaagagaatcttctgagaggcatttatgcttatggttttgagaagccctctgcaattcagcagagaggaattgttcccttctggcagggtcttgatgtcattcagcaagcacaatctggtacaggaaagacagncaccttctggtctgggatcttgcagcagctggactatgggctggntgaatgccagcccctggtccttttgctccaccgtgagcttgcacagcaaattgagaaagcatgcgagcgcttggtgattaccttggntgtaggtccatgcatgtgtgggaggaacatccgtccgtgaggaccaaggattctngcagnngtgtgcatggtgttgttgaacccctgg

SEQ ID NO: 19761 - protein, 149 aa, Zea mays
  misc_feature: Ceres CLONE 1387465-F
  misc_feature (93)..(93): Xaa is any aa, unknown, or other
  misc_feature (108)..(108): Xaa is any aa, unknown, or other
  misc_feature (137)..(137): Xaa is any aa, unknown, or other
MAGMAPEGSQFDAKHYDSKMQELLSTGETEEFFTSYDEVFESFDDMGLQENLLRGIYAYGFEKPSAIQQRGIVPFWQGLDVIQQAQSGTGKTXTFWSGILQQLDYGLXECQPLVLLLHRELAQQIEKACERLVITLXVGPCMCGRNIRP

SEQ ID NO: 19762 - DNA, 595 bp, Zea mays
  misc_feature: Ceres CLONE 1387466-F
  misc_feature: Translation starting site: 87
cgctctagaactagtggatcccccgggctgcaggaattcgcacgagaccattacctagaacatcctaatcgaaaaattcggcgactatggcggcggcaccggcaggcggcggccctcgggcattgtcccagcgggagcaggacatccagatgatgctcgccgccgatgtccacctcggcaccaagaactgcgacttccaggtggagcgctacgtgtacaagcgcccgcactggatggtatctacattattaaccttggaaagacctgggacaggcttcagttggccgccaggggtcatcggtgccattggagaatccgcaggacattatccgggaagtcctgctagggccctatgggcgggggggggtgggcccccaaagtttgggccaaaaaaccttggggggccccatggccattggctggggaaggacacccccccctggggaaacgttcccccccaacccaggggttggaaaacaccctcccttttcaagggggggccccccggcccctttttttttagcccgaggaggggggccccccggaggggggcttggtttctcccccccccccccccctttttaagggggggggg

SEQ ID NO: 19763 - DNA, 740 bp, Zea mays
  misc_feature: Ceres CLONE 1387468-F
  misc_feature: Encodes the peptide sequence at SEQ ID NO. 19764
  misc_feature (471)..(471): n is a, c, t, g, unknown, or other
  misc_feature (700)..(700): n is a, c, t, g, unknown, or other
  misc_feature (701)..(701): n is a, c, t, g, unknown, or other
  misc_feature (712)..(712): n is a, c, t, g, unknown, or other
ggagctccccgcggtggcggccgctctagaactagtggatcccccgggctgcaggaattcgcacgagaccattacctagaacatcctaatcgaaaaataaatccaattgttccttaaaattacgactcgcacccacggacccaccaaccacgccgccgccggccggccacctttctccattctccgtcaatcgtcatcctatccgatccccaactaggcaactactccgtctcacgcctctcctgtcccctctcgccgctctcgccccgcctctgcctccgcctccgcctcctccatcgcacccagctttcctccccaccccaccgccactcctaccccgccacgtcgtgtagtcgcggcggcggatatgcaagccgccgccgccttcaaccaggcagccttcaccgtccgctcgctgcatcgccccccgaggcccctccatctagctgttgcggaggatgcttttgcggngataagaggcgcgccccttacacggccccggtgctgcgggagcctctctgtcggcgtcggcagctacgacagcgagcacactccagtatttccaagaacacaatcatgggatccctacaagctttcttgggtgtgatcaagatgcatctgaagaaagaggtccggagtgcacgggattttcttctaaaaacatacgccggatatgaagaaagtgaaagaggcattgaanngtgctatgacnagatataaatgatagctacacagaccga

SEQ ID NO: 19764 - protein, 79 aa, Zea mays
  misc_feature: Ceres CLONE 1387468-F
  misc_feature (35)..(35): Xaa is any aa, unknown, or other
MQAAAAFNQAAFTVRSLHRPPRPLHLAVAEDAFAXIRGAPLTRPRCCGSLSVGVGSYDSEHTPVFPRTQSWDPYKLSWV

SEQ ID NO: 19765 - DNA, 695 bp, Zea mays
  misc_feature: Ceres CLONE 1387469-F
  misc_feature: Translation starting site: 187
  misc_feature (676)..(676): n is a, c, t, g, unknown, or other
tccccgcggtggcggccgctctagaactagtggatcccccgggctgcaggaattcgcacgagaccatacctagaacatcctaatcggaactccaaagtttcgtccaccatttcgctcccgcaagcaccgatttgtttactgctctctccgacgcgcggcggcggagctccctacgacgactgaaccatgtgcggcggcgcgatccttgccaaccttcgcgagccggcgccgcgccggctcacagagcgggacatctggcagcagaaaaagaagctcaagaggggcggcggcggcgggaggcgctcgttcgcggcggaggacgatgaggacttcgaggccgactttgaggtcttcgaggccgactccagtgattcagatttggagctcagggaggggactgacgacgacgtcgtcgagatcaagcccttcactgccaagaggactttctccagcgatggcttaagcaccatgactagtgctgtagcaaggtcagcccagaggaagagaaagatctatacaggggtatccgccagcggccttggggcaagtgggctgctgagatcagagatcctcagaagggtggtcgtgtttggcttggtacttttcatagtcctgaggaagctgacagagcttatgatgccgaagcgcgcaggattcgtggcaagaaggccagggntacttttctgatgcaccag

SEQ ID NO: 19766 - DNA, 700 bp, Zea mays
  misc_feature: Ceres CLONE 1387471-F
  misc_feature: Encodes the peptide sequence at SEQ ID NO. 19767
aagctggagctccccgcggtggcggccgctctagaactagtggatcccccgggctgcaggaattcgcacgagaccattacctagaacatcctaatcgaaaaccccgccctccgaagtccgaaggccagaagcttccggaagccagcccaagccatgaacgccgccagcaccgccgccgcggcccccgcgcctgccgcgaccgtgcaggtcccgcgcgggcaggtggatctgatcgacttcatcgactggaccggcgtcgagtgcctcaaccaggactcgtcccacagcatcgtcaacgcgctcaagcagagtttgagagacgacgaggggctgtacctcgccagcgattcggacgagcagctgctgatctacatcccctgcatgcaggtaggccaactggcatccggggttatccaaggtccggaggaaaagggcccaaaacaggaaactcttctcaaacaaaagatatagggtttcccaagggcaggactttcccccagggggccccccgggttttctccagatttttgaaaaaaaaaaacttttccccaaaagatggggaaggttcaaagggggcccgcctctgtattttttttgggcgccccccaggggggggggggccccaaaaacccaaaattttttttttggagacgggggggcccccaaaaatgaggtgtctaaaaaaaaaaaaaacccccca

SEQ ID NO: 19767 - protein, 105 aa, Zea mays
  misc_feature: Ceres CLONE 1387471-F
MNAASTAAAAPAPAATVQVPRGQVDLIDFIDWTGVECLNQDSSHSIVNALKQSLRDDEGLYLASDSDEQLLIYIPCMQVGQLASGVIQGPEEKGPKQETLLKQKI

SEQ ID NO: 19768 - DNA, 678 bp, Zea mays
  misc_feature: Ceres CLONE 1387472-F
  misc_feature: Encodes the peptide sequence at SEQ ID NO. 19769
  misc_feature (440)..(440): n is a, c, t, g, unknown, or other
  misc_feature (544)..(544): n is a, c, t, g, unknown, or other
  misc_feature (616)..(616): n is a, c, t, g, unknown, or other
tggagctccccgcggtggcggccgctctagaactagtggatcccccgggctgcaggaattcgcacgagaccattacctagaacatcctaatcgaaaaaattgaaaacagggccttggtcgagttaaaaaaaacgcgagtgaaacacactgacaccgcaaacacgccaaccggcctaccgccttcttctcttgtctcgtcctcctcgcgactatggccgccgccgccgaggtagaccccagccccaacccgccgccaactacagcctccggcctctccaagaccaagacgcgggaggccgaccgccgccgacgccgccgcagcaaggccaagaagaacaagtccgtcactgaggctgatgcccaggacgctgacgggggagcttccagctccgacgccaaggagaacgccgatcccaaccccgaggcacagggtgaggtgnagatagagtacgtgccggagagggccgagcttgacgaccctctcctggatgatttcaggccatcttcgagaaagtcaccttcagggacgctgctggcagcgcgnccgaggatgataataaagacgaggggtgcgctgatgccacaaagaaggggtccctggatgatgatgaccacnacaaaaatgatgagcaggaggcaaacaagagaaggacggaggcctaatccaataggaggaga

SEQ ID NO: 19769 - protein, 155 aa, Zea mays
  misc_feature: Ceres CLONE 1387472-F
  misc_feature (77)..(77): Xaa is any aa, unknown, or other
MAAAAEVDPSPNPPPTTASGLSKTKTREADRRRRRRSKAKKNKSVTEADAQDADGGASSSDAKENADPNPEAQGEVXIEYVPERAELDDPLLDDFRPSSRKSPSGTLLAARPRMIIKTRGALMPQRRGPWMMMTTTKMMSRRQTREGRRPNPIGG

SEQ ID NO: 19770 - DNA, 784 bp, Zea mays
  misc_feature: Ceres CLONE 1387473-F
tggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgcccaagctacacacgggatgctactaactatctgcaggcaaggccgaggaatggcaagcctttcatgtgctcgggcggacagtgttgtccgttccggcgctctgccccccaagctgttgctgtgcccccgctgctgctttcctaacgcggctcccatccccgaacggagaagtgccaagtgctttgccttgccaccaacaattctccaacgatttggccgaaggtttaaagaatctccgttcggcaagcggcccccagacatctccccatccctccagtttggtcgggccctcccccaaacaatcccggggaaccccccgcgcctttgtaaattgtcccaggggccccggttccacacctccagggccctccgtttttcctaaaccgggggccgcccctaaaaacccctctccgcaccctcaacccaccataaaaattcccccctggaaaaacaactcacaatttctcaacatgtgtgcgccggtaatgcaactctcccctgg

SEQ ID NO: 19771 - DNA, 732 bp, Zea mays
  misc_feature: Ceres CLONE 1387476-F
  misc_feature: Encodes the peptide sequence at SEQ ID NO. 19772
  misc_feature (607)..(607): n is a, c, t, g, unknown, or other
tccccgcggtggcggccgctctagaactagtggatcccccgggctgcaggaattcgcacgagaccattacctagaacatcctaatcgaaaaattcccctcccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcggcgccggcgcggagaaggttaagctggagaacaagacatggaaaatcgatactggaacaaggacatttgagatagaattggcgatgttgtcaagtgctcaccatgtggagatgacccccagtgatgctggctttcaggacaggtatgttgttcaggaggtcatcaaagagatggcgaagaacaggcccattgatgccaaagggcagagagcatttaaagtccttggtgtaaatgaggtcgacnagctctcacgagaagcccagcatcccctccgcaggactatgggaaagtatagctcatcatgtagactgatcctatgctgtacagctcctcaaagtgacagaaagctgtagatcccgttgcttaaa

SEQ ID NO: 19772 - protein, 176 aa, Zea mays
  misc_feature: Ceres CLONE 1387476-F
  misc_feature: SWISSPROT Homolog: EC 2.1.2.11 3-methyl-2-oxobutanoate hydroxymethyltransferase
  misc_feature (141)..(141): Xaa is any aa, unknown, or other
MLWVDKYRPKTLDKVTVHDQVAQNLRKFVSEQDCPHLLFYGPSGSGKKTLILALIKQMFGAGAEKVKLENKTWKIDTGTRTFEIELAMLSSAHHVEMTPSDAGFQDRYVVQEVIKEMAKNRPIDAKGQRAFKVLGVNEVDXLSREAQHPLRRTMGKYSSSCRLILCCTAPQSDRKL

SEQ ID NO: 19773 - DNA, 745 bp, Zea mays
  misc_feature: Ceres CLONE 1387477-F
  misc_feature: Encodes the peptide sequence at SEQ ID NO. 19774
  misc_feature (335)..(335): n is a, c, t, g, unknown, or other
  misc_feature (354)..(354): n is a, c, t, g, unknown, or other
  misc_feature (406)..(406): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
ctccccgcggtggcggccgctctagaactagtggatcccccgggctgcaggaattcgcacgagaccattacctagaacatcctaatcgaaaaatctacctcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccctttcgcggntcgatgctggtgctgtccnggctgatcctggccgggcacgtgatcgcgctcacggtggcacccccgtgctngtatctcacgnnnntttnnngggggccccgccccccatcgggttggggtttatgggggggccggggttcctcccctcccgggggcctcgggggtccctggggttgcccgggtcctcccgggatggcaaagtacccggagggggaaacacccggccgggggccgacccacttggaccacggcaaggggggagggggggggccagggccccgggatttaagggatggcgcaagccccgcctcgaccaggggggggggggggcttggaaaaaaaaacaccactggggggggccgggggggggggccttcttggaaccagggggggggggggggtttggggcc

SEQ ID NO: 19774 - protein, 188 aa, Zea mays
  misc_feature: Ceres CLONE 1387477-F
  misc_feature (52)..(52): Xaa is any aa, unknown, or other
  misc_feature (58)..(58): Xaa is any aa, unknown, or other
  misc_feature (79)..(79): Xaa is any aa, unknown, or other
  misc_feature (80)..(80): Xaa is any aa, unknown, or other
  misc_feature (81)..(81): Xaa is any aa, unknown, or other
  misc_feature (82)..(82): Xaa is any aa, unknown, or other
MADHHRGATGGGGGYGDLQRGGGMHGEAQQQQKQGAMMTALKAATAATLSRXDAGAVXADPGRARDRAHGGTPVLVSHXXXXGAPPPIGLGFMGGPGFLPSRGPRGSLGLPGSSRDGKVPGGGNTRPGADPLGPRQGGRGGARAPGFKGWRKPRLDQGGGGAWKKKHHWGGPGGGAFLEPGGGGGFGA

SEQ ID NO: 19775 - DNA, 706 bp, Zea mays
  misc_feature: Ceres CLONE 1387478-F
ctccccgcggtggcggccgctctagaactagtggatcccccgggctgcaggaattcgcacgagaccattacctagaacatcctaatcgaaaaatctccatcactggtacttcagatcattatcttgatctactccagagtgtacaagaacccgatcgacaccatgagggtgttgctcgatgacctctctctcttggctctcgctgcgagagccacctccacgcatacaagcagaggctgaggatgccaaccaccgccgccgtctcatctaccgtcgccgtcgcatatgccacctccggatcagctgccatctccggagcatctccgaccgccggtgcaactgtcgccgtccggtcacctgcccccgccggtggtgtgacggtcgctggtcatctggcgacgtcaccatgacagtacactagtcaatcgcctcgacctcagcctcatacccatacatactcatgcccgtagaaaaaatcgtatcaatgcccgtgccacctgcagggaaactgcgccgttagcaccatcacaatactgcttagtgggtccaggtcgtgaggcatagtgtagtcagacggtgagaccctactgctcgcctcagtgacatacgtaccgcttttacggttccacaatgtcaagcacgtgtgaccaccgaagcgtgacagagtaatcttctgttttgggcatcatgctatactgcaatagca

SEQ ID NO: 19776 - DNA, 670 bp, Zea mays
  misc_feature: Ceres CLONE 1387480-F
  misc_feature: Encodes the peptide sequence at SEQ ID NO. 19777
  misc_feature (670)..(670): n is a, c, t, g, unknown, or other
cttgaacaggtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcaccggcggggtcgcggtgcgggcgtcgctgttctcgcccaagcccgcggggggcaaggacgcgcggccgaccaaggtgcaggagctgtacgtgtacgagatcaacgagcgggaccgcgagagccccgcgtacctgcgcctcagcgccgagcagacggagaacgcgctgggggggatctggtccccttcaccaacaagggtgtacaacggcagccctggacaaggggggtggggcgtcaccggcgggggaatctggcggggtcatcccaggacggtccccgacccggaacgggggaccggctagggaggccgtctgacagctttctacttcggaagan

SEQ ID NO: 19777 - protein, 140 aa, Zea mays
  misc_feature: Ceres CLONE 1387480-F
  misc_feature: SWISSPROT Homolog: EC 5.3.99.6 Allene-oxide cyclase
MAAALRCPASVRVSGPAAAGLAKVRQASRVVAVSGARQSRTGGVAVRASLFSPKPAGGKDARPTKVQELYVYEINERDRESPAYLRLSAEQTENALGGIWSPSPTRVYNGSPGQGGWGVTGGGIWRGHPRTVPDPERGTG

SEQ ID NO: 19778 - DNA, 684 bp, Zea mays
  misc_feature: Ceres CLONE 1387486-F
  misc_feature (566)..(566): n is a, c, t, g, unknown, or other
  misc_feature (590)..(590): n is a, c, t, g, unknown, or other
  misc_feature (600)..(600): n is a, c, t, g, unknown, or other
  misc_feature (684)..(684): n is a, c, t, g, unknown, or other
tggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgcccccgcggcgcgggcggcgcggttcgcgtgcaacgccacggcggcgcgagcgtccacgtgccaggcgctcgtctcctacgcgccgcccaacgggacggccacgcccacgctggccgccgtgcgggcgctctttcagctccgctcccnagcgcgcgctgctgggcggcaaangggctcccgnttctcacgccggcccaggggggcccgcgcccggtgccgctgcgggtcccgcctggcctggcttctgctcgggggggcgcccggn

SEQ ID NO: 19779 - DNA, 666 bp, Zea mays
  misc_feature: Ceres CLONE 1387491-F
  misc_feature (374)..(374): n is a, c, t, g, unknown, or other
  misc_feature (439)..(439): n is a, c, t, g, unknown, or other
  misc_feature (513)..(513): n is a, c, t, g, unknown, or other
  misc_feature (514)..(514): n is a, c, t, g, unknown, or other
  misc_feature (531)..(531): n is a, c, t, g, unknown, or other
  misc_feature (570)..(570): n is a, c, t, g, unknown, or other
  misc_feature (586)..(586): n is a, c, t, g, unknown, or other
tccccgcggtggcggccgctctagaactagtggatcccccgggctgcaggaattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctgntgctcaacctcatcatgtacatcatcgtcatcggcttcgcgagctggaacctgaaccacttcatncacgggcagaccaactaccccccggcgtgccggcaaacgcgcgacgttctacttccctggtgtcgccatcctgnnccggcgtgtgggcgcgncgtccaagctggcgggcgtgcaccacgtgcgcgcctggncgcacgacagcctggncaccaacggcgcgtcgtcgctcatcgcctggggcatcacggcgctcggcttcgggctggcctgcaaggagatcacatcgg

SEQ ID NO: 19780 - DNA, 689 bp, Zea mays
  misc_feature: Ceres CLONE 1387492-F
  misc_feature: Translation starting site: 213
  misc_feature (420)..(420): n is a, c, t, g, unknown, or other
  misc_feature (457)..(457): n is a, c, t, g, unknown, or other
  misc_feature (459)..(459): n is a, c, t, g, unknown, or other
  misc_feature (525)..(525): n is a, c, t, g, unknown, or other
  misc_feature (566)..(566): n is a, c, t, g, unknown, or other
  misc_feature (571)..(571): n is a, c, t, g, unknown, or other
tggagctccccgcggtggcggccgctctagaactagtggatcccccgggctgcaggaattcgcacgagaccattacctagaacatcctaatcgaaaacagctccgcctccctttcctaccttcttccctccgtctcccagctcgcgcaggcaggcgacacagcgacgctaaaaaccctagagcgaggaggcgtgccaggccagcggtttgcgatgacggcaccggcggacaaggggaagaaggccaagaccgatgccgacggcggcgaggagaacgagcaaatcgacggcgcccttgtcttctccatcgagaagctccaggagattcaggacgagctcgagaaggttaatgaggaagcaagtgacaaggttatggaggtggagcagaaatacagtggagattcgcagacctgtctatctncagaggggtgacattatcaagaccatcccggactttngnctcacagcgtttttgagccatcctctactaagtgagctttctgactgagaggatcagaagatattncagtacttggactccattgatgtcgatgattctgatgtaanggcangatattccatttacctaaacttctcttgagacccgtactttgaagaccaaagcttacaaagacctattcctttgttgatgatgggaccaacacaataaagcttctccaattaagggga

SEQ ID NO: 19781 - DNA, 670 bp, Zea mays
  misc_feature: Ceres CLONE 1387493-F
  misc_feature: Translation starting site: 337
  misc_feature: SWISSPROT Homolog: EC 3.1.3.16 Phosphoprotein phosphatase
  misc_feature (308)..(308): n is a, c, t, g, unknown, or other
tccccgcggtggcggccgctctagaactagtggatcccccgggctgcaggaattcgcacgagaccattacctagaacatcctaatcgaaaaaaaagatcgcgaagcgagagggaatgatggaggcataggcactagcacctcctcgcctccacctccgtcctcttcgatcccgtccaatcccccgcgccccggcgcccctctccgccggcggctttgctgggtcccgcgctcctcctcctcctaggctgttctggttggggctgcggcggagggaactaggtaaggggaaggaaaggggaggtttganggagagcgcagcggcagcggcagcagcgatgccatcgcacgcggatctggacccgcagatctcgcagctgcgggattgcaaagtcctgcctgaggcggaggtcaaaacgctatgcgagcaggccaaggcgatcctcatggaggagtgggacgtgcagcccgtgcgctgccccgtcactgtctgcggcgacatccacggcaggtctacgacctcatcgagctctttcccatcggtgggggacgcgcccgacaccactacctctttatgggggactacgtcgaccgtggctactactcaggggaaactggtgtccttattgggggctctaaaaggacgtatagagacagaatcccaatattggg

SEQ ID NO: 19782 - DNA, 704 bp, Zea mays
  misc_feature: Ceres CLONE 1387496-F
  misc_feature: SWISSPROT Homolog: EC 4.2.1.20 Tryptophan synthase
tccccgcggtggcggccgctctagaactagtggatcccccgggctgcaggaattcgcacgagaccattacctagaacatcctaatcgaaaaataaaaaaaactgagcctgcccgcccgcccgcccgcgcgctccgctccgtgaactatatctatctatcacctgctgctccaaggaggcggacagaggcaggcaggaaggcactcacttctccaggagcccggagtcggcagcaagagagaatggccgccgacgccgccgccgccgccacccttcgtactgctctctcccaaggtctggtgctgtggcatgtttagtgcaatcttcattgcttgctgtcttgctgcatttaacacagcacgagcttcagagaatagtccaagcctatctgtgttgccaagagatctcatccaaggtttacggcaatgaaccatttctaaagcacaaagacgtgatgtctttatcaattcatcaggagagcaaatggcgtcaacaggagggtcaccgacgagcggttcgtcgacatacccgaggaggtcatcgacgtgtacaagctctggcgcccgacgcccctgatcaagcccaggaggctgaaaaagctgctcggcaccccggcgaagatctactacaagtacgaggggacagcccgggggggtcgcacaagcccaaaacgccgtgccgcaggggtgtacaaacgcgcggggg

SEQ ID NO: 19783 - DNA, 726 bp, Zea mays
  misc_feature: Ceres CLONE 1387497-F
  misc_feature: Encodes the peptide sequence at SEQ ID NO. 19784
  misc_feature (308)..(308): n is a, c, t, g, unknown, or other
  misc_feature (481)..(481): n is a, c, t, g, unknown, or other
  misc_feature (496)..(496): n is a, c, t, g, unknown, or other
  misc_feature (497)..(497): n is a, c, t, g, unknown, or other
  misc_feature (509)..(509): n is a, c, t, g, unknown, or other
aaactggagctccccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgancgcgctcaaggccgcgacggccgcgaccttcggcgggtcgatgctggtgctgtccgggctgatcctggccggcaccgtgatcgcgctcacggtggccacccccgtgctggtgatcttcaccggggcttgggggggccggccgccatcgcgctggggctcatgggggggccggnttcgtcaccttcggnnggcctcggcgtncgctgggcttggccgtgttcctctgggatggacaggtacctggaggggcaaggaccccgccggggggccgaccagctggaacaacgccagggggagggttgggggtcaagggcccgcgaatttcagggatggaggacaggaccgcatcgaccaaggggcaggggggttttgaaaaaaaaaaccccacttcgaggggaccggcggggggggaactcct

SEQ ID NO: 19784 - protein, 162 aa, Zea mays
  misc_feature: Ceres CLONE 1387497-F
  misc_feature (36)..(154): Pfam Name: Oleosin Pfam Description: Oleosin
  misc_feature (39)..(39): Xaa is any aa, unknown, or other
  misc_feature (97)..(97): Xaa is any aa, unknown, or other
  misc_feature (102)..(102): Xaa is any aa, unknown, or other
  misc_feature (106)..(106): Xaa is any aa, unknown, or other
MADHHRGATGGGGGYGDLQRGGGMHGEAQQQQKQGAMMXALKAATAATFGGSMLVLSGLILAGTVIALTVATPVLVIFTGAWGGRPPSRWGSWGGRXRHLRXASAXAGLGRVPLGWTGTWRGKDPAGGPTSWNNARGRVGGQGPANFRDGGQDRIDQGAGGF

SEQ ID NO: 19785 - DNA, 634 bp, Zea mays
  misc_feature: Ceres CLONE 1387500-F
  misc_feature (326)..(326): n is a, c, t, g, unknown, or other
tccccgcggtggcggccgctctagaactagtggatcccccgggctgcaggaattcgcacgagaccattacctagaacatcctaatccaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccacccgcgccggttcatctaccgccgccggtgcatctggcacctccggttcacctgccacctccggtgcatctcccnacgccggtccacctgccgcccgcgggccacctggcaccgcggggcatgtgcccccgccggttcatctgccgccgcccacatggcactaccctattcaaccggccggggctcaagctcttcccaggcacaccaatgcccgtgccaacaagcgaaatccagccccgggccaagtgaagggaacctggggggtttgcaaaacccccaatcttggggccagggttcaagtttctaaaggaattaggggaccccaagggggaccccctattggtctccctaaaggccaaactttgggcggaaaagggtttccc

SEQ ID NO: 19786 - DNA, 709 bp, Zea mays
  misc_feature: Ceres CLONE 1387503-F
  misc_feature: Encodes the peptide sequence at SEQ ID NO. 19787
  misc_feature (380)..(380): n is a, c, t, g, unknown, or other
  misc_feature (393)..(393): n is a, c, t, g, unknown, or other
  misc_feature (431)..(431): n is a, c, t, g, unknown, or other
  misc_feature (479)..(479): n is a, c, t, g, unknown, or other
  misc_feature (480)..(480): n is a, c, t, g, unknown, or other
  misc_feature (494)..(494): n is a, c, t, g, unknown, or other
  misc_feature (550)..(550): n is a, c, t, g, unknown, or other
  misc_feature (601)..(601): n is a, c, t, g, unknown, or other
  misc_feature (626)..(626): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcgnaagagggaatgcnagagcgagtgccgcgagcggcaccagcaagctgacgcnggcgaggacggcgacagcggcgtggacgcctacgtctcccgctccggnnagggcgagtgccgncgccagtgcctgcgcccgcacgagggccagccgtgggagaccccagagtgcatgangcggtgccgccgccgcggactggccgtcacatggagcaagagtacggtcgncgcagcgagaagcgcggcagtgccngggagagtgcgagcgcaccacccgcgggactggtggagagcacctctaggaaaaaaaaannnggggggggggggggaggaaaa

SEQ ID NO: 19787 - protein, 168 aa, Zea mays
  misc_feature: Ceres CLONE 1387503-F
  misc_feature (64)..(64): Xaa is any aa, unknown, or other
  misc_feature (93)..(93): Xaa is any aa, unknown, or other
  misc_feature (116)..(116): Xaa is any aa, unknown, or other
  misc_feature (133)..(133): Xaa is any aa, unknown, or other
  misc_feature (161)..(161): Xaa is any aa, unknown, or other
  misc_feature (162)..(162): Xaa is any aa, unknown, or other
MGKGSVGASWWAFLLLAGVLLVVAATAGAEDGVVERDRKEDLRWCKQACEWQYGKDTPRKRECXSECRERHQQADAGEDGDSGVDAYVSRSGXGECRRQCLRPHEGQPWETPECMXRCRRRGLAVTWSKSTVXAARSAAVPGRVRAHHPRDWWRAPLGKKXXGGGGEE

SEQ ID NO: 19788 - DNA, 699 bp, Zea mays
  misc_feature: Ceres CLONE 1387505-F
  misc_feature: Encodes the peptide sequence at SEQ ID NO. 19789
  misc_feature (451)..(451): n is a, c, t, g, unknown, or other
  misc_feature (452)..(452): n is a, c, t, g, unknown, or other
  misc_feature (454)..(454): n is a, c, t, g, unknown, or other
  misc_feature (455)..(455): n is a, c, t, g, unknown, or other
  misc_feature (594)..(594): n is a, c, t, g, unknown, or other
  misc_feature (654)..(654): n is a, c, t, g, unknown, or other
tccccgcggtggcggccgctctagaactagtggatcccccgggctgcaggaattcgcacgagaccattacctagaacatcctaatcgaaaaattaaacatactcgcactccagctccccatttctctcctcccctccccttccctaatcatctcagcgaatccaatcgaggcgatggaccagcagggtgcgggcggggacgcggaggtgccggcggggctgggtctgacggcggcggagtacgagcagctgcggtcgacggtggacgcgcaccaccgctacgccgtgggggagggtcaatgctcctcgctgctggcgcagcgcatccacgcgccgccggaggccgtctgggccgtcgtccgccgcttcgactgcccgcaggtgtacaagcacttcatccggagctgcgcgctccgcccagaccccgaagccggcgacgccctctgcccggnncnngctcgcgaggtcagcgtcatctcggggctgcccgctagcaccagcaccgagcgcctcgacctactcgacgacgccgctagggtcttcggcttctccatcacggaggcgagcaccgcctttcgaaactacgctccgtcancaccgtctccgagctcgaagaccccgcgatctgcaccggcgggctcgagtcctacgtcgntgacgtccccgacggcaacaacgaggacgacacccgccctctcgc

SEQ ID NO: 19789 - protein, 175 aa, Zea mays
  misc_feature: Ceres CLONE 1387505-F
  misc_feature (93)..(93): Xaa is any aa, unknown, or other
  misc_feature (94)..(94): Xaa is any aa, unknown, or other
  misc_feature (141)..(141): Xaa is any aa, unknown, or other
  misc_feature (161)..(161): Xaa is any aa, unknown, or other
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPXXAREVSVISGLPASTSTERLDLLDDAARVFGFSITEASTAFRNYAPSXPSPSSKTPRSAPAGSSPTSXTSPTATTRTTPALS

SEQ ID NO: 19790 - DNA, 741 bp, Zea mays
  misc_feature: Ceres CLONE 1387507-F
  misc_feature: Encodes the peptide sequence at SEQ ID NO. 19791
  misc_feature (344)..(344): n is a, c, t, g, unknown, or other
  misc_feature (741)..(741): n is a, c, t, g, unknown, or other
aagctggagctccccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtgaaagtcggaggtggagtcgccggactaccaccgccnccgccgggcgaaggggctggcgcgcccggtgctcgcggtgggtccagggcaaccaacagcgccgccggatgacaacgaagacggcggccccggggaaaaatggtcgaaggcggccaactcgtaccggttgggggtggctgaaaccggccgaaggaacggggacccccctgccccccccgcctggggcaaaccaaaagctgccctctgttatgccagggggacgcccgccgtggaagtctggggcgcaagaaaaacaaaaacactggctggtggtaggaccccccgccatgaaaaccccgaaaactggggcgcccaaaaaaactccccatgtccctccatacaacattccctttaagagaagcggcgagagtatccacattccccacaaaaaccccgn

SEQ ID NO: 19791 - protein, 34 aa, Zea mays
  misc_feature: Ceres CLONE 1387507-F
MGDLIPGLPDEVARECLVRVGFDQLPVVRRISRQ

SEQ ID NO: 19792 - DNA, 663 bp, Zea mays
  misc_feature: Ceres CLONE 1387509-F
  misc_feature: Translation starting site: 162
  misc_feature (227)..(227): n is a, c, t, g, unknown, or other
  misc_feature (276)..(276): n is a, c, t, g, unknown, or other
  misc_feature (291)..(291): n is a, c, t, g, unknown, or other
  misc_feature (298)..(298): n is a, c, t, g, unknown, or other
  misc_feature (302)..(302): n is a, c, t, g, unknown, or other
  misc_feature (309)..(309): n is a, c, t, g, unknown, or other
  misc_feature (315)..(315): n is a, c, t, g, unknown, or other
  misc_feature (328)..(328): n is a, c, t, g, unknown, or other
  misc_feature (331)..(331): n is a, c, t, g, unknown, or other
  misc_feature (339)..(339): n is a, c, t, g, unknown, or other
  misc_feature (346)..(346): n is a, c, t, g, unknown, or other
  misc_feature (349)..(349): n is a, c, t, g, unknown, or other
  misc_feature (385)..(385): n is a, c, t, g, unknown, or other
tccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacnagcggcggctgcggctgccagccaccgccgtcggttcatctaccgccgncggtgcatctgccanctccggntcanctgccancctcgntgcatctccccancgncggttcanctggcgncgncggtccacctgtcaacggcggtccatgtggcgccgncggttcatcttgcggcggcaccatggcactatcctaatcaacggcccggtctctagctcattcccagcacacccatgggcgtggcaaaaggcgcattcaagccctggcaaatggaaggaaactggggggttggagcacccccatactgggcacaggggccaagtccctgaggattaagggaacccgaagggaaaccccaatggtcccccaagtgcaatcttttgggaaaaaaggtttcccacactccaaggaggtggaccccaaacccggacccaggg

SEQ ID NO: 19793 - DNA, 730 bp, Zea mays
  misc_feature: Ceres CLONE 1387510-F
  misc_feature: Encodes the peptide sequence at SEQ ID NO. 19794
  misc_feature (519)..(519): n is a, c, t, g, unknown, or other
  misc_feature (542)..(542): n is a, c, t, g, unknown, or other
  misc_feature (611)..(611): n is a, c, t, g, unknown, or other
  misc_feature (612)..(612): n is a, c, t, g, unknown, or other
  misc_feature (620)..(620): n is a, c, t, g, unknown, or other
  misc_feature (622)..(622): n is a, c, t, g, unknown, or other
  misc_feature (623)..(623): n is a, c, t, g, unknown, or other
  misc_feature (649)..(649): n is a, c, t, g, unknown, or other
  misc_feature (675)..(675): n is a, c, t, g, unknown, or other
ccccgcggtggcggccgctctagaactagtggatcccccgggctgcaggaattcgcacgagaccattacctagaacatcctaatcgaaaactagccgaattgcgccgcgagatatatatctttcaccttctctcgcaggaagctctgtagtggcagtttcaatcgaagacgatgaagttcaacgtcgcgaatcctaccactggttgccagaagaagctcgagatcgatgacgaccaaaagctccgtgctttttacgacaagaggctctctcaggaagttagcggtgatgctttgggcgaggagttcaaggggtacgttttcaagatcatgggaggttgcgacaagcaaggtttcccaatgaaacagggagttctcacccctggtcgtgtccgccttttgcttcaccgaggtactccttgtttcagaggacacggaaggaggactggtgagaggagaagaaagtctgtccgtggttgcattgtcagccaagatctctcggttcttaaccttgtcattgtncagaaaggtgagaaggatctttnccgggctttacgacaccgagaagccaaggatgagagggtcccagagagcttccaagatcccgcagctgnntcaccttngnnaagatgatgatgtcaggaagtatgtncacacttaccgcccgcaatcactaancagaaaggtaaggagtgagcaaagcccccagatccaaaggctgtgactcctttga

SEQ ID NO: 19794 - protein, 152 aa, Zea mays
  misc_feature: Ceres CLONE 1387510-F
  misc_feature (1)..(129): Pfam Name: Ribosomal_S6e Pfam Description: Ribosomal protein S6e
  misc_feature (124)..(124): Xaa is any aa, unknown, or other
  misc_feature (147)..(147): Xaa is any aa, unknown, or other
  misc_feature (150)..(150): Xaa is any aa, unknown, or other
  misc_feature (151)..(151): Xaa is any aa, unknown, or other
MKFNVANPTTGCQKKLEIDDDQKLRAFYDKRLSQEVSGDALGEEFKGYVFKIMGGCDKQGFPMKQGVLTPGRVRLLLHRGTPCFRGHGRRTGERRRKSVRGCIVSQDLSVLNLVIVQKGEKDLXRALRHREAKDERVPESFQDPAAXSPXXR

SEQ ID NO: 19795 - DNA, 654 bp, Zea mays
  misc_feature: Ceres CLONE 1387512-F
  misc_feature: Encodes the peptide sequence at SEQ ID NO. 19796
cgctctagaactagtggatcccccgggctgcaggaattcgcacgagaccattacctagaacatcctaatcgaaaaataggaaaaacgactccacacggtccacggcgtcgtctccggcgaaccttcgcgagccctcggctcccctctaccaccgctgccgcgaccccgcctacggagcatcctcgggtagcgctctggcttcccgtgccggcggacgtcctgcaggaggcggcggcctccgtggcatgttgatgagggccgccgctgccctccctcgccgatcgtcgcggccctcggagcccgggtcctcctccctccgggctcccgcccctggggcctcctccagccgggctcctgcccccggggcctccttcgaccccttcgatgtcgataccgacccgccatcggggcttgagctgacgcccgagcagatcgggctctgcgttgacgcgctcgcgcatttcgaggacaaggggaagcgccgggatgacttgtccgacgagttcagaaggctctcgggatcggatattagactatgaaaacgatcggggtagctcattatcctggtaatagaggaaaggaccgaatatattggtggcttaccatttgacgataccagagtacaggtaaaatcctcagggcggcctcccaaca

SEQ ID NO: 19796 - protein, 97 aa, Zea mays
  misc_feature: Ceres CLONE 1387512-F
MLMRAAAALPRRSSRPSEPGSSSLRAPAPGASSSRAPAPGASFDPFDVDTDPPSGLELTPEQIGLCVDALAHFEDKGKRRDDLSDEFRRLSGSDIRL

SEQ ID NO: 19797 - DNA, 695 bp, Zea mays
  misc_feature: Ceres CLONE 1387513-F
  misc_feature: Encodes the peptide sequence at SEQ ID NO. 19798
gctctagaactagtggatcccccgggctgcaggaattcgcacgagaccattacctagaacatcctaatcgaaaaatcgccccccttcggccttccccactgtactctccaatctcgccgccaagcctcaccgcaccatggcgaccttcaccgcggcctcctccctctccctcctcttctcccacccgcactcccactcccgccaaccatccgcccaggggcccaccgccagctcccacctccacctgcatccgcgcgccagccgcgcgcgctgcgcctcttccgacacgacggccacgaagcaccgccgcccagcggaggagaacatccgcgaggaggcggcgcggctccgaggcccgggccagggtttctctggggtggacgagcccttccccgcggggcccggggggcgaccgaacgagcgctactcgctggacgaggtcgtctacccgtccagctcgggggggcctcctcgacgtggcgccaccacaatggaggcgctgggcccgctaccccgggggcccaactgggggtgaccttcttccaactcccggggtcggcccgcaccgcccggggccctaagggctcggggcggctgggaccaaaaaaaggagattccgggctccccccgagaatcgaatcccgaaccaaattcggttcccctttcttgggagggggaaactcccagacccctcg

SEQ ID NO: 19798 - protein, 132 aa, Zea mays
  misc_feature: Ceres CLONE 1387513-F
  misc_feature: SWISSPROT Homolog: EC 4.2.3.1 Threonine synthase
MATFTAASSLSLLFSHPHSHSRQPSAQGPTASSHLHLHPRASRARCASSDTTATKHRRPAEENIREEAARLRGPGQGFSGVDEPFPAGPGGRPNERYSLDEVVYPSSSGGPPRRGATTMEALGPLPRGPNWG

SEQ ID NO: 19799 - DNA, 667 bp, Zea mays
  misc_feature: Ceres CLONE 1387518-F
  misc_feature: Encodes the peptide sequence at SEQ ID NO. 19800
gctctagaactagtggatcccccgggctgcaggaattcgcacgagaccattacctagaacatcctaatcgaaaaaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagggggtcccgcccgccgccccggccctcctcccaaactaccaccggttcaacatcaagggccgcatttacccggcgatctggcccgttgagagcaagagaggtgctggggagggttatcatgggtggttgtggatgaagagctcccagcttctttgacgcgtttgaagacggggagtacccgaggacaagagttgagatatcattggctgactcttccgagaaaatggtgggtgacccttacgtggggaggggatgcaaaggatcttaatcttttaatgaaaatggggactttggaggtgatatgaccttggttccttgcaggcctgggggggtaaatggtatgggattattaaggttacgggggatcatatcgaaatggggaacttttatccgctcctggggggcctcgggaatctaaatttttggtgggaacccccaacattgaag

SEQ ID NO: 19800 - protein, 87 aa, Zea mays
  misc_feature: Ceres CLONE 1387518-F
MAMKPAAAAPPTPAAAHSVFVYGSLMADEVVRTILKGVPPAAPALLPNYHRFNIKGRIYPAIWPVESKRGAGEGYHGWLWMKSSQLL

SEQ ID NO: 19801 - DNA, 666 bp, Zea mays
  misc_feature: Ceres CLONE 1387519-F
  misc_feature: Encodes the peptide sequence at SEQ ID NO. 19802
  misc_feature (307)..(307): n is a, c, t, g, unknown, or other
tccccgcggtggcggccgctctagaactagtggatcccccgggctgcaggaattcgcacgagaccattacctagaacatcctaatcgaaaaataaaagtgaaattccattaccttgctgtctcggtctgtcggccatcgccggttgcgcagcgggcagcggctcacgtcgacggggaagactccggaggccacgggcgttacattctcctgccgtatttttgcgggattgaagtgacagccagggatccactcatcccctgggtggaaaattcaggttgtggattggattgctagctaccgaacagnccctcagcgtgctaatttcagtgggatcttggtagacaccactgaacttcttggtttcaggtaggttcgagcatagagatcgtcttctctcacactgagttgccagtttattccggaaggtctttcaagctagttctgatgatggctaagggccatggagcagtccatgcatccacgaaggaacccttgttttcttttggtgtcatagctgatggtcagtatgctgatatcccagatggtcgctcattcctcggtgtcccaagatactaccgccatagcatcactggtctccaaggggccgtcaacagggtggaacgaacagggcacatcaggttctcaatcagttttggggacattag

SEQ ID NO: 19802 - protein, 73 aa, Zea mays
  misc_feature: Ceres CLONE 1387519-F
MMAKGHGAVHASTKEPLFSFGVIADGQYADIPDGRSFLGVPRYYRHSITGLQGAVNRVERTGHIRFSISFGDI

SEQ ID NO: 19803 - DNA, 652 bp, Zea mays
  misc_feature: Ceres CLONE 1387520-F
  misc_feature (149)..(149): n is a, c, t, g, unknown, or other
ggagctccccgcggtggcggccgctctagaatagtggatcccccgggctgcaggaattcgcacgagaccattacctagaacatcctaatcgaaaaaatcgagcatcgcagagataggcgtcttcgtactcgcctacctccgcggctcanacctttcccccttctcccaattccctccgtcggccgccgctccatcccgtacgacgacaccatgagggagtgcatttcgatccacatcggccaggcccggtatccagttcggaaacgcgtgctgggagctgtactggcttgagcatggcattcaggctgacggtcagatgcccggtgacaggaccatggggggaggggatgatgctttcaacactttcttcaggggggactggtggtgggaaggcaccgggccccggtgctgtttttggtgagcctggaccccactggcttcgagggaggggggactgggacctaacggcaagtctttccaccctgagagttcattgggggggaaggggggggcgccccaaaattttgccggggggccctaacccccttgggaaggggaaattggtaaccaatggcttttaaaccccaacagggaaattttgcccaaaactgtgggcgggggccccagggggtttccccctgttttaaaaggg

SEQ ID NO: 19804 - DNA, 681 bp, Zea mays
  misc_feature: Ceres CLONE 1387523-F
  misc_feature: Encodes the peptide sequence at SEQ ID NO. 19805
  misc_feature (312)..(312): n is a, c, t, g, unknown, or other
tccccgcggtggcggccgctctagaactagtggatcccccgggctgcaggaattcgcacgagaccattacctagaacatcctaatcgaaaaatttttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccnagtgcccacaggagatgataacgaagcaggatcaggccaagctggctgcctcctctatcgacagcatcgtggacggcagcgacgccgtcatggaggcggttggttgtggcagcaacacggtagtagctggtgcccaggttgagttgcaaacaatgaacgtgcagcagccccgctgatgttggcgggacccggcgggggggtggcggcaatctccaaagggggggaaggtaggccgaaacgggtgcagcgcctggaagaaagagggttggacttacgggattcaactggccggggggggaaactgggactggggcactccaacggctactccgaaaaggaacgactggaagttcgattaacgggagtggg

SEQ ID NO: 19805 - protein, 92 aa, Zea mays
  misc_feature: Ceres CLONE 1387523-F
  misc_feature (14)..(38): Pfam Name: zf-A20 Pfam Description: A20-like zinc finger
  misc_feature (35)..(35): Xaa is any aa, unknown, or other
MEHKEAGCQAPEGPILCINNCGFFGSAATMNMCSXCPQEMITKQDQAKLAASSIDSIVDGSDAVMEAVGCGSNTVVAGAQVELQTMNVQQPR

SEQ ID NO: 19806 - DNA, 681 bp, Zea mays
  misc_feature: Ceres CLONE 1387526-F
  misc_feature: Encodes the peptide sequence at SEQ ID NO. 19807
  misc_feature (216)..(216): n is a, c, t, g, unknown, or other
gctcagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctgnaccttcgatgatgtccaggtgaacgacatctcgctgaacgactacctcgctgtgaacgcgacgaagcacgcgatgtacctgcccgacaccggggggccgtaactccaaaaagcggtttccccaaggggcaagtgccccgatcggtcaagccgcctcaaaaactcccctcatgatggacggggccgcaacaaagggcaaaaaaaggcatgggctgtcccccaatcattcaaaggattaccctggaagaatatttcccccggcttacccggatgcccaacccccatccagggtcggtgcggccaaagcgaattcttcaaaagggggcacccccgggagagatgcccccccctaaattgggtcccctttggggtgtttaaaagaaaaaaagcccctgggaatattctctcccccccgggggggggggggaaaaaaaagggcctttttaaccttccccccccccggggg

SEQ ID NO: 19807 - protein, 50 aa, Zea mays
  misc_feature: Ceres CLONE 1387526-F
  misc_feature (17)..(17): Xaa is any aa, unknown, or other
MAEVEQQQDTPKLFNRXTFDDVQVNDISLNDYLAVNATKHAMYLPDTGGP

SEQ ID NO: 19808 - DNA, 698 bp, Zea mays
  misc_feature: Ceres CLONE 1387527-F
  misc_feature: Encodes the peptide sequence at SEQ ID NO. 19809
  misc_feature (197)..(197): n is a, c, t, g, unknown, or other
  misc_feature (340)..(340): n is a, c, t, g, unknown, or other
tggagctccccgcggtggcggccgctctagactagtggatcccccgggctgcaggaattcgcacgagaccattacctagaacatcctaatcgaaaaattctcctcttcgtcttcggttgcaagaaagaaaaaggtcacccctctaacaccacgccgccgccgtttgctgctcggcgcctctccctcacacccgtacngcaacgtctcccatctcgtatactttcgtgctcagcatcatgggacgcttcccccagaggcgtcgcggtggcgggccctaacattcccggcgggatcccaccccgcaggcgggagccaggcggcggcaggaggaggccccacncaacggacgcagtatccggatgggactggaaattcgggcggcggcttggaatacaagggatggggtgatcatgggatgggacactggaccctctttatggatcaacctttgaaatacaagagtgtgggaacccattaggggagtttgcaagccatacatctttgggagcgaggggaggagtccagggacttccaggaagattttgccgctatttggatgaactaacctcctggctgaccatatgggggaagaaggaaaactcccttggcccccaaagaaatcccccggttatttgacaaggaggggtggcccaaccggcccaaacaagtttttatccccccctggaacccccctggga

SEQ ID NO: 19809 - protein, 30 aa, Zea mays
  misc_feature: Ceres CLONE 1387527-F
MGLEIRAAAWNTRDGVIMGWDTGPSLWINL

SEQ ID NO: 19810 - DNA, 568 bp, Zea mays
  misc_feature: Ceres CLONE 1387529-F
gctctagaactagtggatcccccgggctgcaggaattcgcacgagaccattacctagaacatcctaatcgaaaaactcacaaagaagccggggacggagagcagagagcttcagcgcaactgtgctcaatcgtttcttcgtctttagttgggcttggtctccctcgtcctctgttccaacagaggtgctcactgactcttttgcttggtagaaatagacactctctctctagagctgaccacaccttgctgaggcagcagctagcacgacatgtctccttcgacaccatccgacgccatcgggtaatcgggatgggacccccctatggttttctcttcccggggcctaagttatccccatttgaaaaaggggtccggaaaaaaaaactccccaatcccgaagggggaaccctttaaaatcgttaggggggggtttaaagggttgccctttggccccccccaaaggggtggggaaaccctaaaagggccccgggtgggccccccggggaccaagggggggtttttttcctttaaaccccggggggggcgccccccaagggtgcccccct

SEQ ID NO: 19811 - DNA, 639 bp, Zea mays
  misc_feature: Ceres CLONE 1387530-F
  misc_feature: Translation starting site: 160
  misc_feature (279)..(279): n is a, c, t, g, unknown, or other
  misc_feature (335)..(335): n is a, c, t, g, unknown, or other
  misc_feature (421)..(421): n is a, c, t, g, unknown, or other
  misc_feature (500)..(500): n is a, c, t, g, unknown, or other
tccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttccccataccttncatcaattatagcttcaatatgtgaaaacccagctcttcaaccatataggcttcancaagcatcgcagcaagcacatacctttatgcgccccttgtgtttcacaatcgccagcctaatctttggtggagtcatttttacaancatcagggcacacagctgcagcactcgtgcttactctgatcaaccagtagctctggaaaactttctcctactctcacancaacaatttcttcatttcaacaactgttaaactgagcctggctgctatttgcagcacactattaccttttagccggtagttactgctatctcagaaaaaaacttcttcaatttaacaatgggccgactgaaccccgtgt

SEQ ID NO: 19812 - DNA, 665 bp, Zea mays
  misc_feature: Ceres CLONE 1387531-F
  misc_feature: Pfam Name: DUF1685 Pfam Description: Protein of unknown function (DUF1685)
  misc_feature (295)..(295): n is a, c, t, g, unknown, or other
  misc_feature (296)..(296): n is a, c, t, g, unknown, or other
  misc_feature (348)..(348): n is a, c, t, g, unknown, or other
  misc_feature (373)..(373): n is a, c, t, g, unknown, or other
  misc_feature (381)..(381): n is a, c, t, g, unknown, or other
  misc_feature (425)..(425): n is a, c, t, g, unknown, or other
  misc_feature (437)..(437): n is a, c, t, g, unknown, or other
  misc_feature (517)..(517): n is a, c, t, g, unknown, or other
  misc_feature (535)..(535): n is a, c, t, g, unknown, or other
  misc_feature (547)..(547): n is a, c, t, g, unknown, or other
  misc_feature (549)..(549): n is a, c, t, g, unknown, or other
tccccgcggtggcggccgctctagaactagtggatcccccgggctgcaggaattcgcacgagaccattacctagaacatcctaatcgaaaaaaccaagcagagcaaagagagagacgcggagccaccgcgttccggagagagacgcggagagccaaggcaaggcagctgtcgccgcagcgacgatgtggagctcgggctctgaccgcgacgaggccctagacacggcgaacgcctcgtcagtcgacgcttcgtcgcccgcgcgggagccgtccacgccgcccccgcccgctcggnngcggcgccagcgcgcgcgacgccgcgctcaccgccctccgtgcagaacacgnccgcaggagcgaaagaggaggaggnactcctgnaggccgacccggacgcggacgacgtctggggcgggctgcaccancaacggaagcgnaaggcgtggctggcggcggcgtcaaggccggtggtggtggtcgccggcgaggaggggtcccctccggacccctccgccgntcggggaaaaccggcggnttggggaaggcncnaaacctgaccgacgaccacctggagggagttcagggggggggggaatctggggttcggtttcagctaccgggagatccccgagttggggggaacggttccggccctcaacttctgt

SEQ ID NO: 19813 - DNA, 664 bp, Zea mays
  misc_feature: Ceres CLONE 1387537-R
  misc_feature: Pfam Name: DUF1117 Pfam Description: Protein of unknown function (DUF1117)
  misc_feature (1)..(1): n is a, c, t, g, unknown, or other
  misc_feature (510)..(510): n is a, c, t, g, unknown, or other
  misc_feature (605)..(605): n is a, c, t, g, unknown, or other
ncgattgggtaccgggccccccctcgaggtcgacggtatcgataagcttttttttttttttttttggatttgacattatgttaccataaattttgatgaaactgactaaaaggttaatcgaattacaaaagagaaaaaaagtactatttaggttccaactggtcttctattgttgaatcaaaacgaaaacaaaaatttgaacatttttcacctaaccatcaagtcagaaaaatcttctgatcaacgacgtcgatcgattcataacgtttgtatccaaatcaataacattagaagaagaagagccacgatttggtctcatcctcctcataaacgaaatcattcccccgagctgctctcctcaatcgacagcgcgagcagaattctgctaatctcgggtgtccatgatccctaaccaagagatcgtctcggacctcatactccccagcccacacgtcacttcgtcaacacacgggaaaatcctctcccctctctcatcgcgcgttaaacttncacagcgaatcacctcggaagtctcagatcgtcataccacagcgtgttctcctcgatactccgtgaaccgatccgaagcaatcaatcgacaacanggcacagttcgtatcgaaagccaggacgatgcatcgcgtgaaaatgtgttacacgcacc

SEQ ID NO: 19814 - DNA, 692 bp, Zea mays
  misc_feature: Ceres CLONE 1387539-F
  misc_feature: Translation starting site: 228
  misc_feature (253)..(253): n is a, c, t, g, unknown, or other
  misc_feature (404)..(404): n is a, c, t, g, unknown, or other
ccccgcggtggcggccgctctagaactagtggatcccccgggctgcaggaattcgcacgagaccattacctagaacatcctaatcgaaaactctcgttgtcttggcggctgcggcggagcacggaggcgaaggaggagcagcagcagcaggcggcgccgaggagcggcatcccactcagtgcttgcaaccatggctaggggattgaagaagcacttgaagaggctcaatgcgcccaagcattggatgctcgancagcttggcggagctttttgctccccagccatcttctggacctcacaagtccagggagtgccttcctctgatcctcatcatcaggaacagggctcagtatgctctgaactaccgtgagggcatttctatcctgatggcacgcatgtacttngttgattgcaagggcaggactggacagactaccctgctggggtcatgaatgtcattcccacccccaagacaatgaaaactacggggtgctttatgaacccaaggggccgttccggttttcccccataagggagggggaatgccaatttcagccctgcaagggggagggctttttcattttggcacaaagggttccccctatcgaaaacccaaaaagggggggaaatttcgttaccccgacccggtttttgggggcccaccccccttttagattgttggggagaaaaca

SEQ ID NO: 19815 - DNA, 682 bp, Zea mays
  misc_feature: Ceres CLONE 1387541-F
  misc_feature: Encodes the peptide sequence at SEQ ID NO. 19816
ggagctccccgcggtggcggccgctctagaactagtggatcccccgggctgcaggaattcgcacgagaccattacctagaacatcctaatcgaaaaaagcggcgcatctgaatccaaacgacgacgagatgacgaccgatccacagcagaaaacgagcaagttccgatgggggagagatggacgaagacgacgatctcgacttctttctccctccgaagcaagtgatccggccagatgagaacggattgaagacggtgatcgagtacaagttcaacgaagagggcgaacaggtcaagatcacgaccaagtcacgcgtccgtaagctagcttccgcgaggctcaacaagcgagccatggagcggaggagctggcctaaggtcggagaccccgcgaacgaggacgctgggaagccctctcaccatggtgtcgaccgaaaagattcttctgggacgggctagagctcctggtaccaaagcagatgatacaaaggcggcaggagacaactggtctcagctgggtaaagggggtgcactcttcatggttttccagacttgcggcaggaaaggggatcactggaaatcaaaatgcccctacgaggatctacccccaccgaccgttgtttttcccaacagccacccacaggggaaacttctaccgcctccgctgcacctgaattgggaa

SEQ ID NO: 19816 - protein, 93 aa, Zea mays
  misc_feature: Ceres CLONE 1387541-F
MDEDDDLDFFLPPKQVIRPDENGLKTVIEYKFNEEGEQVKITTKSRVRKLASARLNKRAMERRSWPKVGDPANEDAGKPSHHGVDRKDSSGTG

SEQ ID NO: 19817 - DNA, 651 bp, Zea mays
  misc_feature: Ceres CLONE 1387542-F
  misc_feature: Encodes the peptide sequence at SEQ ID NO. 19818
  misc_feature (251)..(251): n is a, c, t, g, unknown, or other
  misc_feature (293)..(293): n is a, c, t, g, unknown, or other
  misc_feature (337)..(337): n is a, c, t, g, unknown, or other
tacccgcggtggcggccgctctagaactagtggatcccccgggctgcaggaattcgcacgagaccattacctagaacatcctaatcgaaaaaactccaacctacccagcctcggccagccacctccccgtcgctctcacgctcttcgtgcccgccgcctcccctcttcccctccacctcactcctcccgtctgacgcacatggcctccatcgccggatcttccgctctctccttcgccatggctgtcaggncaatcaactcaaattctctagccttctccccggtgaggaggntaacacattcctccgcctgcaaccagtgcctatgagatctgttncctggcgctgcaaaaaggatacgtggacaggtttggtgaaatgtgaaaagcagcttgctcttcctgacacactgaagtttgtggggaatcaaaatctctgaacttggggcggatccctggacacgggtgagatggtggatggcctttaagaacacttcgacattagcggggaggagtccagcgcgcagacaatgcccaccgtaaagacgccgctgactcattgaccagcttgttgctgtaaagcaaaggcccatctcttctatcatggctaaccatctaggttcctatggccgaaaactgggattttctcgcac

SEQ ID NO: 19818 - protein, 37 aa, Zea mays
  misc_feature: Ceres CLONE 1387542-F
  misc_feature (5)..(5): Xaa is any aa, unknown, or other
MRSVXWRCKKDTWTGLVKCEKQLALPDTLKFVGNQNL

SEQ ID NO: 19819 - DNA, 655 bp, Zea mays
  misc_feature: Ceres CLONE 1387543-F
  misc_feature: Encodes the peptide sequence at SEQ ID NO. 19820
  misc_feature (385)..(385): n is a, c, t, g, unknown, or other
  misc_feature (513)..(513): n is a, c, t, g, unknown, or other
tccccgcggtggcggccgctctagaactagtggatcccccgggctgcaggaattcgcacgagaccattacctagaacatcctaatcgaaaaacctccgaatttagtgatccatccatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatggtggtggcggcgatgcggcggccgtgcgctgtgccagcgctgctggtgggcgcggcgaacgcgacgctagcgcttctgctgctgctgtcaccgtcgagcgcgcanccgatgccgtcgtccccgggggcggcggcggggccccgcgggcgggaaccgggatcgactcggcgtgcctgaactcgctgctcaacatgtcggactgcctccccgtacgtgagccaggggagcacggngcgggggcccgacgcgcctgctgccggggaggtgggggcctcgtcggctccaccccgtctgcctctggagctctctccggggcggcgactcaaaggaatcgccgtcgatacgggcgggggttcgggtttcccggggtctgcc

SEQ ID NO: 19820 - protein, 59 aa, Zea mays
  misc_feature: Ceres CLONE 1387543-F
  misc_feature (36)..(36): Xaa is any aa, unknown, or other
MVVAAMRRPCAVPALLVGAANATLALLLLLSPSSAXPMPSSPGAAAGPRGREPGSTRRA

SEQ ID NO: 19821 - DNA, 697 bp, Zea mays
  misc_feature: Ceres CLONE 1387546-F
  misc_feature: Encodes the peptide sequence at SEQ ID NO. 19822
  misc_feature (330)..(330): n is a, c, t, g, unknown, or other
  misc_feature (388)..(388): n is a, c, t, g, unknown, or other
aaagctggagctccccgcggtggcggccgctctagaactagtggatcccccgggctgcaggaattcgcacgagaccattacctagaacatcctaatcgaaaagtccacctcagctcccatatccgctcccctacctctccagcatctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatggtncaagtacgacaccgtgcacggccaatggaaacacagcgacatcgccctcagggactcnaaaacgcttctcttcggggaagagccggtcaccgtcttttggcatcaggaacccccgaggagatcccggggggggggaggttggtgcttgataatgtccggggagtcccccgggggtctcccctgaaaaggaaaagggtgctggcaattcttgaggggggggggccaagaaaggtttttattctcctgcccccaaacaaaaatgcccccctggttttggtggttgggggaaaggaggaaacaacccccccccgaagggtaaattttgttcccaagggggaatgtgacccaaaaaattggctttgttccc

SEQ ID NO: 19822 - protein, 169 aa, Zea mays
  misc_feature: Ceres CLONE 1387546-F
  misc_feature (4)..(152): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (67)..(67): Xaa is any aa, unknown, or other
MGKIKIGINGFGRIGRLVARVALQSEDVELVAVNDPFITTDYMTYMVQVRHRARPMETQRHRPQGLXNASLRGRAGHRLLASGTPEEIPGGGRLVLDNVRGVPRGSPLKRKRVLAILEGGGPRKVFILLPPNKNAPLVLVVGGKEETTPPRRVNFVPKGECDPKNWLCS

SEQ ID NO: 19823 - DNA, 652 bp, Zea mays
  misc_feature: Ceres CLONE 1387549-F
  misc_feature: Pfam Name: Snf7 Pfam Description: Snf7
  misc_feature (298)..(298): n is a, c, t, g, unknown, or other
  misc_feature (303)..(303): n is a, c, t, g, unknown, or other
  misc_feature (321)..(321): n is a, c, t, g, unknown, or other
  misc_feature (324)..(324): n is a, c, t, g, unknown, or other
  misc_feature (325)..(325): n is a, c, t, g, unknown, or other
  misc_feature (591)..(591): n is a, c, t, g, unknown, or other
tccccgcggtggcggccgctctagaatagtggatcccccgggctgcaggaattcgcacgagaccattacctagaacatcctaatcgaaaaaaagccgcgccttacaacgagattcctcccctcctctctccaataaccctagcctactccgccgccggcgacgaatccggcgttttgagtttctgttgccagcgtagccatgtccatgttcaataggatcttcgggaagcccaaggagcaggccaactccaatggctttgccactctgggacagtaaatgagactcttgatatgctgnagaanaaagaaaaggtgctgganaannaagcagccgctgagctggagagagccaaggagtctcaaagctaggagtaaagagcggctatccaatcctggaagaggaaaaaacttatggagcacaaattgagcagcttggaaatttcagttgagaatcatgatcagatgatcatggtagaagcagctaaagctacaacagagactgttgatgcattgagaactggagctgcagctatgaaagcaatgcaaaaaagcaacaacattgatgatgtagacaagagcgtggatgaattnagtggacagactgaaaatatgaaacaaatcggggatgctttgcacctcctctcggagcttc

SEQ ID NO: 19824 - DNA, 655 bp, Zea mays
  misc_feature: Ceres CLONE 1387550-F
  misc_feature: Encodes the peptide sequence at SEQ ID NO. 19825
  misc_feature (235)..(235): n is a, c, t, g, unknown, or other
  misc_feature (250)..(250): n is a, c, t, g, unknown, or other
  misc_feature (373)..(373): n is a, c, t, g, unknown, or other
  misc_feature (412)..(412): n is a, c, t, g, unknown, or other
gctctagaactagtggatcccccgggctgcaggaattcgcacgagaccattacctagaacatcctaatcgaaaaaatcagaagccgccgaggggaggcgccgacgccgagtttttgctccatcccgcatccaccgccagaatgtttctcacgaggacggagtacgaccgcggggtgaacaccttctcgccggaggggcgctgttccaggtcgagtacccatcgaggcatcaagtngggatcactgcgatncgggtgaaacaagggatggtggtgtccttgctggtgagaacgtggggactcgccactggctggaccaggcagggtggaaaaatcatggaaattgatgagcacatagggctgtgcatgagtggncttattggtgatggtagacactagtcgagcatgctcgtngtgaaactcagaatcatagggtctcatacggggaggccaatgaccgtagattctttcacacaagctatttgggacttagctctgcgctttggggagggtgacaaagagtcaatgccacgcccatttggagcctctctcctaatggctggaacgatgaaatgggacctacctggactacccgacccatctgggattttttgggaatgcaccccaagggcattggatctggttctaaggaactaa

SEQ ID NO: 19825 - protein, 83 aa, Zea mays
  misc_feature: Ceres CLONE 1387550-F
  misc_feature: SWISSPROT Homolog: EC 3.4.25.1 Proteasome endopeptidase complex
MLVVKLRIIGSHTGRPMTVDSFTQAIWDLALRFGEGDKESMPRPFGASLLMAGTMKWDLPGLPDPSGIFWECTPRALDLVLRN

SEQ ID NO: 19826 - DNA, 682 bp, Zea mays
  misc_feature: Ceres CLONE 1387552-F
  misc_feature: Encodes the peptide sequence at SEQ ID NO. 19827
  misc_feature (558)..(558): n is a, c, t, g, unknown, or other
gctctagaactagtggatcccccgggctgcaggaattcgcacgagaccattacctagaacatcctaatcgaaaacaccggaggaaggaagcgagaagaccagaaggtgagaagagagagagagagtgtgtgtgatcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgaggaaaagggatgttcctgatgagaagtacaccaatgccttccttggctttgggccagagaacaccaactttgcagttgaattgacatacaactatggcgttgacaagtatgacattggaaacggctttgggcattttcgcattgctaatgatgatgtgtacaagttagctgaaatatcaaatcccagggntggtaagatcacccgcgaacctggtcctgtcaagggaggatccactgttattgctttcccacaggatcctgatggctacatgtttgagtttatccaagggctgacccacctgagcttctttgca

SEQ ID NO: 19827 - protein, 156 aa, Zea mays
  misc_feature: Ceres CLONE 1387552-F
  misc_feature (24)..(145): Pfam Name: Glyoxalase Pfam Description: Glyoxalase/Bleomycin resistance protein/Dioxygenase superfamily
  misc_feature: SWISSPROT Homolog: EC 4.4.1.5 Lactoylglutathione lyase
  misc_feature (115)..(115): Xaa is any aa, unknown, or other
MATGSEASKAAEAVVDWHKHDSKRMLHAVYRVGDLDRTIKYYTECFGMKLLRKRDVPDEKYTNAFLGFGPENTNFAVELTYNYGVDKYDIGNGFGHFRIANDDVYKLAEISNPRXGKITREPGPVKGGSTVIAFPQDPDGYMFEFIQGLTHLSFFA

SEQ ID NO: 19828 - DNA, 689 bp, Zea mays
  misc_feature: Ceres CLONE 1387555-F
  misc_feature: Encodes the peptide sequence at SEQ ID NO. 19829
tggagctccccgcggtggcggccgctctagaactagtggatcccccgggctgcaggaattcgcacgagaccattacctagaacatcctaatcgaaaaacaagcagcatccgcacactcccaattcccctcgagcgccgcagcgagcccaagaagccgaccgccgagccccctctccagtccagtccgcggtctcggtttcttgcttgcccggcgcccaatcttcagagagagctccttctcgtcgtctgtctccatgggcgcctcgaccaagaccgtcgccgtcctcctcggcgcggtgctcctcgcgctggtcgcgtcggcggcagccagcaggaagctggaggaggacgcacttctgggaagcctggccccagcccccgcgccggccgttggcggtgcgcggggctgcctggcggcagccgggggcgtgggccgtcccgctctggtctctctcgtccctttctcgtgatctgaggggtggggatcgtgctgccatcgcgggagatggaggacaaatcctggatctggatcgcaaagaggaggagaggggatatttatgttccgtctgttggtgcaaggggcctctcttttgcctggaaggagaggccatgatttttttaaaaaaaaacccgttatttggcaaaaaaaaaaaaaaagttatcatacggcgacccccaagggggggccc

SEQ ID NO: 19829 - protein, 71 aa, Zea mays
  misc_feature: Ceres CLONE 1387555-F
MGASTKTVAVLLGAVLLALVASAAASRKLEEDALLGSLAPAPAPAVGGARGCLAAAGGVGRPALVSLVPFS

SEQ ID NO: 19830 - DNA, 731 bp, Zea mays
  misc_feature: Ceres CLONE 1387556-F
  misc_feature: Translation starting site: 177
  misc_feature: Pfam Name: Ribonuc_L-PSP Pfam Description: Endoribonuclease L-PSP
  misc_feature (212)..(212): n is a, c, t, g, unknown, or other
  misc_feature (304)..(304): n is a, c, t, g, unknown, or other
  misc_feature (322)..(322): n is a, c, t, g, unknown, or other
  misc_feature (323)..(323): n is a, c, t, g, unknown, or other
  misc_feature (331)..(331): n is a, c, t, g, unknown, or other
  misc_feature (395)..(395): n is a, c, t, g, unknown, or other
  misc_feature (416)..(416): n is a, c, t, g, unknown, or other
  misc_feature (529)..(529): n is a, c, t, g, unknown, or other
ggagctccccgcggtggcggccgctctagaactagtggatcccccgggctgcaggaattcgcacgagaccattacctagaacatcctaataaaacccacccatcacacgacaaaatccctcaccctcgtgagtcctgacgtcctcgcccgtgctcgcagttggtagggttctagccatggcgtggagcgccgccgcgtctccaggttcgagncgcctccccaccgcaggaccatctccgtcaggcttggagcgccgcttctcgctcgtcctgtcctttctcagtgggcgccgacgccccgtggncgcgtccctctcgacctnnctgcacgntgtaagggagctgttcagacagagaaggcaccaccagcactaggtccttattctcaggccatcnaagcaaataatctttgggttnggtctggagttcttgggcttgatcccgagaccagaagtttatctctgagaatggtgaggagcaaactgagcaggttattgaaaacattggccgagaatattgaaagctagggntgctaactatttcttcagtgtgaaaaacacgatcttggttgttgatctgcaggatttcaataaagtaaacgatatctatggaaatattttcccgggggcagcacctggacgataaacctacaaggtgggggggctgccactgaaatgcccgaattgagaataaaggcattccttcttctctaatcaaatatccaaccactct

SEQ ID NO: 19831 - DNA, 769 bp, Zea mays
  misc_feature: Ceres CLONE 1387557-F
  misc_feature: Translation starting site: 255
  misc_feature (382)..(382): n is a, c, t, g, unknown, or other
  misc_feature (398)..(398): n is a, c, t, g, unknown, or other
  misc_feature (465)..(465): n is a, c, t, g, unknown, or other
ggagctccccgcggtggcggccgctctagaactagtggatcccccgggctgcaggaattcgcacgagaccattacctagaacatcctaatcgaaagatctggctgcctcggtcgatttctaattctcctcgcgagcccaaaccctaaacctaaacctttcacccgccgccgccgccaccaccagcactgccactccgccaccaccgtcccgaagccccctcccagcgccatcgacttcatctcggattgaagcaatgtcgtcggacgatgaggtcagggaggagaaggagctcgacctctcctcccacgacgttgtcaccaagtacaaggctgccgccgaaatcctcacaacgctctgaagattgttgtgtctcagtgcaangcaaaagtcaagattngtgacctttgcgagaagggcgactctttcataagagagcaaactggggatggttaacagaacgcaangagaaagattgaaggggtattgctttcccaccttgtgtatccgtcaatggacacagttggccactcctcaccgctttgcaacggatgatgcccgttctggaaaaaatggacatggtaaaaatggaaagggcgtggcaaatggaaggttttattgggcggggggggccaaaacactgaaattaacaatggcccctgccaaagaaaaggcttgggaaattgctttctcttccccacaacaaaaaaaaacccaaagggggtttggaaaccctgggaaaaaaaataaggggtgcccgggacccttcca

SEQ ID NO: 19832 - DNA, 674 bp, Zea mays
  misc_feature: Ceres CLONE 1387559-F
  misc_feature: Translation starting site: 146
  misc_feature (448)..(448): n is a, c, t, g, unknown, or other
  misc_feature (489)..(489): n is a, c, t, g, unknown, or other
  misc_feature (613)..(613): n is a, c, t, g, unknown, or other
ggagctccccgcggtggcggccgctctagaactagtggatcccccgggctgcaggaattcgcacgagaccattacctagaacatcctaattgaaaaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccagagtttgggtgccaaaattcccgccgccgccccctctttcgaaagtcccaagagatcttccatggacgacattgatgacgacggtgatgacgacgacgatttggatatgagggatcccactcctgagcgaggacgagctcgatgaagagattgttgagtctgatcttgagctcgaaggagaaattgtacagtctgnacatgatgacccaccacagaagatgggaaatccttcagtgnaggtgactgaggaaaaccgtgatgcttcccaagaagcaaaaggcaggctatgggagcaatttctgaagggaaactggaagatgctattgaacacctaccaacgcatagtgctggatcactctcnagcatcatgtatggtactagagcatctgtggttataaaatgagaaccagctgctgccatcg

SEQ ID NO: 19833 - DNA, 727 bp, Zea mays
  misc_feature: Ceres CLONE 1387561-F
  misc_feature: Encodes the peptide sequence at SEQ ID NO. 19834
  misc_feature (462)..(462): n is a, c, t, g, unknown, or other
  misc_feature (494)..(494): n is a, c, t, g, unknown, or other
  misc_feature (517)..(517): n is a, c, t, g, unknown, or other
  misc_feature (638)..(638): n is a, c, t, g, unknown, or other
tggagctccccgcggtggcggccgctctagaactagtggatcccccgggctgcaggaattcgcacgagaccattacctagaacatcctaatcgaaaaatcgaaaacccaccgcaccctttcatcagcctgcctgtccactgttggcttggtgacttcctccgctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagccccgacaagtactggagcccccacccccagaaccggcgtctttcgccccggcggcgtgaaccccccagctgccgctgntggcgcgccgaacgcccgcgcggatgctgcangaaagcacgtgctggaccaaaanggtgtgttcccgccccggtcgagacgtcgagaagccccccccccgcgcgtgagccgcgcggcgctgctaggccagcccacactgctgctcgctcataaaaagggcggcggaaaaacctggnagtggcagcactctgctcctggctcgggcgggttgggctccctggctatatcctgcatattaacaaaccaaagaaagggggcttgaaaa

SEQ ID NO: 19834 - protein, 136 aa, Zea mays
  misc_feature: Ceres CLONE 1387561-F
  misc_feature (86)..(86): Xaa is any aa, unknown, or other
  misc_feature (97)..(97): Xaa is any aa, unknown, or other
  misc_feature (105)..(105): Xaa is any aa, unknown, or other
MAAAAGSKGRAIAGSFVSRVLAGKAASPRRAVHASAYDKNLEDQVRPAFVPDDVIGSAGSPDKYWSPHPQNRRLSPRRREPPSCRXWRAERPRGCCXKARAGPKXCVPAPVETSRSPPPAREPRGAARPAHTAARS

SEQ ID NO: 19835 - DNA, 678 bp, Zea mays
  misc_feature: Ceres CLONE 1387563-F
  misc_feature: Encodes the peptide sequence at SEQ ID NO. 19836
  misc_feature (253)..(253): n is a, c, t, g, unknown, or other
  misc_feature (282)..(282): n is a, c, t, g, unknown, or other
  misc_feature (340)..(340): n is a, c, t, g, unknown, or other
cgctctagaactagtggatcccccgggctgcaggaattcgcacgagaccattacctagaacatcctaatcgaaaatctatcgcactcgtagtcgtagctcaagcatcagcggcaggagctctgggcagcgtgcgcacgtggggtacctagctcgctctgctagcctaccatggctgatcaccaccggggtgcgacgggagggtgcggggctacggcgacttcagcgcggggcggcatgcacggcgaggcgcancagcagcagaggcaggccgccatgatgancgcgctcaaggccgcgacggccgcgaccttcggcgggtcgatgctggtgctgtccggnctgatcctggccggcacggtgatcgcgctcacggtggccacccccgtgctggtgatcttcagcgggggttgggggggcggccgccatcgcggtggggctcatggcgggccgggtttcgtcccctccggggggcctcgggggtcctgggcctggcccggttcctcctggatggaacaagtaccctgaaggggaaagcaccccgccgggggcccaacaagttgaaccacccccaggggggggggtgggggtccaagggccccggaaatttcggggggtggagaaaagcccccgcatcgaaccagggggggaggggttttttgaaaaaaagacaccccccg

SEQ ID NO: 19836 - protein, 118 aa, Zea mays
  misc_feature: Ceres CLONE 1387563-F
  misc_feature (35)..(118): Pfam Name: Oleosin Pfam Description: Oleosin
  misc_feature (28)..(28): Xaa is any aa, unknown, or other
  misc_feature (38)..(38): Xaa is any aa, unknown, or other
MADHHRGATGGCGATATSARGGMHGEAXQQQRQAAMMXALKAATAATFGGSMLVLSGLILAGTVIALTVATPVLVIFSGGWGGGRHRGGAHGGPGFVPSGGPRGSWAWPGSSWMEQVP

SEQ ID NO: 19837 - DNA, 712 bp, Zea mays
  misc_feature: Ceres CLONE 1387565-F
  misc_feature: Encodes the peptide sequence at SEQ ID NO. 19838
  misc_feature (345)..(345): n is a, c, t, g, unknown, or other
  misc_feature (375)..(375): n is a, c, t, g, unknown, or other
  misc_feature (410)..(410): n is a, c, t, g, unknown, or other
  misc_feature (430)..(430): n is a, c, t, g, unknown, or other
  misc_feature (431)..(431): n is a, c, t, g, unknown, or other
  misc_feature (541)..(541): n is a, c, t, g, unknown, or other
  misc_feature (595)..(595): n is a, c, t, g, unknown, or other
ttccccgcggtggcggccgctctagaactagtggatcccccgggctgcaggaattcgcacgagaccattacctagaacatcctaatcgaaaatttttgcacagtttgcacgagacgtgcagtttgcacctgatctgcagctgcaggcctgcagcccccgagtccgaaatcgttggacggggaaaggaaagcgaaacaagccacgctaagcaagatgcaccgaaaccctcgcgccgtcatccgcgccgccgtctccctcacccgccggccccccgccgttcctgccgcggaggctctccaaaccctgcctaaagcgacgccctcgcctgcgcttggggcgtgccgnccagacccagcggtggggcctttgggtagngtcagccgccgccgcgccttctccttcctcgcggnagagtatggcaaggatgtgnnacgagtgaaccgcaagttcgcggaggcgcggaaggagatcgaggcggccatggagagcaaggagacggtctacttcaacgaggaggcctccatcgcgcgtgacgccgccnacgaggcgctcgctgctttcgacgcgcttttagcgcgcctcccgcccacggacngcgacgcgctcccgcgcttcatggggctaaagatgaaacactgaaggccgagctcaagcagctcgaggactaacccgactagctgcgaaaaggtttgagttttgcaaaaaatttggg

SEQ ID NO: 19838 - protein, 141 aa, Zea mays
  misc_feature: Ceres CLONE 1387565-F
  misc_feature (54)..(54): Xaa is any aa, unknown, or other
  misc_feature (66)..(66): Xaa is any aa, unknown, or other
  misc_feature (73)..(73): Xaa is any aa, unknown, or other
  misc_feature (110)..(110): Xaa is any aa, unknown, or other
  misc_feature (128)..(128): Xaa is any aa, unknown, or other
MHRNPRAVIRAAVSLTRRPPAVPAAEALQTLPKATPSPALGACRPDPAVGPLGXVSRRRAFSFLAXEYGKDVXRVNRKFAEARKEIEAAMESKETVYFNEEASIARDAAXEALAAFDALLARLPPTDXDALPRFMGLKMKH

SEQ ID NO: 19839 - DNA, 871 bp, Zea mays
  misc_feature: Ceres CLONE 1387566-F
  misc_feature (1)..(1): n is a, c, t, g, unknown, or other
  misc_feature (22)..(22): n is a, c, t, g, unknown, or other
nccctttactatcaccacatcnctcgaacccagctcccccctccttattaaaagctggagctccccgcggtggcggccgctctagaactagtggatcccccgggctgcaggaattcgcacgagaccattacctagaacatcctaatcgaaaaacgatcacacaccactccacagcagtatcaagagggatagagcaaggccacacacacacacacaccactaggctagcctagccttttagtcgtcaaggaggagcaagaagggcgcgcacgcaagcaggcaagcaagaagagagccgatcgaccgagagctagcaccgcgatggcgaggtcttccaagatgatggtggcggcacctcctgctgcccttgcccctggccgcgccaaccgcccaggcgaggaaccttccagacccccgacgaccggaaaaaaaggaccgacgcggtgggggcagccggaagaactttcccgcccttttcaaccggcctcggggggggggcgctgtccccggggggttcggggagggccctccccgggggggcaaccattcccttggggaagcaagcatttcccccggagtttccaccctatggcccccgggcataccggtcatacaaaatcctaaccccggaggttaccagggtttggccccggcacaacgggggaagcaatggcacccctcttttcggggggtggggggcccccccggggccttccaaggaggctatccggggagcaatgccccggggccccccccaacgggccgggattccgttcccccggagcaacccctcaaacagcctctgaaaacgcccaaaaggggtggtataaaaaaggcgggtgcgatcgtgtaaccgggaacaaccatccac

SEQ ID NO: 19840 - DNA, 712 bp, Zea mays
  misc_feature: Ceres CLONE 1387568-F
  misc_feature: Encodes the peptide sequence at SEQ ID NO. 19841
  misc_feature (354)..(354): n is a, c, t, g, unknown, or other
  misc_feature (392)..(392): n is a, c, t, g, unknown, or other
  misc_feature (443)..(443): n is a, c, t, g, unknown, or other
  misc_feature (492)..(492): n is a, c, t, g, unknown, or other
  misc_feature (514)..(514): n is a, c, t, g, unknown, or other
  misc_feature (517)..(517): n is a, c, t, g, unknown, or other
  misc_feature (518)..(518): n is a, c, t, g, unknown, or other
  misc_feature (533)..(533): n is a, c, t, g, unknown, or other
  misc_feature (534)..(534): n is a, c, t, g, unknown, or other
  misc_feature (556)..(556): n is a, c, t, g, unknown, or other
  misc_feature (559)..(559): n is a, c, t, g, unknown, or other
  misc_feature (560)..(560): n is a, c, t, g, unknown, or other
  misc_feature (600)..(600): n is a, c, t, g, unknown, or other
tccccgcggtggcggccgctctagaactagtggatcccccgggctgcaggaattcgcacgagaccattacctagaacatcctaatcgaaaaaaacctaaacctctcacccggcgccgccgccgccgccgccaccgccgccgccccgaggccccatcccagcgaaaccgacttccgcctcggattgaagcaatgtcgtcggacgacgaggtcagggaggagaaggagctcgacctctcctccaacgatgtcgtcaccaagtacaagactgccgccgaaatcctgaacaacgctctgaagctggttgtgtctgagtgcaagccaaaagcaaagattgttgacctttgtgagaaggntgactctttcataagagagcaaactgggaatgtctacnagaatggcaagaggaagattgaaaggggcattgctttcccaacctgtgttncggtgaaacacacagtctgccacttctccccgcttacacagatgatgcnagtctggaagaaatgacatggntannattgacatggggtgnncatatgatgggcttatggctgnggnngcacatacacatgtaatttgcaatggggctgtcacagaangagcagctgatgttctgctgctgccacacagcagcaaaagtgcaatggagcttgcagacctgggaaaaaaataggatgtactgagcattcagaaagtgctgctgtatgatga

SEQ ID NO: 19841 - protein, 105 aa, Zea mays
  misc_feature: Ceres CLONE 1387568-F
  misc_feature: SWISSPROT Homolog: EC 3.4.11.18 Methionyl aminopeptidase
  misc_feature (55)..(55): Xaa is any aa, unknown, or other
  misc_feature (68)..(68): Xaa is any aa, unknown, or other
  misc_feature (85)..(85): Xaa is any aa, unknown, or other
  misc_feature (101)..(101): Xaa is any aa, unknown, or other
MSSDDEVREEKELDLSSNDVVTKYKTAAEILNNALKLVVSECKPKAKIVDLCEKXDSFIREQTGNVYXNGKRKIERGIAFPTCVXVKHTVCHFSPLTQMMXVWKK

SEQ ID NO: 19842 - DNA, 811 bp, Zea mays
  misc_feature: Ceres CLONE 1387569-F
  misc_feature: Encodes the peptide sequence at SEQ ID NO. 19843
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (19)..(19): n is a, c, t, g, unknown, or other
  misc_feature (20)..(20): n is a, c, t, g, unknown, or other
nnnnnnnnncccccccccnncccccccggggggccacccgacttttttaattttgttgctccccggcggggcggccgctctagaatagtggatcccccgggctgcaggaattcgcacgagaccattacctagaacatcctaatcgaaaatcgccatttcaccaccgcctccgcccccatcctctccccctcccgtcgcgccagtcaacagcctgtctgcctcttccctcgccacccatggccaccgtagcgcgcacccctcgtcgccgcatgcccggcacgctctctcctccgcttccggtctcggggcctcccgtcctcctcttccatccgtcccggcggggaacgtgccggcgtcgggtctgtccgctgcatgggctcggcgaccggattccctcctattcccccgctgcgttccggggaaggggggggggccgggcaccgactgaaatgggcccccgctgttcccctgggtgcaaattacgagcactgggctcatcggcatggaacaaaaccggggggggggagggggccacccaaggaagcaaaatggattgattggctaaatcccagaaccctttggcccaggtggttaagggaagggaaaaaggaaggccaaaaaaaaaaagaaaataacaatgggggcccctggaaaaggggttatttttggggattccggcgggggcgaaattttgagggaaaaaaacccccccaaacaaaagctccggagggggctctcccaggggggttccttttttgtggcggttccccggaactcttaaaaggggggagaggcgggagaacaacaaaga

SEQ ID NO: 19843 - protein, 146 aa, Zea mays
  misc_feature: Ceres CLONE 1387569-F
MGSATGFPPIPPLRSGEGGGAGHRLKWAPAVPLGANYEHWAHRHGTKPGGGRGPPKEAKWIDWLNPRTLWPRWLREGKKEGQKKKENNNGGPWKRGYFWGFRRGRNFEGKKPPQTKAPEGALPGGFLFCGGSPELLKGGRGGRTTK

SEQ ID NO: 19844 - DNA, 694 bp, Zea mays
  misc_feature: Ceres CLONE 1387570-F
  misc_feature: Translation starting site: 179
  misc_feature (421)..(421): n is a, c, t, g, unknown, or other
  misc_feature (448)..(448): n is a, c, t, g, unknown, or other
  misc_feature (614)..(614): n is a, c, t, g, unknown, or other
  misc_feature (694)..(694): n is a, c, t, g, unknown, or other
ccccgcggtggcggccgctctagaatagtggatcccccgggctgcaggaattcgcacgagaccattacctagaacatcctaatcgaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagccgtccgcggcgaagaagccggcggcgcaccctccctacgctgagatgattgtagaggcatcgcttgccctcagggagaggaaggggtcgagctcggtggccatcagncagtacgtcgagggggaagcacggcgncaagctccccaccaacttccgcaagcagctcaccgtgcagctgaagaagctcgctgccgccggcaagctgacgagggtgaaaaacttcttcaagctgccggccaccgacgccaggcccagggccgccagcccaaggcaccaaggccgcgcccagcccagccctcgncggagggggaaggcaagacgctgcaagcccagagcggcgtcgcccagccaaggccagggccaggcaagccaaggccagcn

SEQ ID NO: 19845 - DNA, 734 bp, Zea mays
  misc_feature: Ceres CLONE 1387572-F
  misc_feature: Encodes the peptide sequence at SEQ ID NO. 19846
  misc_feature (329)..(329): n is a, c, t, g, unknown, or other
  misc_feature (330)..(330): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (614)..(614): n is a, c, t, g, unknown, or other
tccccgcggtggcggccgctctagaactagtggatcccccgggctgcaggaattcgcacgagaccattacctagaacatcctaatcgaaaaatctacctcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcgnncggtcgatgctggtgctgtccgggctgatcctggccggcaccgtgatcgcgctcacggtggcacccccgtgctgtgactcaccgnnntttttttggggccgccgcccccttcgggttggggctcatggggggccgggttccgccccctccggcggcctcggggtcgttgggctggtccgtgttccccgggttgggccggttcctggcgggctggccccccgccgggcgccgcccggctgggccccggccgggggggggtggggggcccggggcccgcggcttcnggggtggggcccggccccggttcgcccggggggcggggggtttttgggggtggctcccccttcgggggggccggggggggggccctccttggcccctgggcgggtgggggggttttttgt

SEQ ID NO: 19846 - protein, 184 aa, Zea mays
  misc_feature: Ceres CLONE 1387572-F
  misc_feature (50)..(50): Xaa is any aa, unknown, or other
  misc_feature (79)..(79): Xaa is any aa, unknown, or other
  misc_feature (145)..(145): Xaa is any aa, unknown, or other
MADHHRGATGGGGGYGDLQRGGGMHGEAQQQQKQGAMMTALKAATAATFXRSMLVLSGLILAGTVIALTVAPPCCDSPXFFWGRRPLRVGAHGGPGSAPSGGLGVVGLVRVPRVGPVPGGLAPRRAPPGWAPAGGGWGARGPRLXGWGPAPVRPGGGGFLGVAPPSGGPGGGPSLAPGRVGGFF

SEQ ID NO: 19847 - DNA, 725 bp, Zea mays
  misc_feature: Ceres CLONE 1387574-F
  misc_feature: Translation starting site: 360
  misc_feature (568)..(568): n is a, c, t, g, unknown, or other
  misc_feature (617)..(617): n is a, c, t, g, unknown, or other
  misc_feature (627)..(627): n is a, c, t, g, unknown, or other
tggagctccccgcggtggcggccgctctagaactagtggatcccccgggctgcaggaattcgcacgagaccattacctagaacatcctaatcgaaaaaaaaatgaaccacgatttctcttcagttctttccttgcgtgcacggctgctcgtcaattcggctgccgaaattatcccgttgccttctggttcccacgacaaaagcggcattaccccggtcgctttataaattggactttcttactttcggcacggccaccggacagctccccacaaaaccgtcagttctctttttcccctgtaaatcgcaaattcgtctttcctgcccatctatcgcttggacacctctgcaagggagcacatggctctcgagaaggccaaggagatcatcgcgtcctccccggtcgacctagctctccgaaagccaagggagacgtcgccctccaccccgtcgtcgtcttcagcaaacttactgtcctttctgcacccgagtgaaacattgctagcaaagttgggggcagttacaaggctatttgagtggatgtggaaagtgatggcgctgaactgcantcagctctcgctgaatggactgggcagaagactgttcccaatgtcttcntgaaaagggnagcggattggtggctgttgaccaaccatggcgatgcacgacgggtgggaactggtgcctctgctccaccgaggttgagcaattgcactgcccgggctc

SEQ ID NO: 19848 - DNA, 731 bp, Zea mays
  misc_feature: Ceres CLONE 1387575-F
  misc_feature: Encodes the peptide sequence at SEQ ID NO. 19849
  misc_feature (393)..(393): n is a, c, t, g, unknown, or other
  misc_feature (410)..(410): n is a, c, t, g, unknown, or other
  misc_feature (411)..(411): n is a, c, t, g, unknown, or other
  misc_feature (429)..(429): n is a, c, t, g, unknown, or other
  misc_feature (439)..(439): n is a, c, t, g, unknown, or other
  misc_feature (443)..(443): n is a, c, t, g, unknown, or other
  misc_feature (569)..(569): n is a, c, t, g, unknown, or other
ggagctccccgcggtggcggccgctctagaactagtggatcccccgggctgcaggaattcgcacgagaccattacctagaacatcctaatcgaaagaactactccgtcactttgtttgcaaagctcctcctcgatccatcgatcacttcaccggccggcggcaccgcgctcgcaggggctagccaacgagacggcagcaatggcggaccgtgaccgcagcggcatctacggcggcgcccacgccacctacgggcagcagcagcagcagggaggagggcggcgcccgatgggtgagcaggtgaagggcatgctccacgacaagtggccgacggcgtcgcaggcgctgacggtggcgacgctgttccccgctaggcggctgctgctggtgctgtncgggctggcgctgacgnnctccgtggtggggctggncgtggccacngcgntggttctgatcttcagccccgtgctggtcccccgcgcgctgctcatcgggacggccgtcatggggttcctcacgtcgggcgcgctgggggctcagggggcctgtcctcggtcacgtgcctcgacangagggggcggggagcgttccagcggaccccggactacgtggaggaggcgcaccgcaggagggcggaggccccgggccaagcggtccaaaaaccgcgaaggcgggccagccattcagggcagggcccaggaagccgaccccggggaaatgttcaaggtcccct

SEQ ID NO: 19849 - protein, 177 aa, Zea mays
  misc_feature: Ceres CLONE 1387575-F
  misc_feature (44)..(161): Pfam Name: Oleosin Pfam Description: Oleosin
  misc_feature (65)..(65): Xaa is any aa, unknown, or other
  misc_feature (71)..(71): Xaa is any aa, unknown, or other
  misc_feature (77)..(77): Xaa is any aa, unknown, or other
  misc_feature (82)..(82): Xaa is any aa, unknown, or other
  misc_feature (124)..(124): Xaa is any aa, unknown, or other
MADRDRSGIYGGAHATYGQQQQQGGGRRPMGEQVKGMLHDKWPTASQALTVATLFPARRLLLVLXGLALTXSVVGLXVATAXVLIFSPVLVPRALLIGTAVMGFLTSGALGAQGACPRSRASTXGGGERSSGPRTTWRRRTAGGRRPRAKRSKNREGGPAIQGRAQEADPGEMFKVP

SEQ ID NO: 19850 - DNA, 718 bp, Zea mays
  misc_feature: Ceres CLONE 1387576-F
  misc_feature: Encodes the peptide sequence at SEQ ID NO. 19851
  misc_feature (467)..(467): n is a, c, t, g, unknown, or other
  misc_feature (573)..(573): n is a, c, t, g, unknown, or other
ggagctccccgcggtggcggccgctctagaactagtggatcccccgggctgcaggaattcgcacgagaccattacctagaacatcctaatcgaaaagttcccctctctcttccccgtcctgcaggctccaggcgctgctgctctcgtcctccgctagcgagcgaatcgctgacgctggcccgacgccgcggcgggaggtatctcgctttcgatcaggattttggttggggcgtcgttctccggtgcttatctcatttctatttatcggtgcctcgggttcacggccaaattcgctgctgcgtggggctttggagattggagccgattccttaaagtggcggtggcagcgtctggtgggaacctgagcttcgtgttccgaggaagcagggccgacatcgaggccggtggcttcacagggttcgcccccgagcgccgcaccatgcgaattctggcagggagcaggccgntgatagcaattcccttgtttttctctaaactggtttttgttttgttcatgggactgaactcacaccagatgtctccaatcttttgctttgggatagtcttgggagncttcctaatggccacgagccttagaatgtatgccacgtgccagcagcttgctcatgctgcaactgcaaaacagttttcttggcaactgggacttggcgggtgcatgtacccgccgacattgcctttggtacgaagagggcaggta

SEQ ID NO: 19851 - protein, 93 aa, Zea mays
  misc_feature: Ceres CLONE 1387576-F
  misc_feature (10)..(10): Xaa is any aa, unknown, or other
  misc_feature (45)..(45): Xaa is any aa, unknown, or other
MRILAGSRPXIAIPLFFSKLVFVLFMGLNSHQMSPIFCFGIVLGXFLMATSLRMYATCQQLAHAATAKQFSWQLGLGGCMYPPTLPLVRRGQV

SEQ ID NO: 19852 - DNA, 722 bp, Zea mays
  misc_feature: Ceres CLONE 1387578-F
  misc_feature: Encodes the peptide sequence at SEQ ID NO. 19853
  misc_feature (437)..(437): n is a, c, t, g, unknown, or other
  misc_feature (637)..(637): n is a, c, t, g, unknown, or other
  misc_feature (710)..(710): n is a, c, t, g, unknown, or other
  misc_feature (712)..(712): n is a, c, t, g, unknown, or other
gcggtggcggccgctctagaactagtggatcccccgggctgcaggaattcgcacgagaccattacctagaacatcctaatcgaaaaaaaaaaaggattagggttctaacaaaatcaagatatttcaccagaggaacacagaggctgtgcttaagatgttgtcagagattgggagtgttgataacattccagagttcatagagggtgtgaagaacaggaagaggaagatgtctggttttggacaccgtgtgtacaaaaactatgacccaagagctaaagtcatcaagaagctagcagatgaagtgttctccattgttggaagagatcctctaattgaagtagccgttgctctggagaaggcagctctttctgatgattactttgttaagaggaagctttatccaaatgttgatttctactctggtttaatctacaggncaatggggtttcaccagagttctttaccgtctttgttgctattcctcgcatgcctggatacttgtctcattggaaagagtcgttggatgatcctgacaccaagatcatgagggccacacaggtgtacaccggagtgtggcttaggcattacacaccagttaaagagagggatgagcccaaggagtcagacaagttgagtncagtctctacttctatgcatcaaggagacggttggctggattcttcagtttaggtccattatcatataccttnanaacacactgc

SEQ ID NO: 19853 - protein, 130 aa, Zea mays
  misc_feature: Ceres CLONE 1387578-F
  misc_feature: SWISSPROT Homolog: EC 2.3.3.1 Citrate (Si)-synthase
  misc_feature (95)..(95): Xaa is any aa, unknown, or other
MLSEIGSVDNIPEFIEGVKNRKRKMSGFGHRVYKNYDPRAKVIKKLADEVFSIVGRDPLIEVAVALEKAALSDDYFVKRKLYPNVDFYSGLIYRXMGFHQSSLPSLLLFLACLDTCLIGKSRWMILTPRS

SEQ ID NO: 19854 - DNA, 678 bp, Zea mays
  misc_feature: Ceres CLONE 1387579-F
  misc_feature (310)..(310): n is a, c, t, g, unknown, or other
  misc_feature (314)..(314): n is a, c, t, g, unknown, or other
  misc_feature (315)..(315): n is a, c, t, g, unknown, or other
  misc_feature (318)..(318): n is a, c, t, g, unknown, or other
  misc_feature (331)..(331): n is a, c, t, g, unknown, or other
  misc_feature (336)..(336): n is a, c, t, g, unknown, or other
  misc_feature (339)..(339): n is a, c, t, g, unknown, or other
  misc_feature (342)..(342): n is a, c, t, g, unknown, or other
  misc_feature (351)..(351): n is a, c, t, g, unknown, or other
  misc_feature (367)..(367): n is a, c, t, g, unknown, or other
  misc_feature (393)..(393): n is a, c, t, g, unknown, or other
  misc_feature (394)..(394): n is a, c, t, g, unknown, or other
  misc_feature (551)..(551): n is a, c, t, g, unknown, or other
cgcggtggcggccgctctagaactagtggatcccccgggctgcaggaattcgcacgagaccattacctagaacatcctaatcgaaaagaccatgttcaaaacgaaaagtctgatctgaagccagcagacgtgaaaccgacagcacgtacgtacgtacgtgtgagggctgctcggcggccatgggagaatggtgcttcagaaacgcgcagctctggtgattatttgtgccattattagctcgctgcagctgctccctgatactgctcaagaagctggaggagaccccacgagtgtgtcgtcgtcatcctcnccgnncgntgtcgtggtggcngcccntcntcntcccacggngcgatggggccgacgntctccttccgtgtcggggaagaggcnntgttttttacaaaaaagggccaccctctggcaggggatcccgcctacccgtgagtcatcacgtctgcggggaggtgaccgtgacaactgacgttcctgggggactcccctcacggactcgcaacccggcaagtccaggggccctttcaaaattggtnttaaggggggccccccttaacccaaggaaacctctcttccagactccactccttccctacagtaagggtcccctcgcggggggccaaaaaatctccaccctactactaggggtcttccgcgggcggg

SEQ ID NO: 19855 - DNA, 710 bp, Zea mays
  misc_feature: Ceres CLONE 1387580-F
  misc_feature: Encodes the peptide sequence at SEQ ID NO. 19856
  misc_feature (449)..(449): n is a, c, t, g, unknown, or other
  misc_feature (450)..(450): n is a, c, t, g, unknown, or other
  misc_feature (551)..(551): n is a, c, t, g, unknown, or other
  misc_feature (701)..(701): n is a, c, t, g, unknown, or other
tccccgcggtggcggccgctctagaactagtggatcccccgggctgcaggaattcgcacgagaccattacctagaacatcctaatcgaaaaattcccctcccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaccctaatcctagcgctcatcaagcagatgttcggcgccggcgcggagaaaggtaagctggagaacaagacatggaaaatcgatactggaaacaggacatttgagatagaattggcgatnngtgtcagtgctcaccatgtggagatgacccccagtgatgctggctttcaggacaggtatgttgttcagggagtcatcaaagagatggcgaagaacaggccnattgatgccaaaggcagagagcattttaagtccttgtggttaatggagtcgacaagctctcacgagaagccagcatccccctcgcaggactatggaaaagatagctcatcatgtagactggatctatgctgtacagctcctcaaaggganggaagctgt

SEQ ID NO: 19856 - protein, 49 aa, Zea mays
  misc_feature: Ceres CLONE 1387580-F
MLWVDKYRPKTLDKVTVHDQVAQNLRKFVSEQDCPHLLFYGPSGSGKKP

SEQ ID NO: 19857 - DNA, 728 bp, Zea mays
  misc_feature: Ceres CLONE 1387582-F
  misc_feature: Encodes the peptide sequence at SEQ ID NO. 19858
  misc_feature (311)..(311): n is a, c, t, g, unknown, or other
  misc_feature (513)..(513): n is a, c, t, g, unknown, or other
  misc_feature (586)..(586): n is a, c, t, g, unknown, or other
  misc_feature (661)..(661): n is a, c, t, g, unknown, or other
  misc_feature (667)..(667): n is a, c, t, g, unknown, or other
aaagctggagctccccgcggtggcggccgctctagaactagtggatcccccgggctgcaggaattcgcacgagaccattacctagaacatcctaatcgaaaaattgtggctcctcacttccgcgccgccacccccttcaggtaaggaagaggaggagggcaggatgtcgcaccgtaagttcgagcacccgaggcacggctccctcggcttccttcccaggaagcgctcctcccgccaccgcggcaaggtgaagtcattccccagggatgaccccaagaagccttgccatctcactgccttccttggctacnaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagcgaagaagtgaggagaanggtctacaagaactggtgcaagagcaagaagaaggctttcacaaagtatgctctcaaatatgaaaatgatgcntgcaagaaggaaattcagctgcagcttgagaagatgaagaatatgcttctggtatccgtgtcattgctcataccnagatangaaagatgaagggtttgaaacagaagaggctcacctgatggagattcaggtcaatggtggt

SEQ ID NO: 19858 - protein, 170 aa, Zea mays
  misc_feature: Ceres CLONE 1387582-F
  misc_feature (51)..(167): Pfam Name: Ribosomal_L3 Pfam Description: Ribosomal protein L3
  misc_feature (50)..(50): Xaa is any aa, unknown, or other
  misc_feature (117)..(117): Xaa is any aa, unknown, or other
  misc_feature (168)..(168): Xaa is any aa, unknown, or other
MSHRKFEHPRHGSLGFLPRKRSSRHRGKVKSFPRDDPKKPCHLTAFLGYXAGMTHIVREVEKPGSKLHKKETCEAVTIIETPPLVIVGLVAYVKTPRGLRTLNSVWAQHLSEEVRRXVYKNWCKSKKKAFTKYALKYENDACKKEIQLQLEKMKNMLLVSVSLLIPRXER

SEQ ID NO: 19859 - DNA, 694 bp, Zea mays
  misc_feature: Ceres CLONE 1387583-F
  misc_feature: Encodes the peptide sequence at SEQ ID NO. 19860
  misc_feature (401)..(401): n is a, c, t, g, unknown, or other
  misc_feature (411)..(411): n is a, c, t, g, unknown, or other
  misc_feature (467)..(467): n is a, c, t, g, unknown, or other
  misc_feature (490)..(490): n is a, c, t, g, unknown, or other
  misc_feature (535)..(535): n is a, c, t, g, unknown, or other
aagctggagctccccgcggtggcggccgctctagaactagtggatcccccgggctgcaggaattcgcacgagaccattacctagaacatcctaatcgaaaaattccttcactgccagtcttgcatcccgtccccgtccgcgccggccgacgccgccttttcgtccccgcgtcagcgtcgcggctccactgagcgtgcgtgtcaccggcgggaggcaagggcaggcggtggtggcgatggcgtccgctgacgcgcgcttggcggggatcgcctcctccatccgcgtcatccccgacttccccaagccagggatcatgttccaggacatcacgacgttgctgctcgatcccaaggcgttccgtgacaccatcgacctctttgtcgagcggtacaggacaaggnatcaccgtgntttgctgtgtgaaagctagaggtttcatttttggtcctctatcgctttagcattgncgcaaaattgtgcctttgagaanccgaaagagttgcaaggcgagtgatctccgaagagtattctttgnaatatggactgacaataaaaatgctggtcgaagctgacaggcaacgacggctcttggaatcgatgtctattgctacggggacattttgtgagtgaaatttatttaacggtggaacaaaaggttttggaggggggttgggcatgatgcccaaaatgaggc

SEQ ID NO: 19860 - protein, 64 aa, Zea mays
  misc_feature: Ceres CLONE 1387583-F
  misc_feature: SWISSPROT Homolog: EC 2.4.2.7 Adenine phosphoribosyltransferase
  misc_feature (56)..(56): Xaa is any aa, unknown, or other
  misc_feature (59)..(59): Xaa is any aa, unknown, or other
MASADARLAGIASSIRVIPDFPKPGIMFQDITTLLLDPKAFRDTIDLFVERYRTRXHRXLLCES

SEQ ID NO: 19861 - DNA, 708 bp, Zea mays
  misc_feature: Ceres CLONE 1387585-F
  misc_feature: Encodes the peptide sequence at SEQ ID NO. 19862
  misc_feature (509)..(509): n is a, c, t, g, unknown, or other
  misc_feature (537)..(537): n is a, c, t, g, unknown, or other
  misc_feature (607)..(607): n is a, c, t, g, unknown, or other
  misc_feature (608)..(608): n is a, c, t, g, unknown, or other
tcaccgcggtggcggccgctctagaactagtggatcccccgggctgcaggaattcgcacgagaccattacctagaacatcctaatcgaaaaactaccagtccaccaccaccactgctaccatcggttccccaaaccctagccaagggacacggtggccagcgatggacggcgacagagaaggcgctgcggcggtgcaccaccacgcgcgctcccccgaggacgtcttccgcgatttccgcgcgcgccgcgccggcatcgtcaaggcactcaccacggatgtggagaagttctatcagcagtgcgatccagagaaagagaacttgtgcctttatggtttgccaaatgagacttgggaggttactcttccagctgaggaagtacctcctgagcttccagaaccagcactgggcataaacttttgcccgtgatggaatgttgaaaaagactggttgtctctagttgcagttcatagtgatgcgtggctcctgtctggtgcattctactttgnagctcgcttttgatttgataagatgcangggagaggctctttcacatgattaataacctgcccactgtttatgaaagtgtgacccgggttgctaaaanngcatcaaaagccccccacgcagcagcaaagcagcaaatctactctaaccatcaaacagatcatttctacaggaagcctgtgaagccagcacccaacgaga

SEQ ID NO: 19862 - protein, 88 aa, Zea mays
  misc_feature: Ceres CLONE 1387585-F
MDGDREGAAAVHHHARSPEDVFRDFRARRAGIVKALTTDVEKFYQQCDPEKENLCLYGLPNETWEVTLPAEEVPPELPEPALGINFCP

SEQ ID NO: 19863 - DNA, 734 bp, Zea mays
  misc_feature: Ceres CLONE 1387586-F
  misc_feature: Translation starting site: 195
tccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacggccagcagcagcagcagggaggaggcggccgcccgatgggtgagcaggtgaagggcatgctccacgacaaggggccgacggcgtcgcaggcgctgacgggggcgacgctgttcccgctgggcgggctgctgctggtgctgtcggggctggcgctgacgccctccggggtggggttgcccggggccaccccggggttcctgaatttcagccccgggcttggccccgccgggttggtcatcgggaagggccgtcatggggttccctcccgtcgggcgcggtggggggattggggggccttggcctccttctacgggcctccccaaaaaggggggggaaaggggttccagccgccccccgggaaaaaagggggaggggggcgcaccctacaggatagggggaaggccctgggccaccccgggtccaaaaaaaccggcgagggggtgccaagcccattcaggggcaagggcctcgagaaaggcacatgcacc

SEQ ID NO: 19864 - DNA, 729 bp, Zea mays
  misc_feature: Ceres CLONE 1387587-F
  misc_feature: Translation starting site: 242
  misc_feature: SWISSPROT Homolog: EC 4.1.1.33 Diphosphomevalonate decarboxylase
  misc_feature (434)..(434): n is a, c, t, g, unknown, or other
  misc_feature (597)..(597): n is a, c, t, g, unknown, or other
  misc_feature (610)..(610): n is a, c, t, g, unknown, or other
  misc_feature (640)..(640): n is a, c, t, g, unknown, or other
  misc_feature (641)..(641): n is a, c, t, g, unknown, or other
  misc_feature (671)..(671): n is a, c, t, g, unknown, or other
  misc_feature (689)..(689): n is a, c, t, g, unknown, or other
  misc_feature (721)..(721): n is a, c, t, g, unknown, or other
ggagctccccgcggtggcggccgctctagaactagtggatcccccgggctgcaggaattcgcacgagaccattacctagaacatcctaatcgaaaaaatccatttacctgtccaccaaaccagtctgtagtgttttttccctccctaatgaacagaccacggaggtgacgaagcagcggtagagacaaattagcgagcagagaaggggtactggcgatgacacaccttgccattgagccacatgcggtcggaagggaatgaggggctgacggcgacagtggtggtggcgcagagatggtcggggtcgagcgttacgctgatgctgtcgttgatggggaggatgagcgcctcgtcccgcttcccccagtacttgatcaccgcaatgttggtcggcgtccgccccgttgccatgagcacccactgcccctccgccngcgccattggatctctcgcttcgcgctgctctatgcccgataattccttgcaaagggaagttagtaggcataatccctactactctataagcacggtgtgtaggcgtgcacaccgtgcgccatcgttctgccagcctcccgatgctcccctggccagatcggntcacacttttgtncgcgcaatcattcggtacctggccctcaannatctcccccctcgtcccccgtcaggatctncatcgcgcattgatggcngtctcgctgccccctcgcagccctggccccgntcgaggtg

SEQ ID NO: 19865 - DNA, 772 bp, Zea mays
  misc_feature: Ceres CLONE 1387588-F
  misc_feature: Encodes the peptide sequence at SEQ ID NO. 19866
  misc_feature (514)..(514): n is a, c, t, g, unknown, or other
  misc_feature (636)..(636): n is a, c, t, g, unknown, or other
  misc_feature (772)..(772): n is a, c, t, g, unknown, or other
tggagctccccgcggtggcggccgctctagaactagtggatcccccgggctgcaggaattcgcacgagaccattacctagaacatcctaatcgaaaaatacctcctcaaggcacgttcaccacagtcctctctttccccggcaccaccaccaccacccaggctaacaggactggaccgagtgttgaacaacactgcagtgagtgacggcaggcatggtgagccgtgaaaatttgcacctggtgctggacccggagtctctgggcgcgccttgggccgacccgtccgccgcagagatcccgccgcagctcctcgccgcgctgggagagaacctctcctccgcccgcgtcgacgtcaagacggaggcgaacgacgagttcatgatgcacgaattccaggtgcggcgttgcccacgcgcacgaattccccaaatggacggggccgccttaccctcccccgggggaggccgcgccgcgtttgtacccggcgccgggggaaccaaccaaggagaatccntgacagtttttcagcccccttctcggatccctggccccccccttgccccttgtgcctcttcattccccttacgctcccgcgtgacaatttagcggggggcccctcccccccccccgttaacnaccggaacccctgcccgtacaagttttctaccctgcccgaagcttggtttattgtttcttcaaacccgcccacaaggggaagcgctccggctggccctcctgaaacacaatggcaccagtcctttgacgggccacn

SEQ ID NO: 19866 - protein, 130 aa, Zea mays
  misc_feature: Ceres CLONE 1387588-F
  misc_feature (101)..(101): Xaa is any aa, unknown, or other
MVSRENLHLVLDPESLGAPWADPSAAEIPPQLLAALGENLSSARVDVKTEANDEFMMHEFQVRRCPRARIPQMDGAALPSPGGGRAAFVPGAGGTNQGESXTVFQPPSRIPGPPLAPCASSFPLRSRVTI

SEQ ID NO: 19867 - DNA, 723 bp, Zea mays
  misc_feature: Ceres CLONE 1387592-F
  misc_feature: Encodes the peptide sequence at SEQ ID NO. 19868
  misc_feature (338)..(338): n is a, c, t, g, unknown, or other
  misc_feature (359)..(359): n is a, c, t, g, unknown, or other
  misc_feature (383)..(383): n is a, c, t, g, unknown, or other
  misc_feature (414)..(414): n is a, c, t, g, unknown, or other
  misc_feature (429)..(429): n is a, c, t, g, unknown, or other
  misc_feature (451)..(451): n is a, c, t, g, unknown, or other
ggagctccccgcggtggcggccgctctagaactagtggatcccccgggctgcaggaattcgcacgagaccattacctagaacatcctaatagaaaaacactgatggccccgccagatccaagccgcgacccagacggcaagatagagcgagcgacctctcgattctccccatcccgccgtgcttcccgtcttcaccaaatccttcgccacgatggcgcgcctgctcatccccctccccttcgccgccgcctctgcctcatcgctccacctcgccgtctcccgccttcctctcgccgcggtctccgccgcgcgtcgcgagtgtctctttgggagaaggntggtacgacgagtggtgaggncgcccgcgaggctttctaagcgcnggttgtgcgccggcgcagaggctggcgactncgccgtcacgttggnagccatggaatgtgtccagaangacaggggagcgctgctccacgtcgtctacccgcgtcggggacctcgacaagacgatcaagtctacacggagtgcctgggcatgaaattggtgaggaaagaggacatccccgaggagaggtacaccatgcctttctgggggacgggcctgaggatccacattttggttggggagtcacttaccattatggggggggaaactataacatcgggaactggttttgggccactttggaattgctggtgagggatggtgaaaaaaaggggaactta

SEQ ID NO: 19868 - protein, 161 aa, Zea mays
  misc_feature: Ceres CLONE 1387592-F
  misc_feature: SWISSPROT Homolog: EC 4.4.1.5 Lactoylglutathione lyase
  misc_feature (43)..(43): Xaa is any aa, unknown, or other
  misc_feature (50)..(50): Xaa is any aa, unknown, or other
  misc_feature (58)..(58): Xaa is any aa, unknown, or other
  misc_feature (68)..(68): Xaa is any aa, unknown, or other
  misc_feature (73)..(73): Xaa is any aa, unknown, or other
  misc_feature (80)..(80): Xaa is any aa, unknown, or other
MARLLIPLPFAAASASSLHLAVSRLPLAAVSAARRECLFGRRXVRRVVRXPARLSKRXLCAGAEAGDXAVTLXAMECVQXDRGALLHVVYPRRGPRQDDQVYTECLGMKLVRKEDIPEERYTMPFWGTGLRIHILVGESLTIMGGETITSGTGFGPLWNCW

SEQ ID NO: 19869 - DNA, 715 bp, Zea mays
  misc_feature: Ceres CLONE 1387593-F
  misc_feature: Encodes the peptide sequence at SEQ ID NO. 19870
  misc_feature (359)..(359): n is a, c, t, g, unknown, or other
  misc_feature (364)..(364): n is a, c, t, g, unknown, or other
  misc_feature (366)..(366): n is a, c, t, g, unknown, or other
  misc_feature (367)..(367): n is a, c, t, g, unknown, or other
  misc_feature (377)..(377): n is a, c, t, g, unknown, or other
  misc_feature (378)..(378): n is a, c, t, g, unknown, or other
  misc_feature (398)..(398): n is a, c, t, g, unknown, or other
  misc_feature (437)..(437): n is a, c, t, g, unknown, or other
  misc_feature (441)..(441): n is a, c, t, g, unknown, or other
  misc_feature (466)..(466): n is a, c, t, g, unknown, or other
  misc_feature (485)..(485): n is a, c, t, g, unknown, or other
  misc_feature (507)..(507): n is a, c, t, g, unknown, or other
  misc_feature (520)..(520): n is a, c, t, g, unknown, or other
  misc_feature (521)..(521): n is a, c, t, g, unknown, or other
  misc_feature (633)..(633): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagaagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctggccgcgncggtncnnactgccacgnnccgtcatgtggccgccgccnggtcatctggccgcccgcacatgccactaccctactcanccgnccccggccctcagctcatccccagncacacccatgcccgtggcnacagccgcatcccagcccgtgncagctgcaggaannctttggcgggttgcagcaccccgatcctggggcaggggggtccaagtcctgaggcatcaagggagccccaaaggggacccctatggttcgcctcagggccaaccgtttgggnaacaaggtttccaaaacttcagggaggtgagccccacaccggaaccagggatttttcggtttgggcccccgccatctggaaa

SEQ ID NO: 19870 - protein, 80 aa, Zea mays
  misc_feature: Ceres CLONE 1387593-F
  misc_feature (12)..(12): Xaa is any aa, unknown, or other
  misc_feature (16)..(16): Xaa is any aa, unknown, or other
  misc_feature (54)..(54): Xaa is any aa, unknown, or other
MPVATAASQPVXAAGXLWRVAAPRSWGRGVQVLRHQGSPKGDPYGSPQGQPFGXQGFQNFREVSPTPEPGIFRFGPPPSG

SEQ ID NO: 19871 - DNA, 719 bp, Zea mays
  misc_feature: Ceres CLONE 1387594-F
  misc_feature: Encodes the peptide sequence at SEQ ID NO. 19872
  misc_feature (396)..(396): n is a, c, t, g, unknown, or other
  misc_feature (483)..(483): n is a, c, t, g, unknown, or other
  misc_feature (517)..(517): n is a, c, t, g, unknown, or other
  misc_feature (525)..(525): n is a, c, t, g, unknown, or other
  misc_feature (555)..(555): n is a, c, t, g, unknown, or other
  misc_feature (613)..(613): n is a, c, t, g, unknown, or other
aagctggagctccccgcggtggcggccgctctagaactagtggatcccccgggctgcaggaattcgcacgagaccattacctagaacatcctaatcgaaaatcgccatttcaccaccgcctccgcccccatcctctccccctcccgtcgcgccagtcaacagcctgtctgcctcttccctcgccacccatggccaccgtagcgcgcaccctcgtcgccgcatgcccggcacgctctctcctccgcttccggtctcggcgcctcccgtcctcctcttccatccgtcccgcgcggcaacgtgccggcgtcgggtctgtccgctgcatggctcggcgaccggattcctcctattccccgctgcgttcggggcagggcggtgaccgtgcaccgactgaantggcgccgctgttccctggttgcgattacgagcactggctcatcgtcatggacaaacccggggggcgagggcgccaccaagcagcanatgattgattgctacatccagacccttgcccagntgctaggnagtgaagaaggagcgaaaaaaagatatacnatgtgtcctgcgagcgctatttttggatcggatgcgaaattgatgaaagactccaccnactcgagggctttcccgggggggttctttttggctcctgaatccttatgtgagcgaacaaggaaatttggggggtggattattcggaaagggaaaacaccctccag

SEQ ID NO: 19872 - protein, 100 aa, Zea mays
  misc_feature: Ceres CLONE 1387594-F
  misc_feature (70)..(70): Xaa is any aa, unknown, or other
  misc_feature (99)..(99): Xaa is any aa, unknown, or other
MATVARTLVAACPARSLLRFRSRRLPSSSSIRPARQRAGVGSVRCMARRPDSSYSPLRSGQGGDRAPTEXAPLFPGCDYEHWLIVMDKPGGRGRHQAAXD

SEQ ID NO: 19873 - DNA, 733 bp, Zea mays
  misc_feature: Ceres CLONE 1387596-F
  misc_feature: Encodes the peptide sequence at SEQ ID NO. 19874
  misc_feature (367)..(367): n is a, c, t, g, unknown, or other
  misc_feature (368)..(368): n is a, c, t, g, unknown, or other
  misc_feature (392)..(392): n is a, c, t, g, unknown, or other
  misc_feature (417)..(417): n is a, c, t, g, unknown, or other
  misc_feature (473)..(473): n is a, c, t, g, unknown, or other
  misc_feature (474)..(474): n is a, c, t, g, unknown, or other
aagctggagctccccgcggtggcggccgctctagaactagtggatcccccgggctgcaggaattcgcacgagaccattacctagaacatcctaatcgaaaaaaaaacacatccatcctcgctagctcgctctctcttgcaactccagtgcttctcactgccactgccagcaggtcgagctgctccgcaagtctgctttgctgctgcacctgcaagtctgcaaccgcgcacagagatgtcgacgactgtgagccgtgcgtccctcgaccagaaactcgccctcgccaagcgctgctcccgagaggcgaccctcgccggagccaaggcggcagccgtggcgactatcgcctccgcgatccccaccctgnncagcgtgcggatgctgccatgggncaaggccaaacatcacccccacggnccagcgctcatcgtctccaccgtggctggggatggcctacttcatcgccgccgatnnagaagatcctgtcgctggcgaagcgcccctcgttcgaccaagccctggacacctcaaaaacacctcctccaggggaccggccggcccacccggttttcttcagggcgggaaaagaaaccccgcaaagatattaataaccggcccttttagggccgcggggaaataaccccccaatgccccccggcccttaaaaaatttaatgggaagtttttttttttgaaaaaaaaaaaaaaatttttcaccccccccccgggggggg

SEQ ID NO: 19874 - protein, 129 aa, Zea mays
  misc_feature: Ceres CLONE 1387596-F
  misc_feature (12)..(81): Pfam Name: ENOD93 Pfam Description: Early nodulin 93 ENOD93 protein
  misc_feature (45)..(45): Xaa is any aa, unknown, or other
  misc_feature (53)..(53): Xaa is any aa, unknown, or other
  misc_feature (80)..(80): Xaa is any aa, unknown, or other
MSTTVSRASLDQKLALAKRCSREATLAGAKAAAVATIASAIPTLXSVRMLPWXKAKHHPHGPALIVSTVAGDGLLHRRRXRRSCRWRSAPRSTKPWTPQKHLLQGTGRPTRFSSGREKKPRKDINNRPF

SEQ ID NO: 19875 - DNA, 719 bp, Zea mays
  misc_feature: Ceres CLONE 1387597-F
  misc_feature: Encodes the peptide sequence at SEQ ID NO. 19876
  misc_feature (312)..(312): n is a, c, t, g, unknown, or other
  misc_feature (365)..(365): n is a, c, t, g, unknown, or other
  misc_feature (368)..(368): n is a, c, t, g, unknown, or other
  misc_feature (423)..(423): n is a, c, t, g, unknown, or other
  misc_feature (478)..(478): n is a, c, t, g, unknown, or other
tggagctccccgcggtggcggccgctctagaactagtggatcccccgggctgcaggaattcgcacgagaccattacctagaacatcctaatcgaaaagtccgatctctctcccgagtccactccaagccttttcgccttttcctccgccttctcgcgatggcgccgccgcgccgcgctctactcgtcctcgccgctctcctcctctccctctcccttggggccgcctccttccattccgacgagctcctcctcaacgatgacgaagagttcgagggcgtcgtcgcccgcccctccgccccctccccgccggnggccccggtggtctcctcctcccgccgcagatcagcggacgcgccgttgcccnggntcaggcgagtccaacgcagtgcagttcacgctcgagcacggacctggcgacggcnagggcttcgtctcagctggaaccttctcggcccgctcaagaccttcgcccacggnacgcagaccctcactaaacttcgcttttacaggaatgattttactgaggatgataaagcggcgttcaaaaaagtgcttcaggaaggatgctttttatacattaggctgccatctaatggggtggacactacaaagaaccatctggttgtttcttccatcagagctagatgcattccacggggaaggttgaatgaaccattggtatcccccgtggatgggggaaaaatcttgggaagcaata

SEQ ID NO: 19876 - protein, 187 aa, Zea mays
  misc_feature: Ceres CLONE 1387597-F
  misc_feature (52)..(52): Xaa is any aa, unknown, or other
  misc_feature (70)..(70): Xaa is any aa, unknown, or other
  misc_feature (71)..(71): Xaa is any aa, unknown, or other
  misc_feature (89)..(89): Xaa is any aa, unknown, or other
MAPPRRALLVLAALLLSLSLGAASFHSDELLLNDDEEFEGVVARPSAPSPPXAPVVSSSRRRSADAPLPXXRRVQRSAVHARARTWRRXGLRLSWNLLGPLKTFAHGTQTLTKLRFYRNDFTEDDKAAFKKVLQEGCFLYIRLPSNGVDTTKNHLVVSSIRARCIPRGRLNEPLVSPVDGGKILGSN

SEQ ID NO: 19877 - DNA, 719 bp, Zea mays
  misc_feature: Ceres CLONE 1387607-F
  misc_feature: Encodes the peptide sequence at SEQ ID NO. 19878
  misc_feature (420)..(420): n is a, c, t, g, unknown, or other
  misc_feature (487)..(487): n is a, c, t, g, unknown, or other
  misc_feature (536)..(536): n is a, c, t, g, unknown, or other
  misc_feature (599)..(599): n is a, c, t, g, unknown, or other
  misc_feature (662)..(662): n is a, c, t, g, unknown, or other
tcaccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggacatcaagaccacgacgacggaaaagaaggacgacgcggtggtgcagccgcagaccttcccgcccttcgacccgctcggnggcggcgcgtccccggcgttcggcggcctccccggcggcagcattcctggcagcagcatttccgggntcagcatgcccggcagcggcagcagccctaccccgggtcagcttgcccnggagcggagtgccctccttttttgggggggggggctccccggggctcagggggtttcgggggnattggccgggtccgccacccgggcgggctccgtccccgaggacgccaacaagccctgacggcnaaaagggtggggaaaaaaaaggggtgctactgttactgggaaaaacggcgtcgctcc

SEQ ID NO: 19878 - protein, 54 aa, Zea mays
  misc_feature: Ceres CLONE 1387607-F
  misc_feature (15)..(15): Xaa is any aa, unknown, or other
  misc_feature (36)..(36): Xaa is any aa, unknown, or other
MPGSGSSPTPGQLAXERSALLFWGGGLPGAQGVSGXLAGSATRAGSVPEDANKP

SEQ ID NO: 19879 - DNA, 636 bp, Zea mays
  misc_feature: Ceres CLONE 1387608-R
  misc_feature: SWISSPROT Homolog: EC 1.14.11.16 Peptide-aspartate beta-dioxygenase
cgaattgggtaccgggccccccctcgaggtcgacggtatcgataagcttttttttttttttttttgaatttaagagctttcatatgattccatggttctaaagaacttctcggagacaaaaaaaaaactcacggaatagtcgagaaagaaccaaatgacatggcaaggatcaaataaacatccagacaattctcaatcttaagattttccaaatgcaacgttcagatctccaagcttttgctatgactggtaaaacttgaaatgaggaagaaaaatgttgtttcaattcttcatacctctccatcaccagattccgaatcttcatcttctctccaagaaagaattggactgagtgaagatgactcatatgacactgattgtaagaagttgaaataagcatacttgatgtcgaactgcatgtcataccaatagttgaccgcaatggtatagccaccatctcctggggtttgactaacatggtgaaaccacatgcttggcaggtaaagaatttccccagccttgagagtacagtgaaacggctttgggccatcaaagaagaaaggatatttcaatctctcacttgcttccctctcaggcgaagggtatggatcaacactgcaccatggcacatgcctc

SEQ ID NO: 19880 - DNA, 742 bp, Zea mays
  misc_feature: Ceres CLONE 1387609-F
  misc_feature: Encodes the peptide sequence at SEQ ID NO. 19881
  misc_feature (419)..(419): n is a, c, t, g, unknown, or other
  misc_feature (483)..(483): n is a, c, t, g, unknown, or other
  misc_feature (548)..(548): n is a, c, t, g, unknown, or other
  misc_feature (559)..(559): n is a, c, t, g, unknown, or other
  misc_feature (718)..(718): n is a, c, t, g, unknown, or other
  misc_feature (719)..(719): n is a, c, t, g, unknown, or other
aaactggagctccccgcggtggcggccgctctagaactagtggatcccccgggctgcaggaattcgcacgagaccattacctagaacatcctaatcaaaatcaagcttagctagttaactgtgcaattagttgagtcagtagataagcttgttccgtcttaacttatctaccgatcgagctcgcggcaatggcgatgatggcatgcaataacactcgaccccgcaagttgtcgcttgccatgccgcacccgtacttttccaagccttaatactaagcacagcagtcttcctggcttgcttccacggccgtcgtcgtcggcaaggagccacaaccaccgtcctcctccggcggcggctgtcactaccgcttcgagctcacccacgtagatgccaacctcaaccttaccagcgacgagttngatgcgtcgtgcctatgacaggagccgcctccgcgcggcgagcttggccgcctactcggacggncgacacgaagggcgcgttagcattcctgacgctcgtacatcatcacgttttacttgggcaacagncggccgagaancatcttcccgccgtcgtggacaccggcagcgacatattttgacgaccgaagaaggaattgtagccgttcccagaacagggtcatggctgcttgctgcagccccaagtgcgagcacggcccccctttggggggtgcggacgaagcgagctcagggcgaannccgaaaaggaaaaccaagtgccc

SEQ ID NO: 19881 - protein, 33 aa, Zea mays
  misc_feature: Ceres CLONE 1387609-F
  misc_feature (26)..(26): Xaa is any aa, unknown, or other
MAACCSPKCEHGPPLGGADEASSGRXPKRKTKC

SEQ ID NO: 19882 - DNA, 739 bp, Zea mays
  misc_feature: Ceres CLONE 1387611-F
  misc_feature: Encodes the peptide sequence at SEQ ID NO. 19883
  misc_feature (218)..(218): n is a, c, t, g, unknown, or other
  misc_feature (250)..(250): n is a, c, t, g, unknown, or other
  misc_feature (267)..(267): n is a, c, t, g, unknown, or other
  misc_feature (305)..(305): n is a, c, t, g, unknown, or other
  misc_feature (631)..(631): n is a, c, t, g, unknown, or other
tggagctccccgcggtggcggccgctctagaactagtggatcccccgggctgcaggaattcgcacgagaccattacctagaacatcctaatcgaaaatctatcgcactcgtagtcgtagctcaagcatcagcggcaggagctctgggcagcgtgcgcacgtggggtacctagctcgctctgctagcctaccatggctgatcaccaccggggtgcgacnggaggtggcgggggctacgccgacctcagcgncggggcggcatgcacgncgaagcgcaacaacacagaagcagggcgccatgatgancgcgctcaagggcgcgacggccgcgacctttcgcgggtcgatgctggtgctgtccggcctgatcctggccggcaccgtgatccgcctcacgggggcaccccccgtgctggtgatcttcaacccgtggctggtgcccggccccctccccctggggctcttggggggcgggttccccccctccggggggcctgggagtcctggggttgcccgtgttttcccgggaatgacaaataacctggaagggaaaacccccgccgggggccaaacaattggacacccgcaaggggaggttgggggcccaaggcccccgaatttagggagtgggnaaaagtccccgcttctacaaggggagaggggttttagaaaaaaaaacccacactcggggggagcccggccgcgaaaacttctttaaaacagtggcgggggggggagaa

SEQ ID NO: 19883 - protein, 139 aa, Zea mays
  misc_feature: Ceres CLONE 1387611-F
  misc_feature (1)..(112): Pfam Name: Oleosin Pfam Description: Oleosin
  misc_feature (3)..(3): Xaa is any aa, unknown, or other
  misc_feature (112)..(112): Xaa is any aa, unknown, or other
MMXALKGATAATFRGSMLVLSGLILAGTVIRLTGAPPVLVIFNPWLVPGPLPLGLLGGGFPPSGGPGSPGVARVFPGMTNNLEGKTPAGGQTIGHPQGEVGGPRPPNLGSGXKSPLLQGERGFRKKNPHSGGARPRKLL

SEQ ID NO: 19884 - DNA, 667 bp, Zea mays
  misc_feature: Ceres CLONE 1387614-F
  misc_feature (391)..(391): n is a, c, t, g, unknown, or other
  misc_feature (448)..(448): n is a, c, t, g, unknown, or other
  misc_feature (503)..(503): n is a, c, t, g, unknown, or other
cgcggtggcggccgctctagaactagtggatcccccgggctgcaggaattcgcacgagaccattacctagaacatcctaatcgaaaatgtttgtgacagtccagtcaaattcgtttcaagtgtcgtttgcagcggagcgcatgcttcctcatcatatgatgatataaatatagaacaagcacaattaactacttcaccatatggatctgaggatacctcagcatcaggtacaagctgtgcagcagtgggagcagttattttggctgatgaatccagcaagctcggtaacttgacatcagatcttgaagttgatacaattcagacaatgccactgcacacatctttagaatgcgtcgctcaaaagggtgaaacaaagctttgaggaaatcangaaggttgccgagcaaacattgtgctgagtttctagagagctaagttcttgctgacnaggaacacttaaacttaggtgggcatgaagtgaattgaaacatcatttccagacnaaggttttcctcccaaaacttccgggcaaaataaaaattgaggtttaaaatgatccgaaacccatggccggccttcttatttcttttaattgaaaaaaagggggtgggtccctttaaaaaagccagggaaaccttgggttttccaaaacgggtttccaaaaaag

SEQ ID NO: 19885 - DNA, 752 bp, Zea mays
  misc_feature: Ceres CLONE 1387615-F
  misc_feature: Translation starting site: 260
  misc_feature (501)..(501): n is a, c, t, g, unknown, or other
aaagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataaagaccgcggacatcacgatgatgccttcagcaccttcttcagccagactggtgctgggaagcaccgtccccgtgcatcctcgttgatctaaaacccactgggatcgatgaggtggggactggnacgtaccggcagttcttccacctgaggaagtatcaggggcagggggaggccgtaacaatttcccccggggcccctacccaattggaaaggaaaattggggatctgggccttgaccgaaccccaaatttggttaaaaatgccccgggcccagggtttcggggtttaaaagccttgggggggggacaggcctcgggcctggttcctcccccctggaacccccttttggggaaaccaaaaaaaacacaaggggg

SEQ ID NO: 19886 - DNA, 702 bp, Zea mays
  misc_feature: Ceres CLONE 1387619-F
  misc_feature: Encodes the peptide sequence at SEQ ID NO. 19887
  misc_feature (615)..(615): n is a, c, t, g, unknown, or other
aaagctggagctccccgcggtggcggccgctctagaactagtggatcccccgggctgcaggaattcgcacgagaccattacctagaacatcctaatcgaaaaaacccagggtgagtctccggatccgtcgccgtctggtctccgtgtgctctcgtcgccgtcgccgtcgccgccgtctgactgaccccctcgcctcccgcggcgtcgggtctctggtgctgctgctactgctgctgcgtgcagggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaggaagttgagaagttggctgccgctttgccagaaagtggagttctgctcctagagaatgttanattctacaagggagaagagaagaacgaacctgagtttgctaagaagctagcatctgttgcttgcctttatgtcaatgatgctttttg

SEQ ID NO: 19887 - protein, 150 aa, Zea mays
  misc_feature: Ceres CLONE 1387619-F
  misc_feature (3)..(150): Pfam Name: PGK Pfam Description: Phosphoglycerate kinase
  misc_feature: SWISSPROT Homolog: EC 2.7.2.3 Phosphoglycerate kinase
  misc_feature (122)..(122): Xaa is any aa, unknown, or other
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPESGVLLLENVXFYKGEEKNEPEFAKKLASVACLYVNDAF

SEQ ID NO: 19888 - DNA, 710 bp, Zea mays
  misc_feature: Ceres CLONE 1387622-F
  misc_feature: Encodes the peptide sequence at SEQ ID NO. 19889
  misc_feature (520)..(520): n is a, c, t, g, unknown, or other
  misc_feature (558)..(558): n is a, c, t, g, unknown, or other
  misc_feature (562)..(562): n is a, c, t, g, unknown, or other
  misc_feature (577)..(577): n is a, c, t, g, unknown, or other
  misc_feature (598)..(598): n is a, c, t, g, unknown, or other
  misc_feature (603)..(603): n is a, c, t, g, unknown, or other
aagctggagctccccgcggtggcggccgctctagaactagtggatcccccgggctgcaggaattcgcacgagaccattacctagaacatcctaatcgaaaaatcaccaagttttggattccagcagcggcgcccccaggccaggccccacccgctcagcctcctcagctgcccaaccttctccccatctgctcagcctcagctgtcattcccgcgaagcgccgtctcccggctctatcgatggaccgagtcgccgccctcgtcgtcgcgctcctcgccctcttcttcgccgccggggccacggcgcaggccccggcctcgtcgcccaagcgcactccagcgccagcgccacccaggacggccttcctcccgccgccgccggccagggcgcctatggcctccccgccctcgcctcccgcgatggcgccggtgcccgcgccctccgccggcgtgccggccacgagccccgtcggcgcgggagctggtgacgacgcgatggcccccgccggaggccgcgcggntctgactccggctggcgcgccggtcacggagaagagcngcgncgtttcaagctccgncgcgccgcgcaggctcggggncatcngttgccgcctggcaacccgcggccccgtttaaaacggggaccgacctgggaaatttgaaatggcggggggggaaccccgggaggagctaaagattggcccttttccg

SEQ ID NO: 19889 - protein, 131 aa, Zea mays
  misc_feature: Ceres CLONE 1387622-F
  misc_feature (94)..(94): Xaa is any aa, unknown, or other
  misc_feature (107)..(107): Xaa is any aa, unknown, or other
  misc_feature (108)..(108): Xaa is any aa, unknown, or other
  misc_feature (113)..(113): Xaa is any aa, unknown, or other
  misc_feature (120)..(120): Xaa is any aa, unknown, or other
  misc_feature (122)..(122): Xaa is any aa, unknown, or other
MDRVAALVVALLALFFAAGATAQAPASSPKRTPAPAPPRTAFLPPPPARAPMASPPSPPAMAPVPAPSAGVPATSPVGAGAGDDAMAPAGGRAXLTPAGAPVTEKSXXVSSSXAPRRLGXIXCRLATRGPV

SEQ ID NO: 19890 - DNA, 719 bp, Zea mays
  misc_feature: Ceres CLONE 1387626-F
  misc_feature: Encodes the peptide sequence at SEQ ID NO. 19891
aagctggagctccccgcggtggcggccgctctagaactagtggatcccccgggctgcaggaattcgcacgagaccattacctagaacatcctaatcgaaaagcgctcaagaagctctgcatcaagggttgccctgtgtcagatcgtgggatggaagcactaaatggggggtgccccagtttagtcaaggtgaagctgaagagatgtcgtggagtgtcatacgagtgcattgagaacctgaaggttactaggggggagtcattttccatcagcttggatgttgtattggagcatgatgccgggagcactagtgaaaatggtgcacaagagaatggacagacacaaattacagagctggccggtcaaatgacaggcatggacctcctcaccaatgccgctggcacacaatcatcgattcataccattaacaggatgaggagtgtcatgtcagcgatccggcgtaggtttggcaatcctctgccaccatgatgattccatgcccataagaccaagattgattattcaaatgacggttgctgaaaaattctacatgactatattattactctattccataacaaagaaaagctagaacgaaaaaaaaaaaaaaaaaagcttatcgataccgtcgacctcgagggggggcccggtacccaattcgccctatagtgagtcgtattacgcgcgctcactggccgtcgttttacaacgtcgtgactg

SEQ ID NO: 19891 - protein, 161 aa, Zea mays
  misc_feature: Ceres CLONE 1387626-F
AGAPRGGGRSRTSGSPGLQEFARDHYLEHPNRKALKKLCIKGCPVSDRGMEALNGGCPSLVKVKLKRCRGVSYECIENLKVTRGESFSISLDVVLEHDAGSTSENGAQENGQTQITELAGQMTGMDLLTNAAGTQSSIHTINRMRSVMSAIRRRFGNPLPP

SEQ ID NO: 19892 - DNA, 711 bp, Zea mays
  misc_feature: Ceres CLONE 1387633-F
  misc_feature: Encodes the peptide sequence at SEQ ID NO. 19893
  misc_feature (556)..(556): n is a, c, t, g, unknown, or other
  misc_feature (586)..(586): n is a, c, t, g, unknown, or other
  misc_feature (679)..(679): n is a, c, t, g, unknown, or other
  misc_feature (681)..(681): n is a, c, t, g, unknown, or other
aaagctggagctccccgcggtggcggccgctctagaactagtggatcccccgggctgcaggaattcgcacgagaccattacctagaacatcctaatcgaaaaattatcaagaaaccatgagttctaggttagctgaaatctcccttattgtaatctgttcatctcctggcgtgagtctgtggcgctagtgtgatgccttctcctagctcatggcttccggttcgcaatccctaatcctgatctcacttaagcgctcgtgagctctctccagtggctaaagattgcagatttgagttatagtccaagaaacgggtggtggtccgccatggaggtgaggtccgagcaagggctgatggcggggagggatctattcggtatgccaaagagcccgccggcgccggtttccgggccgccggcgtccgccgccatgcagagcgtgcgcatggcgtacacctcggacggcaccgctgtgttcgctccgatgagatcctcggccgcgacgccgtcttaccagccgcagggtgcagcccacggcgctagcatgtccgcggcgacnatcattggaggcaatggcgcggcagctgcngcgagcatgggggagccggtgcccagaaagagcgcgggcgaaagggagtatgggcccgacggtccatggcgctgcattggtgccctgtgtcgncngctacggggtcgcgacgacagggcagggtt

SEQ ID NO: 19893 - protein, 128 aa, Zea mays
  misc_feature: Ceres CLONE 1387633-F
  misc_feature (119)..(119): Xaa is any aa, unknown, or other
MEVRSEQGLMAGRDLFGMPKSPPAPVSGPPASAAMQSVRMAYTSDGTAVFAPMRSSAATPSYQPQGAAHGASMSAATIIGGNGAAAAASMGEPVPRKSAGEREYGPDGPWRCIGALCRXLRGRDDRAG

SEQ ID NO: 19894 - DNA, 681 bp, Zea mays
  misc_feature: Ceres CLONE 1387635-F
  misc_feature: Encodes the peptide sequence at SEQ ID NO. 19895
  misc_feature (575)..(575): n is a, c, t, g, unknown, or other
  misc_feature (607)..(607): n is a, c, t, g, unknown, or other
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaaatcgcttatcatccgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactccccactgatgagactcttgtgacccaaattaaggaaggntcgaaagcgggaaggatcttgtggactgtcannttggcatgggggaggacaaaactgccgctaaagatgttggcccaagaacttctttggttttgaaacggaccta

SEQ ID NO: 19895 - protein, 162 aa, Zea mays
  misc_feature: Ceres CLONE 1387635-F
  misc_feature (86)..(153): Pfam Name: eIF-5a Pfam Description: Eukaryotic initiation factor 5A hypusine, DNA-binding OB fold
  misc_feature (30)..(64): Pfam Name: KOW Pfam Description: KOW motif
  misc_feature (142)..(142): Xaa is any aa, unknown, or other
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVTQIKEGSKAGRILWTVXLAWGRTKLPLKMLAQELLWF

SEQ ID NO: 19896 - DNA, 729 bp, Zea mays
  misc_feature: Ceres CLONE 1387637-F
  misc_feature: Encodes the peptide sequence at SEQ ID NO. 19897
  misc_feature (242)..(242): n is a, c, t, g, unknown, or other
  misc_feature (437)..(437): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (464)..(464): n is a, c, t, g, unknown, or other
aagctggagctccccgcggtggcggccgctctagaactagtggatcccccgggctgcaggaattcgcacgagaccattacctagaacatcctaatcgaaaaaattttctgaagcttgggcgggatctcggctcgcctccgtccatctctatggcgccacggggccaccacctggcggaggtggccctcctcgcctctgcttcgtcggacctcgcagccgcaggcgccggcgagagggagggntggttggacgaccccgccatcctcccctcgctcgggccccgcgcgcgatccctcgcagtggccagcgcggcgcactccgtgctcgtgatcgtcgcggtggcgggaggtggaggcggcggggtcacggtggagcctgcgctggggcccgacgagggccgaatctccgccgttgagtgggtcccgttcgccgggggnacagaatgcagaggnnnannnaggggntgtccgtggtgatcggcacggacgctgggtggctactgttctactcgctcgcaggcgatctattgcacaagcagagtatatatcctgcaaagatactgaaactcaactttcgtgagaggaaggagaacgcttgggaagattcaggctcagatgaactttctgtagtgtttcctggtgttatcgcgcgctttgatggtgctgaccttcagaacgttcttaaaaaagcatttcaagatgtaaaatcacgcctgtggaaagataagtt

SEQ ID NO: 19897 - protein, 95 aa, Zea mays
  misc_feature: Ceres CLONE 1387637-F
  misc_feature (4)..(4): Xaa is any aa, unknown, or other
  misc_feature (5)..(5): Xaa is any aa, unknown, or other
  misc_feature (6)..(6): Xaa is any aa, unknown, or other
  misc_feature (8)..(8): Xaa is any aa, unknown, or other
MQRXXXGXSVVIGTDAGWLLFYSLAGDLLHKQSIYPAKILKLNFRERKENAWEDSGSDELSVVFPGVIARFDGADLQNVLKKAFQDVKSRLWKDK

SEQ ID NO: 19898 - DNA, 646 bp, Zea mays
  misc_feature: Ceres CLONE 1387638-F
  misc_feature (534)..(534): n is a, c, t, g, unknown, or other
  misc_feature (646)..(646): n is a, c, t, g, unknown, or other
tccccgcggtggcggccgctctagaactagtggatcccccgggctgcaggaattcgcacgagaccattacctagaacatcctaatcgaaaaagttcttctccacctcgtcctcctcctgctcctgcattctcgcccgtcccccaaattcaccttggccaccctccaccacctcgtcgacgcgggcagcagttcgcctcatcgtcctcccacctgacgacgtcgcggttcgcgctctcgcggcgtgccgcgcacccacgtctcccgcgagttccacgccttctgtgccacgcgcggacgcgccacctggagccactgttcgccgcgccctccgcatctccgacctctacatctccatccgcggaagcagaccacctccaatccttctttttcacgcagtcattgcttgcctccttagcccaactgttggtaccagaggttcatgtttcatcataaggaatgaacagtagtcgacaaatggaactccactacataaacactggatttccatacacaatcaccgagagcttcatggnatttctttgagggtctcacttttgctcatgctgactttgctctcacggatggctttcaggatcagggtaatccatactgggaaatgatgcatacaaactcgtacaatatggn

SEQ ID NO: 19899 - DNA, 681 bp, Zea mays
  misc_feature: Ceres CLONE 1387641-F
  misc_feature: Translation starting site: 209
  misc_feature (513)..(513): n is a, c, t, g, unknown, or other
  misc_feature (548)..(548): n is a, c, t, g, unknown, or other
  misc_feature (549)..(549): n is a, c, t, g, unknown, or other
  misc_feature (570)..(570): n is a, c, t, g, unknown, or other
tggagctccccgcggtggcggccgctctagaactagtggatcccccgggctgcaggaattcgcacgagaccattacctagaacatcctaatcgaaaaaatcaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtgggtggggctggccaggcccacgccggtgttcctgatcttcagccccgtgctcgtccccgccgcgctgctcatccgggacggccggncatggggtcccttcacgtcgggcgcgctggggggnnttttggggggcctgtccctcngctcacgtgcctcgccaacacggggggggggaaggcgttccagcgcacccgggaactaaacccgggggagggaggcgcaacgcaaggaaaaaggcgggaaagcccgccggg

SEQ ID NO: 19900 - DNA, 683 bp, Zea mays
  misc_feature: Ceres CLONE 1387645-F
  misc_feature (556)..(556): n is a, c, t, g, unknown, or other
  misc_feature (596)..(596): n is a, c, t, g, unknown, or other
  misc_feature (646)..(646): n is a, c, t, g, unknown, or other
aaagctggagctccccgcggtggcggccgctctagaactagtggatcccccgggctgcaggaattcgcacgagaccattacctagaacattctaatcgaaaactcttcgtctcgtctcgtctgcagtagcagtctccgcatccgcttgcctccgcctcctccgtcgatttggattcgcagcggcggcggcggccaatcaaagcaatcatcacccagtcgcccagcccaacaaacgctccagtccccagccctcccacccgcctcgatcgatgcgaggcacaatgccggccaccgactcctcctcctcctcctcctcctcgccggcggcggcgccgctgtcctccatcggccgctccatccgctcgctccgccgtgaccagaaccagatccactccttcccgccgccgccagacgccacagacgccttccagcgccgcgccgcccaactcctggccgacctcccggcagccgacgacgtcctctccctcgcctggacgcgccgcctcctcgaatccttcctctctgccctcgaggagttccgcgccctgctcttccngctccggggactcgcccgctgctcggcccccgctcgaccngcctcgtcgccgacttctcccgaccgcgcccgtcaaggcgctcgacttcntgcaacgcccgtccgcgacggcctcgacctcgtttcc

SEQ ID NO: 19901 - DNA, 693 bp, Zea mays
  misc_feature: Ceres CLONE 1387660-F
  misc_feature: Encodes the peptide sequence at SEQ ID NO. 19902
aagctggagctccccgcggtggcggccgctctagaactagtggatcccccgggctgcaggaattcgcacgagaccattacctagaacatcctaatcgaaaaaagattactctgtcttctcaagccataaaataaatcccatattgaggaaggataagcctcgtcggcgactaaatcatggtttcatctaacaacaatatggttcatgcttgtgtctacgcatcgtcttcttcactcagggttacaggcggattcctctccgcgagtcccaacgcctcctctttcgattctcataagctttccctccctttcgagcctcttcggtcgagaaagaccaagaacgtagctactgtcagaaagaattggaatagctcgtctccgaaggctgtgtactccggcaatctctggacggcggagattccttcacctcaaggagtttggcccatcacagatgatttacaagtcccttcttcgccgtattttcctgcgtacgctcaaggacaaggaccacctcctatggtgcaagagcgtttccagagtatcataaggcagctcttccaatataggattattctctgtggaggtgctgtggacgatgatattgccaacataatcgtagctcagcttctttaccttgatgcctgtgatcctactaaggatatgggcatgtatgtgaactctcgtggtggatcat

SEQ ID NO: 19902 - protein, 172 aa, Zea mays
  misc_feature: Ceres CLONE 1387660-F
  misc_feature: SWISSPROT Homolog: EC 3.4.21.92 Endopeptidase Clp
MVSSNNNMVHACVYASSSSLRVTGGFLSASPNASSFDSHKLSLPFEPLRSRKTKNVATVRKNWNSSSPKAVYSGNLWTAEIPSPQGVWPITDDLQVPSSPYFPAYAQGQGPPPMVQERFQSIIRQLFQYRIILCGGAVDDDIANIIVAQLLYLDACDPTKDMGMYVNSRGGS

SEQ ID NO: 19903 - DNA, 639 bp, Zea mays
  misc_feature: Ceres CLONE 1387661-R
cgaattgggtaccgggccccccctcgaggtcgacggtatcgataagcttttttttttttttttttgtcgcaaatttagtttgaaaatgcataaatcacgatggtctcatagggcacttgttttgttcacagtatatcaaaatataaagtacaacgatattttgccaatattgtcgcaatcatacacgattttttgacatgacaaaaaacgaggagccaaccctgtcttcggtacttcatacatttggaaccattagcctttagctaggtcgtggcccgaaatggaagcatcgctgctcggctcttgtcaaaacaggtatgtgtaagcctttgcaagaagttccattcaatcttccttcgacttctcagcacaccagtagtaaaacactttagattctgaaattctgattaggaaagagcgtccagaattatcagctgatatttcttcaatcataacttccgaaaattcaaagtcgttgctcaagagagctagttgctctggataaccatcatcacaaacaaaggtaagccgcatgctagatgatggcagaagaacaaggttcagcttccctcttggacttgagatcgtttatgctctcgcactgctcctcgaccagcttgttgagcgatgccgccttct

SEQ ID NO: 19904 - DNA, 656 bp, Zea mays
  misc_feature: Ceres CLONE 1387661-F
  misc_feature: Translation starting site: 292
  misc_feature (507)..(507): n is a, c, t, g, unknown, or other
  misc_feature (586)..(586): n is a, c, t, g, unknown, or other
gctctagaactagtggatcccccgggctgcaggaattcgcacgagaccattacctagaacatcctaatcgaaaaatcccgtaatcgcagcctcgccccgctcgcatcttcctctccctctcagcgctggtgctcaatctacaggtcgtcccgctccctacacacccgccctccggtgtgaacctccatgacgtccacaaccactctccgatctgctgtcgtgacctcatccagccgtgctgtggcagtggatcggagttcgctccagctctgattggaattccactactatatgtgccacttgaagttgttatgttcaaataatatggtgaaaacgagcgtctattgggatctattttttatcttgcaaatgatcttcctgaaggaggtaatatattcttagatgaggtatatatcgtaatacttatagcataaacactcaagccactacaaactgccttcgtccccttcatcactgctgatgaccgtgacttggagacccgacgcnacccctcgacgttgtcgccgccgagcccatgctgtttccaccagtggtcacccggcccgggatgtggcccgccaagagnagcaaggaacggtgcagcgaaagccaaaaggtgttagatccagcacccgcctctgcacgaccatccattc

SEQ ID NO: 19905 - DNA, 740 bp, Zea mays
  misc_feature: Ceres CLONE 1387665-F
  misc_feature: Encodes the peptide sequence at SEQ ID NO. 19906
  misc_feature (367)..(367): n is a, c, t, g, unknown, or other
  misc_feature (439)..(439): n is a, c, t, g, unknown, or other
  misc_feature (460)..(460): n is a, c, t, g, unknown, or other
aagctggagctccccgcggtggcggccgctctagaactagtggatcccccgggctgcaggaattcgcacgagaccattacctagaacatcctaatcgaaaaacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcgncgtgctgcagcggggtgcgctcgctcaacagccgcgcgtcgtcgacggcggaccgcagggcacctgcaactngctcagggcatgacggccggnttcggggggggggggtcaggatgggccaacgccgccaaatcccctccaagggggggggcccccggtgggggggcccattaagccccccggggattgggccaaaaataaatggttcgatggaaccctaaggggggggaacctcccctccttgaaaggggaagggaacggggccaaaaaaaaaaaggaggcccccctgcaaaaaaaaaaaggcccacaaaaaccgggggggggggcggggccccaaacggggcaaaaaaaaaaaaaaaaaaaacatccgccc

SEQ ID NO: 19906 - protein, 135 aa, Zea mays
  misc_feature: Ceres CLONE 1387665-F
  misc_feature (39)..(126): Pfam Name: Tryp_alpha_amyl Pfam Description: Protease inhibitor/seed storage/LTP family
  misc_feature (63)..(63): Xaa is any aa, unknown, or other
  misc_feature (87)..(87): Xaa is any aa, unknown, or other
  misc_feature (94)..(94): Xaa is any aa, unknown, or other
MAARSSSSQPQLVAAAAVLAAALLLLAAGAGTASAAVSCGEVTSSVAPCLGYAMGSAASPSAXCCSGVRSLNSRASSTADRRAPATXSGHDGRXRGGGVRMGQRRQIPSKGGGPRWGGPLSPPGIGPKINGSMEP

SEQ ID NO: 19907 - DNA, 715 bp, Zea mays
  misc_feature: Ceres CLONE 1387666-F
  misc_feature: Encodes the peptide sequence at SEQ ID NO. 19908
  misc_feature (323)..(323): n is a, c, t, g, unknown, or other
  misc_feature (371)..(371): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (547)..(547): n is a, c, t, g, unknown, or other
  misc_feature (572)..(572): n is a, c, t, g, unknown, or other
  misc_feature (573)..(573): n is a, c, t, g, unknown, or other
  misc_feature (603)..(603): n is a, c, t, g, unknown, or other
  misc_feature (652)..(652): n is a, c, t, g, unknown, or other
aaactggagctccccgcggtggcggccgctctagaactagtggatcccccgggctgcaggaattcgcacgagaccattacctagaacatcctaatcgaaaaagttcgtggagtggagtcaccacagaatcaaagaaaagctttcccccgatcctctcgcggacaccagcgatgggttcccgctacgaggtggaggtcaccgtcggctccgcccgggacctcaagaacgtcaactggcgcaacggcgacctcaagccctacgccgtggtgtggatcgactccggcagcaagtgctcgacccgcgtcgacctcgacaacggcagnagcccggcgtgggacgagaagctgctcgtcccgctcccgcccacctcncgcctcggacgacccgtctctttatagtttcgacgtcgtccacgccaacgcgggcccagggcgtcaaggccgctccgtcggctccgcgcgcctcggnnntccgcgaggtctcgannnaannncccgggggggggcgggggggcaaagggccttcgcggcagccttccgccttcagncggccccctcgggccgccccccggnngggggctcgaacggccgggggtggccggtnaaaggaaccccgcccaaggatactacgaaccccaaccccctaccggggnccccggcggctacgccaaaaagggggcgggggggcacccgtgaccccctaacggtcggtccgt

SEQ ID NO: 19908 - protein, 75 aa, Zea mays
  misc_feature: Ceres CLONE 1387666-F
  misc_feature (51)..(51): Xaa is any aa, unknown, or other
MGSRYEVEVTVGSARDLKNVNWRNGDLKPYAVVWIDSGSKCSTRVDLDNGXSPAWDEKLLVPLPPTSRLGRPVSL

SEQ ID NO: 19909 - DNA, 694 bp, Zea mays
  misc_feature: Ceres CLONE 1387667-F
  misc_feature: Encodes the peptide sequence at SEQ ID NO. 19910
  misc_feature (474)..(474): n is a, c, t, g, unknown, or other
  misc_feature (495)..(495): n is a, c, t, g, unknown, or other
  misc_feature (513)..(513): n is a, c, t, g, unknown, or other
  misc_feature (514)..(514): n is a, c, t, g, unknown, or other
  misc_feature (525)..(525): n is a, c, t, g, unknown, or other
  misc_feature (526)..(526): n is a, c, t, g, unknown, or other
  misc_feature (671)..(671): n is a, c, t, g, unknown, or other
  misc_feature (672)..(672): n is a, c, t, g, unknown, or other
gaagctccccgcggtggcggccgctctagaactagtggatcccccgggctgcaggaattcgcacgagaccattacctagaacatcctaatcgaaaaagttcgaaaggttcaacttcaaacacactccaaactccaagcctcaataatctcgacctctgtaatgaccaagaagctcatctccatctccaccatggccgggaagcaaggttgcaaggagcagtccaatgatcggaggatccaggcttcgatccaaggagacgccaagagcgtggtggtggggttcggcggcaggctggtcacccgtgagcaggagcaggaggacgccatcatcgtcgcggcgctgcggcacgtggtgtccgggtacagcacgccgccgccggaggtcgtcgtcacggtggcgggcggggaggcgtgcgggactgcggcatcgacgggtgcctcggctgcgacttcttcggggcgccggagctgggncaaggaggcagtgtcctgcgncacagggcaagtggcacnnacagcgttcgnncccgggggcgggcaaaaaggggggggggggctgaagcccccgggggggggtaggaaacaggaacatgtaacccgcggcgtgcggaaacgggcggggggggcaaaggggggcccgggggaatatccgcggacccgcggcgcccggnncgcccccgtggtggtttgggcc

SEQ ID NO: 19910 - protein, 168 aa, Zea mays
  misc_feature: Ceres CLONE 1387667-F
  misc_feature (95)..(95): Xaa is any aa, unknown, or other
  misc_feature (102)..(102): Xaa is any aa, unknown, or other
  misc_feature (108)..(108): Xaa is any aa, unknown, or other
  misc_feature (112)..(112): Xaa is any aa, unknown, or other
  misc_feature (161)..(161): Xaa is any aa, unknown, or other
MAGKQGCKEQSNDRRIQASIQGDAKSVVVGFGGRLVTREQEQEDAIIVAALRHVVSGYSTPPPEVVVTVAGGEACGTAASTGASAATSSGRRSWXKEAVSCXTGQVAXTAFXPGGGQKGGGGLKPPGGGRKQEHVTRGVRKRAGGAKGGPGEYPRTRGARXAPVVVWA

SEQ ID NO: 19911 - DNA, 647 bp, Zea mays
  misc_feature: Ceres CLONE 1387671-F
  misc_feature: Encodes the peptide sequence at SEQ ID NO. 19912
tctgaactagtggatcccccgggctgcaggaattcgcacgagaccattacctagaacatcctaatcgaaaaatagtactagaaaaatggccatggcagccgccaccgcgaatgccatcttgctcttggctctcttcttcgccggcgctcacgcgaatgtcccatgcatactccccgtatgcaagacggtgggtggcgggagccggttcttcgacgtgcagttctgcctggcggcactcggctccgatggccggagcgtcgaccactgcctcgactaccaggtctactccgccattgccgctgacctcctcgcggccaacctcaccgctacggcggccaagatcaacggcctgctccggaagagcggcggctccgccgacgaggccacgacgcgctgtctccggtcctgtcaagcgttgtacggcgacatggaacggaggcagactggctgcgcggctgccgtccggggcgtcagggaagggtgaggccaccaggtgccttggaggaagtcgcgtcagctgctgaggagtgcgcgagggacgggttccagagggagcaagtggggggccccgccggggatgggggagaaaccaggcaagggttcaagctcgcccaagctcgcttgtcgcgctggttgcggcacggtgg

SEQ ID NO: 19912 - protein, 132 aa, Zea mays
  misc_feature: Ceres CLONE 1387671-F
MAMAAATANAILLLALFFAGAHANVPCILPVCKTVGGGSRFFDVQFCLAALGSDGRSVDHCLDYQVYSAIAADLLAANLTATAAKINGLLRKSGGSADEATTRCLRSCQALYGDMERRQTGCAAAVRGVREG

SEQ ID NO: 19913 - DNA, 642 bp, Zea mays
  misc_feature: Ceres CLONE 1387674-F
  misc_feature: Encodes the peptide sequence at SEQ ID NO. 19914
  misc_feature (537)..(537): n is a, c, t, g, unknown, or other
tggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgccggtgttcctgatcttcagccccgtgctggtccccgccgcgctgctcatcgggacggccgtcatggggtccctcacgtcgggcgcgctggggggctcggggggcctgtccntcgctcacgtgcctcgccaacacggcggcggcaggcgttccagcgcacccgggactaaacgtggaggaggcgcaccgcagggaatgcccggaggccgcgggcgca

SEQ ID NO: 19914 - protein, 152 aa, Zea mays
  misc_feature: Ceres CLONE 1387674-F
  misc_feature (44)..(138): Pfam Name: Oleosin Pfam Description: Oleosin
  misc_feature (118)..(118): Xaa is any aa, unknown, or other
MADRDRSGIYGGAHATYGQQQQQGGGGRPMGEQVKGMLHDKGPTASQALTVATLFPLGGLLLVLSGLALTASVVGLAVATPVFLIFSPVLVPAALLIGTAVMGSLTSGALGGSGGLSXAHVPRQHGGGRRSSAPGTKRGGGAPQGMPGGRGR

SEQ ID NO: 19915 - DNA, 691 bp, Zea mays
  misc_feature: Ceres CLONE 1387682-F
  misc_feature (331)..(331): n is a, c, t, g, unknown, or other
  misc_feature (384)..(384): n is a, c, t, g, unknown, or other
  misc_feature (388)..(388): n is a, c, t, g, unknown, or other
  misc_feature (389)..(389): n is a, c, t, g, unknown, or other
  misc_feature (458)..(458): n is a, c, t, g, unknown, or other
  misc_feature (503)..(503): n is a, c, t, g, unknown, or other
  misc_feature (504)..(504): n is a, c, t, g, unknown, or other
  misc_feature (521)..(521): n is a, c, t, g, unknown, or other
  misc_feature (578)..(578): n is a, c, t, g, unknown, or other
  misc_feature (585)..(585): n is a, c, t, g, unknown, or other
  misc_feature (592)..(592): n is a, c, t, g, unknown, or other
  misc_feature (678)..(678): n is a, c, t, g, unknown, or other
  misc_feature (679)..(679): n is a, c, t, g, unknown, or other
tggagctccccgcggtggcggccgctctagaactagtggatcccccgggctgcaggaattcgcacgagaccattacctagaacatcctaatcgaaaaataaacaactcgaccaaacccaagtccagacccgcagctcccgtcagccgccggaggcggagggaaccgagccggcgaccggcagaccgcagagaagaggccagaagccgaccgcaggcagccgccaccgcaccaaaacccgaggtctcgaggcaatcgagcgcgcgcgggtcgggggctgcggccattgtcggtgagttgcgggctcgagttgggtggtgtgccttggctgcnacgcggtgggcgtggaagcggctcacctacatcggcgcctacgacagcgagantggnnccgcccggcgtccgccccgacgagttcgagcccgtcccgcgcctcttggccgcgccgtgctcgggaacnttaacgacgaggagctcctccagccccaagtttcgcgcccgccgnngagcacggctacttcgnacatcgaccccaagggcatccctcaagcggtccctctactaaaagggaagcccgggnaacgcgntggccgncgaacctccgcttaaaggtcgacgagggggaaaaaagggaatcattcccttggggcgggcgcggccttcaacctcgtgcgcacgcnnaaaataaaaggg

SEQ ID NO: 19916 - DNA, 684 bp, Zea mays
  misc_feature: Ceres CLONE 1387690-F
  misc_feature: Encodes the peptide sequence at SEQ ID NO. 19917
  misc_feature (511)..(511): n is a, c, t, g, unknown, or other
  misc_feature (512)..(512): n is a, c, t, g, unknown, or other
  misc_feature (537)..(537): n is a, c, t, g, unknown, or other
  misc_feature (588)..(588): n is a, c, t, g, unknown, or other
  misc_feature (628)..(628): n is a, c, t, g, unknown, or other
  misc_feature (647)..(647): n is a, c, t, g, unknown, or other
  misc_feature (653)..(653): n is a, c, t, g, unknown, or other
aagctggagctccccgcggtggcggccgctctagaactagtggatcccccgggctgcaggaattcgcacgagaccattacctagaacatcctaacgaaaaaatcaattctccagaccctccccggcaaccgcgtccggccgtccgcttccgtctccttggataaccacgacgcccgccggcaagcgaaagcgaagcgagccaacccagccatggagaaggcgatcgatcggcagcgggtcctcctggcgcacctcctcccctccctctccgccgcctcctcgcagcctcagcttgcggcgtcggcgtgcgcggccggggacagcgccgcctaccagaggtcctcctccttcggggacgatgtcgtcgtcgtcgctgcctacaggacgccgatatgcaaggccaagcgaggaggcttcaaggacacctacccagaggacctcctcactgttgttctcaaggctgttctggacaacactagaatcaatccagctgacatcggtgacatcgtcnngttgggacggtgctttggccctggnttcccagcgtgcaaacgagtgcaggtgggcttggcgttgttttgctggatnccctgaaaccgtccttggttagaactgtcaaaccgccagntgttcattctgggctacangcaagntagcttgatgtcgcagcttgctattaaaggc

SEQ ID NO: 19917 - protein, 127 aa, Zea mays
  misc_feature: Ceres CLONE 1387690-F
  misc_feature: SWISSPROT Homolog: EC 2.3.1.16 Acetyl-CoA C-acyltransferase
  misc_feature (101)..(101): Xaa is any aa, unknown, or other
  misc_feature (126)..(126): Xaa is any aa, unknown, or other
MEKAIDRQRVLLAHLLPSLSAASSQPQLAASACAAGDSAAYQRSSSFGDDVVVVAAYRTPICKAKRGGFKDTYPEDLLTVVLKAVLDNTRINPADIGDIVXLGRCFGPGFPACKRVQVGLALFCWXP

SEQ ID NO: 19918 - DNA, 672 bp, Zea mays
  misc_feature: Ceres CLONE 1387692-F
tccccgcggtggcggccgctctagaactagtggatcccccgggctgcaggaattcgcacgagaccattacctagaacatcctaatcgaaaaagaaacatatgattgagagcaacaagcaacgtagaaagaggaatccggtagcaacaacagatgaacgatggagaccaaaatattgtccctccttatgctccttggtcgttctgcatgtggtggtagcgcgacaatctgccctcgaagatcacaagctactataggttcccttcttcccccataccttccatgaatgagagcttcagcatgcgaaaacccagctcttcaaacctataggctccgacaagcaatcgcagcaggcaacatacctttatcacccttggtgttacaacacatcgccaggactatctttggagcaggcactggtacaaaccaacacggaacagcagctgcaggaactcgcgctacctgtgatccaccaagtagctctggcaaacctttctccctactctcagcaacaacaatttcttccattcaaacaactgtctacactgaaccctgctgcttatttgcagcaacaactattaccattcgggcagctagctactgtctactctcagcaaaaacaacttcttccattatatcaactggccgcactgaaccccgctgcttatttgcag

SEQ ID NO: 19919 - DNA, 737 bp, Zea mays
  misc_feature: Ceres CLONE 1387698-F
  misc_feature: Encodes the peptide sequence at SEQ ID NO. 19920
  misc_feature (677)..(677): n is a, c, t, g, unknown, or other
  misc_feature (678)..(678): n is a, c, t, g, unknown, or other
  misc_feature (695)..(695): n is a, c, t, g, unknown, or other
  misc_feature (737)..(737): n is a, c, t, g, unknown, or other
aagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctctgggctggnntctctcctcctggagcngctgtctgttgactatggcaagaaagtcaagctcgggttcan

SEQ ID NO: 19920 - protein, 169 aa, Zea mays
  misc_feature: Ceres CLONE 1387698-F
  misc_feature (49)..(168): Pfam Name: Tubulin Pfam Description: Tubulin/FtsZ family, GTPase domain
  misc_feature (150)..(150): Xaa is any aa, unknown, or other
  misc_feature (156)..(156): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLXSLLLEXLSVDYGKKVKLGF

SEQ ID NO: 19921 - DNA, 697 bp, Zea mays
  misc_feature: Ceres CLONE 1387702-F
  misc_feature: Encodes the peptide sequence at SEQ ID NO. 19922
  misc_feature (506)..(506): n is a, c, t, g, unknown, or other
aaagctggagctccccgcggtggcggccgctctagaactagtggatcccccgggctgcaggaattcgcacgagaccattacctagaacatcctaatcgaaaaattttttttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggcggcagtttcgtcgccgtcgcctccatgacgtccgccgccgtctccaccagggtggagaacaagaagccatttgctcctccgagggaggtacatgtccagggtacacattcaatgccatctcacaaagatgaaatttttcagtcacttgatggatgggctagagatatatcttgacacatctcaagccagtcgagaagtggtggcaggcacaggnatttcctccctgaccaagcatctggagggtttcttgatggaggttagggacctcaaagaacggccaaggaggaccccggatgataattttggttggttgggttggaaacatgattactggggaagccctaccacatacccaaatatggcttaaacccccccaacgggttcaaaaatgaaacaggggccgcc

SEQ ID NO: 19922 - protein, 80 aa, Zea mays
  misc_feature: Ceres CLONE 1387702-F
  misc_feature: SWISSPROT Homolog: EC 1.14.19.2 Acyl-[acyl-carrier-protein] desaturase
MALRLHDVALCLSPPLAARRRSGGSFVAVASMTSAAVSTRVENKKPFAPPREVHVQGTHSMPSHKDEIFQSLDGWARDIS

SEQ ID NO: 19923 - DNA, 663 bp, Zea mays
  misc_feature: Ceres CLONE 1387710-F
  misc_feature: Encodes the peptide sequence at SEQ ID NO. 19924
  misc_feature (398)..(398): n is a, c, t, g, unknown, or other
  misc_feature (454)..(454): n is a, c, t, g, unknown, or other
  misc_feature (534)..(534): n is a, c, t, g, unknown, or other
  misc_feature (556)..(556): n is a, c, t, g, unknown, or other
ggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatggngagagcgagtgccgcgagcggcaccagcaagcttgacgcgggcgaggacggcgacnagcggcgtggacgcctacgtctcccgctcggaaggaggggcgagtgccggcgccagtgcctgcgcccgccacgagggccnagccgtgggagacccaggaagncattgaggcggtgccgccgccgcgggactggccgtcgacatggagcaaagagtacggtcgcggcagcgagagcgcgggaagtggcccgggagaggtgcgagcgccac

SEQ ID NO: 19924 - protein, 117 aa, Zea mays
  misc_feature: Ceres CLONE 1387710-F
  misc_feature (64)..(64): Xaa is any aa, unknown, or other
  misc_feature (109)..(109): Xaa is any aa, unknown, or other
  misc_feature (116)..(116): Xaa is any aa, unknown, or other
MGKGSVGASWWAFLLLAGVLLVVAATAGAEDGVVERDRKEDLRWCKQACEWQYGKDTPRKREWXERVPRAAPASLTRARTATSGVDAYVSRSEGGASAGASACARHEGXAVGDPGXH

SEQ ID NO: 19925 - DNA, 709 bp, Zea mays
  misc_feature: Ceres CLONE 1387711-F
  misc_feature: Encodes the peptide sequence at SEQ ID NO. 19926
  misc_feature (465)..(465): n is a, c, t, g, unknown, or other
  misc_feature (474)..(474): n is a, c, t, g, unknown, or other
  misc_feature (634)..(634): n is a, c, t, g, unknown, or other
aaagctggagctccccgcggtggcggccgctctagaactagtggatcccccgggctgcaggaattcgcacgagaccattacctagaacatcctaatcgaaaactagaagcctccaccctcctgcgcctccaccctcctcgccgcctcactccctctgcagaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaaggtcgagtcctactggccggcgctcttcgctaagctcctggagaagcgcagtgttgaggatctaatcctctccgttggatctggtggtggcgctgctccagttgctgctgccgccccagctggaggtgctgcagctgctgctgcccctgctgcnagagagaanaaggaagagccccaggaggagtctgatgacgacatgggcttcagcctggtcgactgaggaggccctcgctacccagccattagcaaattcccttatgctgccaaggacttatctacgctatggctggagccttttgtattaccagtactcaggtttgagntttttgaatgggggtattacaaggggatgaagaccccaacccttcgaaaaaagggaacttggttctatataaggc

SEQ ID NO: 19926 - protein, 109 aa, Zea mays
  misc_feature: Ceres CLONE 1387711-F
  misc_feature (21)..(108): Pfam Name: Ribosomal_60s Pfam Description: 60s Acidic ribosomal protein
  misc_feature (91)..(91): Xaa is any aa, unknown, or other
MASGELACTYAALILSDDGIAITAEKIATIVKAANIKVESYWPALFAKLLEKRSVEDLILSVGSGGGAAPVAAAAPAGGAAAAAAPAAREXKEEPQEESDDDMGFSLVD

SEQ ID NO: 19927 - DNA, 715 bp, Zea mays
  misc_feature: Ceres CLONE 1387717-F
  misc_feature: Encodes the peptide sequence at SEQ ID NO. 19928
  misc_feature (446)..(446): n is a, c, t, g, unknown, or other
  misc_feature (468)..(468): n is a, c, t, g, unknown, or other
  misc_feature (469)..(469): n is a, c, t, g, unknown, or other
  misc_feature (485)..(485): n is a, c, t, g, unknown, or other
aaagctggagctccccgcggtggcggccgctctagaactagtggatcccccgggctgcaggaattcgcacgagaccattacctagaacatcctaatcgaaaaagctatcacaaaagaaaaaaaaagggaaagggccgcgacgagccgacgagcaacgacgaccatggcgacgattgccgcttcttcctgccacgggcaacttctcctgtttctcctcgtggccgtcgcgtcggcctgcctcggctccgcggcagcgcatcaagccggatctggagagggctacacgatcgctggccgcgtcaagatcgatggcatgagcgtgaagggctttggtcttgcaacaaagacatcaaacacaaaagtgatacttaatggcggccagagggttacatttgccaggccagacggctactttgcattccacaacgtgccagctgggactcatnctgatgaggtctcctcaatggnntactcttttccccagntcgagtagatatcagtgcaagggaatcctgggtatatcaagcagcattgactgaaactagaaaggtctaaatggactttgccctggaacctcggaaagaaaaggcgtacttttggggttgggagcctttcccccgcatggcactttttaaagaccccggggggggaaggggggggttaaagggcctaaaggggctttggggggccccaaaggggggaaaaataaatcccg

SEQ ID NO: 19928 - protein, 109 aa, Zea mays
  misc_feature: Ceres CLONE 1387717-F
  misc_feature (95)..(95): Xaa is any aa, unknown, or other
  misc_feature (102)..(102): Xaa is any aa, unknown, or other
  misc_feature (108)..(108): Xaa is any aa, unknown, or other
MATIAASSCHGQLLLFLLVAVASACLGSAAAHQAGSGEGYTIAGRVKIDGMSVKGFGLATKTSNTKVILNGGQRVTFARPDGYFAFHNVPAGTHXDEVSSMXYSFPQXE

SEQ ID NO: 19929 - DNA, 650 bp, Zea mays
  misc_feature: Ceres CLONE 1387718-F
  misc_feature: Encodes the peptide sequence at SEQ ID NO. 19930
  misc_feature (575)..(575): n is a, c, t, g, unknown, or other
agtggatcccccgggctgcaggaattcgcacgagaccattacctagaacatcctaatcgaaaaaagagaataaaagacagccccacacgcagctcgaatcccggcacgtgagcggcggaggcagggacggccatggcatgcagtgggtgcagctgcgaggcggcggtgggggcgatggcgtcggaggcgtaccttgagggggcgccggtgcgggaggcgcgggagctggtggcggagctctgtcggcacttctacgcgcagggatgggtcacgggcaccggcggcagcatcaccgtcaaggtcaacgaccccgccgtgccgctcgccgaccgcctcgtcggtatgtcaccttccggtgtgcagaaggagaggatggtagcagaggacatgtatgtgatggctgcagatgggaaagtgctttctgcgcctgtagcaaagccatggccaaacaagcctcctaagtgcacggactgtgctcctctgttcatgaaggcgtatctgatgagaggaagctggggctgtcattcacagccatgggaatagagacttgcatcgcaacaatgctcatcccgggntgcaaaggaagttccggagtgacccaccatgggaaatgatcaaggggaatccaaaggtcatggcctcccaatgga

SEQ ID NO: 19930 - protein, 136 aa, Zea mays
  misc_feature: Ceres CLONE 1387718-F
MACSGCSCEAAVGAMASEAYLEGAPVREARELVAELCRHFYAQGWVTGTGGSITVKVNDPAVPLADRLVGMSPSGVQKERMVAEDMYVMAADGKVLSAPVAKPWPNKPPKCTDCAPLFMKAYLMRGSWGCHSQPWE

SEQ ID NO: 19931 - DNA, 661 bp, Zea mays
  misc_feature: Ceres CLONE 1387719-F
  misc_feature: Encodes the peptide sequence at SEQ ID NO. 19932
  misc_feature (605)..(605): n is a, c, t, g, unknown, or other
tccccgcggtggcggccgctctagaactagtggatcccccgggctgcaggaattcgcacgagaccattacctagaacatcctaatcgaaaacgaaaaaaccccaccgcagcacagcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatggaggacggcgacgagatcgacgccatgcttcaccagaccggaggcagcgttcctagcaccacctaaaagcagcagctgcggagcctcgttttgctctccgccctgcgtagtactaaacaaaagggaaaaagtctttttaaggaacttgtgatgctctggctccttgtgccattgctgagggacatccttagcctttatttaggggnaatgatttggcaactttggtctgtcatcactcgtttatctatccctatacatgccc

SEQ ID NO: 19932 - protein, 99 aa, Zea mays; identical to SEQ ID NO: 19564
  misc_feature: Ceres CLONE 1387719-F
  misc_feature (21)..(91): Pfam Name: ubiquitin Pfam Description: Ubiquitin family

SEQ ID NO: 19933 - DNA, 685 bp, Zea mays
  misc_feature: Ceres CLONE 1387721-F
  misc_feature: Encodes the peptide sequence at SEQ ID NO. 19934
  misc_feature (345)..(345): n is a, c, t, g, unknown, or other
  misc_feature (401)..(401): n is a, c, t, g, unknown, or other
  misc_feature (433)..(433): n is a, c, t, g, unknown, or other
  misc_feature (461)..(461): n is a, c, t, g, unknown, or other
  misc_feature (538)..(538): n is a, c, t, g, unknown, or other
  misc_feature (578)..(578): n is a, c, t, g, unknown, or other
  misc_feature (599)..(599): n is a, c, t, g, unknown, or other
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaaacagtgcaaacaagctcgctcgcaagcgcaacccacccacgtctacggtctaccacacgaagcatcgtagccagccagccagctaaacccacaccacacatggccgggatcgtggtggtgttcgacttcgacaagacgatcatcgacgtggacagcgacaactgggtggtggacagcctcggcctcaccgacctgttcgagcgcctcctccccaccacgccctggaacacgctcatggacacgnatgatgggggagcttgcacgcgcggggcaggacgcttggccgaggtgaccgaggcngctcagggcggcgccctcgaacccgcgcgggnccgcccgcccgtcaggggccgcgcacgncgctcggctggaaaacttgcgcgtggctcagcgacgccaacgccttcttcatccacaccgtcctggaccaccacggncctgctcgcctgctttctcccaggtcaacccaaccccagnccgggtcgacgcccacggcgnttttccgcatcgggcctgcacgacccgggcgcgggccgaaaaaaattttggttgtgggggtgtncccctgcccccacaatggtggg

SEQ ID NO: 19934 - protein, 161 aa, Zea mays
  misc_feature: Ceres CLONE 1387721-F
  misc_feature (4)..(160): Pfam Name: Put_Phosphatase Pfam Description: Putative Phosphatase
  misc_feature (49)..(49): Xaa is any aa, unknown, or other
  misc_feature (78)..(78): Xaa is any aa, unknown, or other
  misc_feature (113)..(113): Xaa is any aa, unknown, or other
  misc_feature (126)..(126): Xaa is any aa, unknown, or other
  misc_feature (155)..(155): Xaa is any aa, unknown, or other
MAGIVVVFDFDKTIIDVDSDNWVVDSLGLTDLFERLLPTTPWNTLMDTXDGGACTRGAGRLAEVTEAAQGGALEPARXRPPVRGRARRSAGKLARGSATPTPSSSTPSWTTTXLLACFLPGQPNPXPGRRPRRFSASGLHDPGAGRKKFWLWGCXPAPTMV

SEQ ID NO: 19935 - DNA, 705 bp, Zea mays
  misc_feature: Ceres CLONE 1387722-F
  misc_feature: Encodes the peptide sequence at SEQ ID NO. 19936
agtggatcccccgggctgcaggaattcgcacgagaccattacctagaacatcctaatcgaaaaatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggagaggtgacgtcgtcggtggcgtcgtgcctcgggtacgcgatgggcagcgcggcgtcgccctccccggcgggctgcagggggggtggagctcgctccaacaggcggcgggtccgacgggggagggaccggggggggccacctggcaactggcctcaagaagcatggacggggccgggctttgggggggggggggtgcagaaatggaccaacgggcccccatatttcccccgggcaagagggggggggcctccgggggggggggggcgataaagcccccccacgcggagggcgggcccccagtatcgacggggggcgagggggcatgcttgaagggggcggcacccttttcttccactgtgaagggggcaaagaaaacgccgccctatacaccggagagggggggggcggggctgccaaagaggagagaaggcc

SEQ ID NO: 19936 - protein, 126 aa, Zea mays
  misc_feature: Ceres CLONE 1387722-F
MAARSSSQQLVAAAVLAAALLLLAAGAGTASAAVSCGEVTSSVASCLGYAMGSAASPSPAGCRGGGARSNRRRVRRGRDRGGPPGNWPQEAWTGPGFGGGGVQKWTNGPPYFPRARGGGPPGGGGR

SEQ ID NO: 19937 - DNA, 653 bp, Zea mays
  misc_feature: Ceres CLONE 1387724-F
  misc_feature: SWISSPROT Homolog: EC 2.1.3.3 Ornithine carbamoyltransferase
  misc_feature (267)..(267): n is a, c, t, g, unknown, or other
  misc_feature (369)..(369): n is a, c, t, g, unknown, or other
  misc_feature (400)..(400): n is a, c, t, g, unknown, or other
  misc_feature (420)..(420): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (492)..(492): n is a, c, t, g, unknown, or other
  misc_feature (581)..(581): n is a, c, t, g, unknown, or other
ggagctccccgcggtggcggccgctctagaactagtggatcccccgggctgcaggaattcgcacgagaccattacctaagaacatcctaatccaaaaaggccctaagcaacaaatccgtatcccgagtccggcgacggcagtatccgagctcgcactcgcgcacccgtccatcgcatcgcatctgtcctcccatcccctcagcgccaccgcaccgcaatcacacgcgcgccacccgcgatgacgccgggcggcggcgatctccggcntccagcagccacgtcgtcgtctcctccgcccgcctcaggcagccgttcacgctccctccgcgcaccgcttgcccaatcgccgccgccgcctcgcccgtgacncgccgcgggggtcgcggtcgccgccgtgcgnagccccgttgtgtccgccgncgcgnnngaaggatgccaaacaggcttcctaaggatttccttcaaatcattgattttgacaaggatacaatnaatgaagattcttaatcgagccatcgaggttaaggcattgataaagtctggagacaagagcttccaaccgttcaaagggaaaacatggnccatgatttttgccagccatcatgaaggacccgtgtttcatttgagaccggattttttttacttggtggatg

SEQ ID NO: 19938 - DNA, 604 bp, Zea mays
  misc_feature: Ceres CLONE 1387729-F
  misc_feature: Encodes the peptide sequence at SEQ ID NO. 19939
  misc_feature (417)..(417): n is a, c, t, g, unknown, or other
  misc_feature (418)..(418): n is a, c, t, g, unknown, or other
  misc_feature (443)..(443): n is a, c, t, g, unknown, or other
  misc_feature (449)..(449): n is a, c, t, g, unknown, or other
  misc_feature (450)..(450): n is a, c, t, g, unknown, or other
  misc_feature (460)..(460): n is a, c, t, g, unknown, or other
aaactggagctccccgcggtggcggccgctctagaactagtggatcccccgggctgcaggaattcgcacgagaccattacctagaacatcctaatcgaaaacctgtgaaaattcgtgatgcggagaacagctaccgccgccctcgtcctcgtccccctcctcgctgcggcggtacagacctccgccctgcctttcatcgtcctgcacgggattggggaccagtgcgtcaaccatggcgttgccaagttcactaaacttctcgccgattggtccggctccgacggctactgcctagagattggcagaggaacatgggactcttgggtcatgcctcttcaacaacaggctgatataatctgcaacaaggtcaaggaaatgaaacaactgagaggtggctacaacattagttggtctgtnnctcaggggaactttgatttgggtcnagcaanngggtttgagnaacctggggattttatgaacccccggtacaaatttccttcttttgaggggccctctggtggaaccgtttcgggccctttttggggttgggatttttttccattttgggggagggcctgggaccaaatgggaaatactcccccat

SEQ ID NO: 19939 - protein, 162 aa, Zea mays
  misc_feature: Ceres CLONE 1387729-F
  misc_feature (101)..(101): Xaa is any aa, unknown, or other
  misc_feature (109)..(109): Xaa is any aa, unknown, or other
  misc_feature (111)..(111): Xaa is any aa, unknown, or other
  misc_feature (115)..(115): Xaa is any aa, unknown, or other
MRRTATAALVLVPLLAAAVQTSALPFIVLHGIGDQCVNHGVAKFTKLLADWSGSDGYCLEIGRGTWDSWVMPLQQQADIICNKVKEMKQLRGGYNISWSVXQGNFDLGXAXGFEXPGDFMNPRYKFPSFEGPSGGTVSGPFWGWDFFPFWGRAWDQMGNTPP

SEQ ID NO: 19940 - DNA, 652 bp, Zea mays
  misc_feature: Ceres CLONE 1387731-F
  misc_feature: Encodes the peptide sequence at SEQ ID NO. 19941
tggagctccccgcggtggcggccgctctagaactagtggatcccccgggctgcaggaattcgcacgagaccattacctagaacatcctaatcgaaaaactaaaaacatgggactccaccctgtctccgaggccaacgcttcaagccccttcggctctctctccgccgccgaattctactccctccattccgtcgcccactcctccgcctacatcaccaacccaaccggtctcaaactcttcacccaatggtggacccctctccaccgtccaccactcggcctcatcgccgtcgtccacggcttcaccggcgagtccagctggttcctccaactaacctccgtcctcttcgccaagtcagggttcctcacttgcgccatcgaccaccaaggccacggcttctccgacgggctaaccgctcacatccccaacatcaacctcatcgtcgacgactgcatctccttcttcgacgacttccgtagccgtcacgcttcctcctcctccctaccttccttcctctactccgagtccctcggcggcgcgatagctctctacatcaccctccgccagaaatcaaaatggaacggtctcatcctcagcggcgccatgtgctccatcagccacaagttcaaaccccccgtggccgttacaaca

SEQ ID NO: 19941 - protein, 182 aa, Zea mays
  misc_feature: Ceres CLONE 1387731-F
  misc_feature: SWISSPROT Homolog: EC 3.1.1.23 Acylglycerol lipase
MGLHPVSEANASSPFGSLSAAEFYSLHSVAHSSAYITNPTGLKLFTQWWTPLHRPPLGLIAVVHGFTGESSWFLQLTSVLFAKSGFLTCAIDHQGHGFSDGLTAHIPNINLIVDDCISFFDDFRSRHASSSSLPSFLYSESLGGAIALYITLRQKSKWNGLILSGAMCSISHKFKPPVAVTT

SEQ ID NO: 19942 - DNA, 678 bp, Zea mays
  misc_feature: Ceres CLONE 1387734-F
  misc_feature: Encodes the peptide sequence at SEQ ID NO. 19943
  misc_feature (1)..(1): n is a, c, t, g, unknown, or other
  misc_feature (481)..(481): n is a, c, t, g, unknown, or other
  misc_feature (488)..(488): n is a, c, t, g, unknown, or other
ntccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggcccgggacggtgggcttcttctggctggtgaaccacggagtgccggaggagctgatgggcggatgcntccgcgnggtggcgtagaggcccccccctgggggggggggaaaaaaaaaaccccctctctttacgggagggaacttcgttggaaaccgtggtgtttccgcctcaaacttcgaccttcttcaagggttgctggcgggccgactggcgcaccgttttttttttgggggggggggggctccgaaccgccccccccggggg

SEQ ID NO: 19943 - protein, 180 aa, Zea mays
  misc_feature: Ceres CLONE 1387734-F
  misc_feature: SWISSPROT Homolog: EC 1.14.11.20 Desacetoxyvindoline 4-hydroxylase
  misc_feature (115)..(115): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAARDGGLLLAGEPRSAGGADGRMXPRGGVEAPPWGGGKKKTPSLYGRELRWKPWCFRLKLRPSSRVAGGPTGAPFFFWGGGGSEPPPPG

SEQ ID NO: 19944 - DNA, 673 bp, Zea mays
  misc_feature: Ceres CLONE 1387735-F
  misc_feature: Encodes the peptide sequence at SEQ ID NO. 19945
  misc_feature (545)..(545): n is a, c, t, g, unknown, or other
  misc_feature (559)..(559): n is a, c, t, g, unknown, or other
  misc_feature (560)..(560): n is a, c, t, g, unknown, or other
  misc_feature (577)..(577): n is a, c, t, g, unknown, or other
  misc_feature (578)..(578): n is a, c, t, g, unknown, or other
  misc_feature (586)..(586): n is a, c, t, g, unknown, or other
  misc_feature (642)..(642): n is a, c, t, g, unknown, or other
tccccgcggtggcggccgctctagaactagtggatcccccgggctgcaggaattcgcacgagaccattacctagaacatcctaatcgaaaaaaaccttcgctgctgcttcgcaacggtgccgcggcttcggacagggctctcgcgacgcgatcggccatggcggcgtctctgcgggcctcgtcctccctccgctcgcgcctcctctcgttctcctcggggtgttctctgtgtccgtggcgtctcctcctctcctcacctgtccactcggacgccccccaccagaccgaaaccctcgctttcgacgagatccagctgtcgccggagaagccggctaccgccactgccttcgtcctgcacggcctcctcggttccggccgcaactggcgctccttctctcgcgccctcgtctccgaactccgtaaccgctccccttcagacgagtggaggatggttctcgtggacttgaggaaccatggcagatcggctgggatcaaggggctcggcccaccccacaacatatctactgccgccaaggacctcgctngatttagtgaaggnnccgtggttggcaatggnncgggatgntttgttgtgggtcacttcatgggggtggaaaagtcgctctaagatttcgcggaagntgctcctcgccggggtgggtatgggagattc

SEQ ID NO: 19945 - protein, 156 aa, Zea mays
  misc_feature: Ceres CLONE 1387735-F
  misc_feature (130)..(130): Xaa is any aa, unknown, or other
  misc_feature (135)..(135): Xaa is any aa, unknown, or other
  misc_feature (141)..(141): Xaa is any aa, unknown, or other
  misc_feature (143)..(143): Xaa is any aa, unknown, or other
MAASLRASSSLRSRLLSFSSGCSLCPWRLLLSSPVHSDAPHQTETLAFDEIQLSPEKPATATAFVLHGLLGSGRNWRSFSRALVSELRNRSPSDEWRMVLVDLRNHGRSAGIKGLGPPHNISTAAKDLAXFSEGXVVGNGXGXFVVGHFMGVEKSL

SEQ ID NO: 19946 - DNA, 676 bp, Zea mays
  misc_feature: Ceres CLONE 1387739-F
  misc_feature: SWISSPROT Homolog: EC 4.1.2.13 Fructose-bisphosphate aldolase
tggagctccccgcggtggcggccgctctagaactagtggatcccccgggctgcaggaattcgcacgagaccattacctagaacatcctaatcgaaaagagcgagattaacacctccctatagcctaacccgaagaagaagatcctaacagcacatggcttccagctctgcgtctcttctcagagcctcaccggtgaactctgcattgcagtaatctacagaggctcctcatccgcccaccatcctcaccctcagctatccgcagcagacgcagctaccttccgctctcaccgtccgagcggactcttactccgacgagctcgtcaaaacaggtaaaacaatcgcgtctccggaacacggaatattggcgatggacgagtaaaacgcgacttgcgggaagcgtttggcgtgcgattgacctacacaacacggatgctaaccgtcaggcttaccggacgctgcttgtcgtcctactccgggattgtgacagtacatctccggagctatcctcttcaaggaaactctctaccagaccaccgttgacgtccacaaaatggacgatggtctcggcaaccaaaacatcgacgctgcaatcaagtcaacaagggtttgctgacacttgatgcgctaacgacgagtcatgccgcagggactcgacggtgtgccctcctcgtacg

SEQ ID NO: 19947 - DNA, 618 bp, Zea mays
  misc_feature: Ceres CLONE 1387741-F
  misc_feature: Encodes the peptide sequence at SEQ ID NO. 19948
cgcggtggcggccgctctagaactagtggatcccccgggctgcaggaattcgcacgagaccattacctagaacatcctaatcgaaaaatcaccaccactgggtcttcagaacattagttttatctactccctagcgcatagtagacccgatcgagaccatgagggcgttgctcgatgccctcgctctcctgggtctcgctgggagcgtcacctccactgataccagcggagactgtgcgtgccagtctccgccgccgcgtcatcgaccgccgccgtgggatctgccatctccgggtgacctgccacctgcggagcatgctcccaccgtcggtcgactgccgccgccggatcactgacagcggcaggctatggactgcatgatgttgatgtgtgcacgcctgatgctgctacactactcagcaggctcgtgctgagcctcatacgcaccagaatgatgatcgagctgacctacgtgtcgctcttctcccctgtccgggaaaggctgggggcttgaagaaccccgttcctgggcccggggggggaaggttcgggggtatcatgggacgcccggggggtatgcctactgccccccctgagggcaaggctttggtcagaagg

SEQ ID NO: 19948 - protein, 65 aa, Zea mays
  misc_feature: Ceres CLONE 1387741-F
MRALLDALALLGLAGSVTSTDTSGDCACQSPPPRHRPPPWDLPSPGDLPPAEHAPTVGRLPPPDH

SEQ ID NO: 19949 - DNA, 655 bp, Zea mays
  misc_feature: Ceres CLONE 1387742-F
cgcggtggcggccgctctagaactagtggatcccccgggctgcaggaattcgcacgagaccattacctagaacatcctaatcgaaaaatccccaccgatgggtttttcgaacattagtttcatttactctctatctcctactaccccatcgaaccatgagggcgttgctagatgctctcgctctcctgagacaagctggcagcgtcccctacaatgatatcggcggagactgtccgtgccagtatccgccgccgcgtcatcgaccgccgccttgggatctgcctcctccgggtgacctgctacctgcggagcatctcacaccgccggtcgaactgccgccgccggatcacctgccagcgccggttcatgagcctgcctgcggtgcatgtgtcaccgccatcatgctactacactactcaagcgtgccggtctcgacctcatccccagccacactgatgatcgagctgacagacgcatccatctccgtgccatgtgcaggaaacctgcggcgttggaagcacctcgatcctgtggcagtgcatctagtctctgacgcatcattgcacgccgacggggatgccctactgctcgcctcagagccagtcgcttggtcagcagcgtcgccagcagctcatgcaggagcagcctgaacacc

SEQ ID NO: 19950 - DNA, 662 bp, Zea mays
  misc_feature: Ceres CLONE 1387751-F
  misc_feature: Translation starting site: 220
  misc_feature: Pfam Name: DUF667 Pfam Description: Protein of unknown function (DUF667)
  misc_feature (391)..(391): n is a, c, t, g, unknown, or other
  misc_feature (392)..(392): n is a, c, t, g, unknown, or other
  misc_feature (409)..(409): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (417)..(417): n is a, c, t, g, unknown, or other
  misc_feature (418)..(418): n is a, c, t, g, unknown, or other
  misc_feature (421)..(421): n is a, c, t, g, unknown, or other
tccccgcggtggcggccgctctagaactagtggatcccccgggctgcaggaattcgcacgagaccattacctagaacatcctaatcgaaaaatctcgcaataccaaccttccggatccagtgccgcacgcctcactccccgtccccgacacccatgacacgcaagaggcggaagcacgccgccgccgccgccgccgcctagggttccgatcccttcctcatggattcgctgccgcggaagcgcaagggcgcgcgcgccgcgtgctccctggccggatcccgccacgatgcgcctgccgcccgcaagcgcacctgccgcgagcccaagccgcggcccgagaagaagaagccctcttccgccgatgagggctccgcctccgccgggggggggnnaataaaaaggcacggcntnnnnngnnaanttaacatcacatacccagctgaatccttctgctactcttgggattaagcttccatttctggctattattgtgaaaaatcttaagaaatacttcacgtttgagatccaagttctggatgacaagaatgtccgacgtcgatttcgagcatcatattttcaatctgtcacaagggtgaagccatatatctgcacgatgccgttgaaactcgacgatggctggaacaacatccagttgaaccttg

SEQ ID NO: 19951 - DNA, 661 bp, Zea mays
  misc_feature: Ceres CLONE 1387752-F
  misc_feature: Encodes the peptide sequence at SEQ ID NO. 19952
  misc_feature (554)..(554): n is a, c, t, g, unknown, or other
  misc_feature (566)..(566): n is a, c, t, g, unknown, or other
  misc_feature (597)..(597): n is a, c, t, g, unknown, or other
tccccgcggtggcggccgctctagaactagtggatcccccgggctgcaggaattcgcacgagaccattacctagaacatcctaatcgaaaaaaattgaccgccattgtgcaaaccagaaccccttcgccattttcaccaactccctccgatcccggccatggcgggggaggactgccgctccggcgcggaaatggacgcgctcgtacgacgcttgaagctccaccggccgtccccatccccctacgaccccgatccggccgcggcccccgtccccgccaccgccggcgacggcgagctgttccggccgcggagagctgccgtgcttgtctgcctcttccggggagacggcagcgagctccgcgtcatcctcactaagcgctcgtcctccctctccacccactccggtgaagtttcattgccaggaggaaaggtcgaggagggtgatgctgatgatgtagcaacagcgttaagagagtcaaaagaggagattggacttgatccagctctggtaaactgtggttgcctctcttgaacacttcttgtccagatcttncctggaagtggntcccgggtgttggcatactggtagacagacnagcatttaaacctgctcttaaaatttgctgaggaaaacaaaatatttgatgtacccccctgaag

SEQ ID NO: 19952 - protein, 124 aa, Zea mays
  misc_feature: Ceres CLONE 1387752-F
MAGEDCRSGAEMDALVRRLKLHRPSPSPYDPDPAAAPVPATAGDGELFRPRRAAVLVCLFRGDGSELRVILTKRSSSLSTHSGEVSLPGGKVEEGDADDVATALRESKEEIGLDPALVNCGCLS

SEQ ID NO: 19953 - DNA, 676 bp, Zea mays
  misc_feature: Ceres CLONE 1387757-F
  misc_feature: Translation starting site: 471
  misc_feature (355)..(355): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgncgccggtccacctgccaccgccggtccatgtgccgccgccggttcatctgccgccgccaccatgccactaccctactcagccgccccgggctcagcctcatccccagccacacccatgcccgtgccaacagccgcatcccagcccgtgccagctgcagggaacctgcggcgttggcagcaccccgatcctgggccagtgcgtcgagttcctgaggcatcagggcagcccgacggggacgccctactgctcgcctcaggggccaggcgttgcgggagcagtgtttgcaagagcctcaggcagggggagccgcaccaccggta

SEQ ID NO: 19954 - DNA, 698 bp, Zea mays
  misc_feature: Ceres CLONE 1387758-F
  misc_feature: Encodes the peptide sequence at SEQ ID NO. 19955
  misc_feature (463)..(463): n is a, c, t, g, unknown, or other
  misc_feature (542)..(542): n is a, c, t, g, unknown, or other
  misc_feature (552)..(552): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (638)..(638): n is a, c, t, g, unknown, or other
  misc_feature (669)..(669): n is a, c, t, g, unknown, or other
  misc_feature (673)..(673): n is a, c, t, g, unknown, or other
  misc_feature (674)..(674): n is a, c, t, g, unknown, or other
  misc_feature (679)..(679): n is a, c, t, g, unknown, or other
aaactggagctccccgcggtggcggccgctttagaactagtggatcccccgggctgcaggaattcgcacgagaccatttacccttaaacatcctaatcgaaaagcccacttcccagaggcttttttttctcctcgcctcctctccctagtctccacgacgcaagggagagtgacggaaagcgacgcggcgcgagcgaggagggccaaggcgaagaggggaagcaccgcaccaggacccttgttccccgccgccgcctcttatctccgcgaggttgtcaggattcaatatgtcgaccagcacattcgctacttcctgcacgctgttgggcaatgttagaacaacgcaggcctcccagacagcggtgaagagcccttcgtctcttagcttcttcagccaagttacgaaggttccaagcctgaagaccttccagaaactggattgtctccgccatggctgtatacnaggtgaagcttgtcgggcctgaaggtgaagagcacgagtttgatgctccagacgacgcctacttccttgacgcagccanacttgcgggntgtggagttgccataacttcgtgccgtgctggggctttgctccacctgtccgcaaatccaannntttttgtttcggttgacaacanccccaatgggtcctttccctttgatgacgcncccnngaggnaaaaaaagggttttgggtt

SEQ ID NO: 19955 - protein, 65 aa, Zea mays
  misc_feature: Ceres CLONE 1387758-F
  misc_feature (59)..(59): Xaa is any aa, unknown, or other
MSTSTFATSCTLLGNVRTTQASQTAVKSPSSLSFFSQVTKVPSLKTFQKLDCLRHGCIXGEACRA

SEQ ID NO: 19956 - DNA, 669 bp, Zea mays
  misc_feature: Ceres CLONE 1387762-F
  misc_feature: Encodes the peptide sequence at SEQ ID NO. 19957
ggagctccccgcggtggcggccgctctagaactagtggatcccccgggctgcaggaattcgcacgagaccattacctagaacatcctaatcgaaaaccccccccccccatctctcctcccctccccatctcgctcttgcggagatcgaagagaagctgaggcctagcgccgcacccgccgccgcatcagccatcagccatggcgatggccgctcgcctcgtctcgcgctcccgtcagctacattcggttcaagcagcttttgcgaatggaggtgccactcaagttcgctcctttgccaaggatgcagctccagctgaccgtcctcctgttggtggggatgatctcctgaagggcatattctttgaggtaaagaagaagtttgagacagctctcggcgtccttaaaaaggaaaagatcactattgatccagatgacccagcggcagtttctcaatatgctcaagtcatgaagactgtaagggaaaaggcggatcttctttctgattctcaaaggattaaatataccattgagaccttcaccaagggcatccctgatgcacggacttacttgaatactcttcaacagctcagaataaagagtgggcttatagatcatattggaatcgaacctttgatgatggaagctcttgagaagattgagaaggatatt

SEQ ID NO: 19957 - protein, 157 aa, Zea mays
  misc_feature: Ceres CLONE 1387762-F
MAMAARLVSRSRQLHSVQAAFANGGATQVRSFAKDAAPADRPPVGGDDLLKGIFFEVKKKFETALGVLKKEKITIDPDDPAAVSQYAQVMKTVREKADLLSDSQRIKYTIETFTKGIPDARTYLNTLQQLRIKSGLIDHIGIEPLMMEALEKIEKDI

SEQ ID NO: 19958 - DNA, 675 bp, Zea mays
  misc_feature: Ceres CLONE 1387768-F
  misc_feature: Encodes the peptide sequence at SEQ ID NO. 19959
  misc_feature (675)..(675): n is a, c, t, g, unknown, or other
aagctggagctccccgcggtggcggccgctctagaactagtggatcccccgggctgcaggaattcgcacgagaccattacctagaacatcctaatcgaaaaacgactagcggaataatatccaccggcgacgggaacgggaggcggcgcggccggagattcgaagcgatggcgttcacgatgcgggcagtgaaggtgcctccgaactcggcctcgctggaggaggcccggcaccgcgtcttcgatttcttcaagcaggcatgccgctctatccccaccgtcatggagatctacaacctcgacgacgttgtcacgccctctcagctccgctcgaccatcgctaaggagatccgtaaaaaccagaacgtcaccaaccccaaggtgattgatatgcttctgttcaacgcgacggaggagctgaacaacatagtcgaacatgcaaagcagcgccatcatgtgattgggcagtatgtgatcggccaagagggcctggtgcacgagctggggtcgaaggatctagggaactctgactttctggaagaattctacacaagcaattacttctgatctgggttgcagatttacaacatctgttatactccgggtggtgctctggataagacgacccggaggacctatcggacccattgtttcccactgaagggtttgatctatn

SEQ ID NO: 19959 - protein, 132 aa, Zea mays
  misc_feature: Ceres CLONE 1387768-F
  misc_feature (19)..(89): Pfam Name: Complex1_LYR Pfam Description: Complex 1 protein (LYR family)
MAFTMRAVKVPPNSASLEEARHRVFDFFKQACRSIPTVMEIYNLDDVVTPSQLRSTIAKEIRKNQNVTNPKVIDMLLFNATEELNNIVEHAKQRHHVIGQYVIGQEGLVHELGSKDLGNSDFLEEFYTSNYF

SEQ ID NO: 19960 - DNA, 730 bp, Zea mays
  misc_feature: Ceres CLONE 1387771-F
  misc_feature: Encodes the peptide sequence at SEQ ID NO. 19961
tggagctccccgcggtggcggccgctctagaactagtggatcccccgggctgcaggaattcgcacgagaccattacctagaacatcctaatcgaaaaacgaagagcagcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgcagtgcctatcgggtactggttctttaagagtcggaggtgaatttctttgcaggcactatcacgagcggactatctacatcccacaagcaacgtgggggaatcacccaaaagtctccaccctatctgggcttgaacggtaggaggcacccgcttattaggatactgggaaaatggaggctttcctttccaaggaattcctgggaagaccctcggttctggctcctccgggtccaaatggaactgggtgggggccggggcc

SEQ ID NO: 19961 - protein, 152 aa, Zea mays
  misc_feature: Ceres CLONE 1387771-F
  misc_feature: SWISSPROT Homolog: EC 2.6.1.1 Aspartate transaminase
MASQGSSVFAALEQAPEDPILGVTVAYNKDPSPVKVNLGVGAYRTEEGKPLVLNVVRRAEQMLINNPSRVKEYLPITGLAEFNKLSAKLIFGADSPAIQENRVATVQCLSGTGSLRVGGEFLCRHYHERTIYIPQATWGNHPKVSTLSGLER

SEQ ID NO: 19962 - DNA, 697 bp, Zea mays
  misc_feature: Ceres CLONE 1387773-F
  misc_feature: Encodes the peptide sequence at SEQ ID NO. 19963
cgctctagaactagtggatcccccgggctgcaggaattcgcacgagaccattacctagaacatcctaatcgaaaatcatgcagcagcgaacaacacaaattaagtagtggagtgtcagaacttgggaggcacaaattaagtacaaagcagtctaattaatgacgggcccgatggagattccggtgatcgatctcggcggcctcaacggcggcggcgaggagaggtcgcggaccttggcggagctccacgacgcctgcaaggactggggcttcttctgggtggagaaccacggcgtggacgcgccgctgatggacgaggtcaagcgcttcgtctacggccactacgaggagcacctggaggccaagttctacgcctccgccctcgccatggacctcgaggccgccaccagaggtgacactgatgagaagccctccgacgagggggactgggagtccacctacttcatccagcaccaccccaagaccaacgtcgccgactttcccaggagatcacgccgccgacacgagagacgctgggacgcgtacgtcgcgcagatggtgtccctcgcggagcgtctggccgagtgcatgagcctcaacctgggcctcccccggggcccacgtcgccgcacttttcggggcgggccgttcggggggcaccaaggtcgccatggtaccggcctgccggggcccggggg

SEQ ID NO: 19963 - protein, 175 aa, Zea mays
  misc_feature: Ceres CLONE 1387773-F
  misc_feature: SWISSPROT Homolog: EC 1.14.17.4 Aminocyclopropanecarboxylate oxidase
MEIPVIDLGGLNGGGEERSRTLAELHDACKDWGFFWVENHGVDAPLMDEVKRFVYGHYEEHLEAKFYASALAMDLEAATRGDTDEKPSDEGDWESTYFIQHHPKTNVADFPRRSRRRHERRWDAYVAQMVSLAERLAECMSLNLGLPRGPRRRTFRGGPFGGHQGRHGTGLPGPG

SEQ ID NO: 19964 - DNA, 622 bp, Zea mays
  misc_feature: Ceres CLONE 1387779-F
  misc_feature: Encodes the peptide sequence at SEQ ID NO. 19965
  misc_feature (385)..(385): n is a, c, t, g, unknown, or other
aagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaatgccgatcaataggatcgccctgtggagccaccaggaggtgtaccacccgggcgccctcaaggaggcgctcgctgagttcatctccaccctcatcttcgtcatcgccgggcaagggctccgggatggccttcagcaagctgaccgggggggggcccgacgaccccgccgggctcgatcgggggggnggggggcgcacgcggtcccggtggtccagggggatgtctgggggcccaaacatctcccgcgggaaggggacccctgccgggaccatccgggggcctcgggggggggaaaaacaccctggtccggggggccccgggaagggggggcccaactggcggggtccccccgggggggggttcctggtccccttttcagggggggggagggcccggggccctttggggtggggggggggtggg

SEQ ID NO: 19965 - protein, 141 aa, Zea mays
  misc_feature: Ceres CLONE 1387779-F
  misc_feature (63)..(63): Xaa is any aa, unknown, or other
MPINRIALWSHQEVYHPGALKEALAEFISTLIFVIAGQGLRDGLQQADRGGARRPRRARSGGXGAHAVPVVQGDVWGPKHLPREGDPCRDHPGASGGGKTPWSGGPREGGAQLAGSPRGGVPGPLFRGGEGPGPFGVGGGW

SEQ ID NO: 19966 - DNA, 696 bp, Zea mays
  misc_feature: Ceres CLONE 1387782-F
  misc_feature: Encodes the peptide sequence at SEQ ID NO. 19967
  misc_feature (343)..(343): n is a, c, t, g, unknown, or other
  misc_feature (360)..(360): n is a, c, t, g, unknown, or other
  misc_feature (612)..(612): n is a, c, t, g, unknown, or other
cgctctagaactagtggatcccccgggctgcaggaattcgcacgagaccattacctagaacatcctaatcgaaaaattgattgatcggacggacgcgcgtctccggtcccgtccgtaataacactgatccgatccacgccggccggcgatggagctcatcaagtccagggcgaccgtgtgcgcgctcctcctggcgctgctcctgctctcacactacgacggcgggacgacgacgacgatggtggcggaggcccgggtgtgcatgggcaagagccagcaccactcgttcccctgcatctccgaccgcctctgcagcaacgagtgcgtcaaggaggacggcggntggaccgccggctactngcacctccgctactgcagggtgccagaaggcgtgctaagcaaagctcttgaaacacccttggcttgccagaactgaactgtggtagtactaagtaacacccttggctagctgtgcacaacctacgtaccgtgcatgcatgtaatgtggtgtcatgtaacggtgacagcataatattaatacccatataccccggcatggagcctttgcatggctctaggcaaaaaaaaaaaaaaagcttatcgataccgccnacctcaagggggggcccggaacccattccccccaaaggggggccaaataacccggctcccgggccgtggtttaaaaaggccggg

SEQ ID NO: 19967 - protein, 95 aa, Zea mays
  misc_feature: Ceres CLONE 1387782-F
  misc_feature (36)..(76): Pfam Name: Gamma-thionin Pfam Description: Gamma-thionin family
  misc_feature (71)..(71): Xaa is any aa, unknown, or other
MELIKSRATVCALLLALLLLSHYDGGTTTTMVAEARVCMGKSQHHSFPCISDRLCSNECVKEDGGWTAGYXHLRYCRVPEGVLSKALETPLACQN

SEQ ID NO: 19968 - DNA, 718 bp, Zea mays
  misc_feature: Ceres CLONE 1387783-F
  misc_feature (526)..(526): n is a, c, t, g, unknown, or other
  misc_feature (527)..(527): n is a, c, t, g, unknown, or other
  misc_feature (651)..(651): n is a, c, t, g, unknown, or other
tccccgcggtggcggccgctctagaactagtggatcccccgggctgcaggaattcgcacgagaccattacctagaacatcctaatcgaaaaatatgactctctccctagtccctacactttctcccccgtgtcccgttgctaaaagcttagagaaaaacctaatcggacagcactgtggccaagcagggcgcgggagatcgtacgccggcggcgaggtcctgcggtggcgggcctcggcagagtggtggtgctagcggagtgcagctgttgggttggtgggtaagagtgagaaggacatgaaggcgctgcggcgatccagcacctcgtcctcgccgacggccgcgtcctcccctccgtcctcagtcgtggatccacatccggtcgctcctcgccgccgccgcgtcctcgtcctcgtcctcctccttcgcagcggctgcggctgggagcgcggtggctgtggtgtcggctgcggtggccgcctcgtcttcttcctcgccggcgtcgtcctcgccgcactcggagcgnngtggtcttaaatctccatggtcccggaggaaaagaaaacgagcactttctcgtgaacagtgggagagtttgttttcagcagatgggaagcttcgtgatggtgggagggagtttctcaagaaagntcgcagtggtggcatggaagcaagatttaggggctgaagtttggcccttcctactaggagtctatga

SEQ ID NO: 19969 - DNA, 860 bp, Zea mays
  misc_feature: Ceres CLONE 1387787-F
  misc_feature: Encodes the peptide sequence at SEQ ID NO. 19970
  misc_feature (7)..(7): n is a, c, t, g, unknown, or other
  misc_feature (9)..(9): n is a, c, t, g, unknown, or other
  misc_feature (12)..(12): n is a, c, t, g, unknown, or other
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (48)..(48): n is a, c, t, g, unknown, or other
ttttttntnttnnttnntcncccccctccctccccgcgccgagcaaanaaaaaaagctggagctcaccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttccccccgtacctctcaccagcggggtctttcggatgtgaaaacccaattcttcacccctacaggatcccaccagggaaatcacaggttggcattcttgaccttctatcaccctttgggtcccctcccaacaaatccatcaggccctaattaaccatccagccttaacccttttgggcggccttttagttggcaacacaaaatcttccgggggccaccaaacaacactaaccacaccaactcttggtggtttaaaccaaagaccctttggcctggccctaaacttcctcaggcaaaaaacaggccggttctcctttcccatttccaaacccaaattataacctcgcaaatttgagaaccctccggccttctttgaatttggggaaaccgaacggggcagccttccccttttcgacccccgggtcacccggggtgtgccctacccccccaagaaatatttgtttcccaattcacacgcaaagtgggcggggggattgggacccctcccgcgggtgtttatctatcaggcgcggggccacaccc

SEQ ID NO: 19970 - protein, 48 aa, Zea mays
  misc_feature: Ceres CLONE 1387787-F
MAAKIFCLLMLLGLSASAATATIFPQCSQAPIASLLPPVPLTSGVFRM

SEQ ID NO: 19971 - DNA, 738 bp, Zea mays
  misc_feature: Ceres CLONE 1387788-F
  misc_feature: Translation starting site: 216
  misc_feature (608)..(608): n is a, c, t, g, unknown, or other
  misc_feature (646)..(646): n is a, c, t, g, unknown, or other
ggagctccccgcggtggcggccgctctagaactagtggatcccccgggctgcaggaattcgcacgagaccattacctagaacatcctaatcgaaaacccatttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcagcccgctgatgttgccggacccagcgagggggtggcggcgatctccagaggggggaaggtagggccgaaccggtgcagcgcctgcaggaagaggggtggacttacgggattcgactggcggtgnggggaacttgtactgcgcactccaccgctactccgacnagcacgactgcaaggtcgactacgggactgctgccagggacgccattgccaagggctatccggtgggtgagggagacaggctcgacagatct

SEQ ID NO: 19972 - DNA, 741 bp, Zea mays
  misc_feature: Ceres CLONE 1387789-F
  misc_feature: Encodes the peptide sequence at SEQ ID NO. 19973
  misc_feature (592)..(592): n is a, c, t, g, unknown, or other
  misc_feature (628)..(628): n is a, c, t, g, unknown, or other
  misc_feature (687)..(687): n is a, c, t, g, unknown, or other
  misc_feature (714)..(714): n is a, c, t, g, unknown, or other
aagctggagctccccgcggtggcggccgctctagaactagtggatcccccgggctgcaggaattcgcacgagaccattacctagaacatcataatcgaaaaacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcacacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagataggacaaccacctctgtggtccttgctcaggngctgatcgctgagggtggttaggttgtggcagctgntgctaatcctgttcagattactcgtggtatcgagaaaacagcgaaagcactagttgagnaactacgggaagtgtctaaggaggtcnaagatagtgagcttgcagatgttgctt

SEQ ID NO: 19973 - protein, 138 aa, Zea mays
  misc_feature: Ceres CLONE 1387789-F
  misc_feature (132)..(132): Xaa is any aa, unknown, or other
MASTFGATSTVGLMAAPTGKNVRLQRRVNFRVRAAKELYFNKDGSAIKKLQTGVNKLAHLVGVTLGPKGRNVVLESKYGSPKIVNDGVTVAREVELEDPVENIGAKLVRQAAAKTNDLAGDRTTTSVVLAQXLIAEGG

SEQ ID NO: 19974 - DNA, 711 bp, Zea mays
  misc_feature: Ceres CLONE 1387792-F
  misc_feature: Encodes the peptide sequence at SEQ ID NO. 19975
  misc_feature (365)..(365): n is a, c, t, g, unknown, or other
aaagtggagctccccgcggtggcggccgctctagaactagtggatcccccgggctgcaggaattcgcacgagaccattacctagaacatcctaatcgaaaagagtaggtgcatggccacgctagatgtagctttttgcagagcgtcgtctgtaaatacgtagcccttcccaagcgaggcaaggtgggagagagtatcgtcagctagcacagagagtgcgtagcaactagcagtggcggagaaccctgctccgaggtccccgctagtgacttctcgcgacgccgctgcgccgcctctgccagaggagttcaccaagctcaccttccgtagcctgtacatccgtcggacaggtccaggcatcccgtnagatgactgtggacgtcaggccgtctgaccagctggcacgacggttcgtgagcgacttttccatatactatgggacggtgtttcgggggcccacctcgtcgctcggttggagggaggcactggcccaaatcggcagcttcgacccaggtagtcagcatcggcttccgagggcgggaggggttaggggttccccgctggccccccagggagggataacggttggttcccaaggagggggccatctaacgggggtacccggaatgttccccatggcccccgggggaatacaaaaaaagttctccccccggaggaacggccggaatctggataggctaccccgcatccg

SEQ ID NO: 19975 - protein, 114 aa, Zea mays
  misc_feature: Ceres CLONE 1387792-F
MTVDVRPSDQLARRFVSDFSIYYGTVFRGPTSSLGWREALAQIGSFDPGSQHRLPRAGGVRGSPLAPQGGITVGSQGGGHLTGVPGMFPMAPGGIQKKFSPRRNGRNLDRLPRI

SEQ ID NO: 19976 - DNA, 664 bp, Zea mays
  misc_feature: Ceres CLONE 1387794-F
  misc_feature: Encodes the peptide sequence at SEQ ID NO. 19977
  misc_feature (422)..(422): n is a, c, t, g, unknown, or other
aaagctggagctccccgcggtggcggccgctctagaactagtggatcccccgggctgcaggaattcgcacgagaccattacctagagcatcctaatcgaaaactcacacaaccaagctcgatcgatctcactctcagctggtcgctcactcttgcagctccacccttcactcagtcttaggctcttagctctaggctctagctagccgcgccactccttcgtgtagccatcagccttctcatcgctaccaatggacactgccgaggtccagaccccgaacgtcgtggcggcgaggaaggcccgtggtaagacccgacgccggcgtcgtgcccgaggagtctggccccgtcgaggccttagaccgagtccgaggctgaggcggctgctcctgctgatcccgagagcttcccgggacgaagagnaggcagccgccgagcccgaggccctgctcctggtgatgcgaggagccgcggtggccgatccgcccgccaggctgaagctgctggtcctgctgggcccaaggagactccccggggcggacaggaggagccccccaggaggagctgctgctgatcctccagctgaggctaggacacgccggggccaaacgttcgcgaggaaaagttgctgctccgaggggtccccgggaaaagccgagctcggg

SEQ ID NO: 19977 - protein, 138 aa, Zea mays
  misc_feature: Ceres CLONE 1387794-F
  misc_feature (58)..(58): Xaa is any aa, unknown, or other
MDTAEVQTPNVVAARKARGKTRRRRRARGVWPRRGLRPSPRLRRLLLLIPRASRDEEXAAAEPEALLLVMRGAAVADPPARLKLLVLLGPRRLPGADRRSPPGGAAADPPAEARTRRGQTFARKSCCSEGSPGKAELG

SEQ ID NO: 19978 - DNA, 756 bp, Zea mays
  misc_feature: Ceres CLONE 1387796-F
  misc_feature (431)..(431): n is a, c, t, g, unknown, or other
  misc_feature (669)..(669): n is a, c, t, g, unknown, or other
  misc_feature (670)..(670): n is a, c, t, g, unknown, or other
tccccgcggtggcggccgctctagaactagtggatcccccgggctgcaggaattcgcacgagaccattacctagaacatcctaatcgaaaaatcaagaaaccagtgagttctaggttagctgaaatctcccttattgtaatctgttcatctcctggcgtgagtctgtggcgctagtgtgatgccttctcctagctcatggcttccggttcgcaatccctaatcctgatctcacttaagcgctcgtgagctctctccagtggctaaagattgcagatttgagttatagtccaagaaaacggtggtggtccgccatggaggtgaggtccgacaagggctgatggcgggaaggatctatccggtatgcaaagaggcccgccggccccgtttccgggccggcggcgtccggcggcatgcagagggtgggcatggncgtacccctcgaacggcaccggtgggttcgctccgatgaaatcttccggcgggacgccggttttacaggccgaggggggacccaaagggggtaagattgtcccgggaaaattttttgaggaaatgggccggaaccttcccccaaaatggggaaaccgggccccaaaaaaaaggcggggcaccaaaggaaattgggcccccagaggccctgggggtgggattttggggccggggggcgnnattaaaggggcccccaaacaagggggggggttttttttggggggcgttcccgcggggggggaaaaaacaaaaaaacctttgtgggg

SEQ ID NO: 19979 - DNA, 697 bp, Zea mays
  misc_feature: Ceres CLONE 1387797-F
  misc_feature: Encodes the peptide sequence at SEQ ID NO. 19980
aagctggagctccccgcggtggcggccgctctagaactagtggatcccccgggctgcaggaattcgcacgagaccattacctagaacatcctaatcgaaaaactgccctggtcccccattcaattcttccaactccgccgcttcgcctcgttccgtccgccgcccccatggcgtccgccgccgccacgaccacctccgcccccgcccagaacctcaatccccttagtatcaacatcaagctccccccatggctcagcgggctgcgctgccccttcaccttcgtctgcccgcccccgcccccgcctccgccgccgccgccgcctcctcccccgctgccacctacggaacccgtggtcccacggtcgcggaggttaccaagcctgcgggtgaccacggagtacgatagcgaagagggcgtgtttgtgaacaaggtgtcgtgcaagcttgcgggggacctcgccaaactgcggctctccttccagagcgacccgcagggcagggcaaaaggggaggcggggcaaacaaagggaccccgcacaagaagttctctccccgcgccggttgggggggccccacccccaagacgttgccccggggcccctacaacgtccaacgaccgcaaaccgcgttgggccccgcgcaagactgggcgggtttccccgaagaggggcccttcaaccttccgttgcctattgat

SEQ ID NO: 19980 - protein, 176 aa, Zea mays
  misc_feature: Ceres CLONE 1387797-F
MASAAATTTSAPAQNLNPLSINIKLPPWLSGLRCPFTFVCPPPPPPPPPPPPPPPLPPTEPVVPRSRRLPSLRVTTEYDSEEGVFVNKVSCKLAGDLAKLRLSFQSDPQGRAKGEAGQTKGPRTRSSLPAPVGGAPPPRRCPGAPTTSNDRKPRWAPRKTGRVSPKRGPSTFRCLL

SEQ ID NO: 19981 - DNA, 577 bp, Zea mays
  misc_feature: Ceres CLONE 1387798-F
  misc_feature: Encodes the peptide sequence at SEQ ID NO. 19982
  misc_feature (264)..(264): n is a, c, t, g, unknown, or other
  misc_feature (266)..(266): n is a, c, t, g, unknown, or other
  misc_feature (305)..(305): n is a, c, t, g, unknown, or other
  misc_feature (306)..(306): n is a, c, t, g, unknown, or other
  misc_feature (321)..(321): n is a, c, t, g, unknown, or other
  misc_feature (344)..(344): n is a, c, t, g, unknown, or other
ggagctccccgcggtggcggccgctctagaactagtggatcccccgggctgcaggaattcgcacgagaccattacctagaacatcccaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctggccccctgcgcgggctgcaggggcttgtacngncgctggcgcccgcctgacgacgatgatgggcgccggcgnncttacccctacccgnagtactgaggcagccgcatgcancccgctggggggggcgccctactaccccggtgggggcacgcgaggcccatgttcaaccgctcgggaaaaggggttccaaaaaaaaaaagagttgatggacgtggaatcctttccggaaaaattggaaaaatatattcacttttgaaggggcgcctttccccccaaaaaaacctttgaaaaaccattttttttggagaaaaaaaaaaaaggttgttgggaccccaagggtcctc

SEQ ID NO: 19982 - protein, 109 aa, Zea mays
  misc_feature: Ceres CLONE 1387798-F
  misc_feature (36)..(36): Xaa is any aa, unknown, or other
  misc_feature (49)..(49): Xaa is any aa, unknown, or other
  misc_feature (62)..(62): Xaa is any aa, unknown, or other
MKMVIVLVVCLALSAASASAMQMPWPPARAAGACTXAGARLTTMMGAGXLTPTRSTEAAACXPLGGAPYYPGGGTRGPCSTAREKGFQKKKELMDVESFPEKLEKYIHF

SEQ ID NO: 19983 - DNA, 674 bp, Zea mays
  misc_feature: Ceres CLONE 1387802-F
  misc_feature (303)..(303): n is a, c, t, g, unknown, or other
  misc_feature (442)..(442): n is a, c, t, g, unknown, or other
  misc_feature (570)..(570): n is a, c, t, g, unknown, or other
  misc_feature (674)..(674): n is a, c, t, g, unknown, or other
aagctggagctccccgcggtggcggccgctctagaactagtggatcccccgggctgcaggaattcgcacgagaccattacctagaacatcctaatcgaaaaaacggatagatacgcatcgaggcagagggcttggccgagatctccccactaccccgcagcgtctttaaaaccaggacctgcttgtttgattgtttcatcgatcgtcaatgcaagtttgtccattcgcattggtctgaaactgtagctactagcgcgagtgccactgtgccgcagctgcctgctcgccattactgcagctgtngtcatcaagcttaattagctccctctacatctgatccagctaagtagctagcccgcactacagaaagggcgtgggcagaatcaggagagagatagcaggggggctagctagctgagctcgtgcgaccaaaaatggccgnaattgcaagaacatggtggcgccggtcctggggctcaactcatcatgacatcatcgtcatcgggttcggaggttgaacctggacacttcatcacgggaagaccactaacccggggtgcccggcaacgncgcgacgttctactttcctggtgtccccattttggcccgggggggtgggcccggggtccaggttgggggcgtggccccacgtggggggccgggggccacaaagn

SEQ ID NO: 19984 - DNA, 671 bp, Zea mays
  misc_feature: Ceres CLONE 1387805-F
  misc_feature: Encodes the peptide sequence at SEQ ID NO. 19985
  misc_feature (371)..(371): n is a, c, t, g, unknown, or other
  misc_feature (469)..(469): n is a, c, t, g, unknown, or other
  misc_feature (494)..(494): n is a, c, t, g, unknown, or other
  misc_feature (514)..(514): n is a, c, t, g, unknown, or other
  misc_feature (515)..(515): n is a, c, t, g, unknown, or other
tggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacngccggtgtgggcagacgagcgccatgtaccagccgctccggcaacagtgctggcagcagcaaatgaggatgatggacgtgcagtccgtcgcgcaacanctgcagatgatgatgccactttgancgtgccgcttgccgcagcanncaccctgtacgagccagttctgatgaagcaagaacaagcagttgctgggcaccccagggtctccaaccccatggccatgatgatggggcaaaaatggccggccatgggtggattctaccaataccaaatacagttgcccagttacccgcccacccc

SEQ ID NO: 19985 - protein, 110 aa, Zea mays
  misc_feature: Ceres CLONE 1387805-F
  misc_feature (71)..(71): Xaa is any aa, unknown, or other
  misc_feature (103)..(103): Xaa is any aa, unknown, or other
MKMVIVLVVCLALSAASASAMQMPCPCAGLQGLYGAGAGLTTMMGAGGLYPYAEYLRQPQCSPLAAAPYYXRCGQTSAMYQPLRQQCWQQQMRMMDVQSVAQXLQMMMPL

SEQ ID NO: 19986 - DNA, 740 bp, Zea mays
  misc_feature: Ceres CLONE 1387809-F
  misc_feature: Translation starting site: 578
  misc_feature (472)..(472): n is a, c, t, g, unknown, or other
  misc_feature (594)..(594): n is a, c, t, g, unknown, or other
  misc_feature (595)..(595): n is a, c, t, g, unknown, or other
  misc_feature (621)..(621): n is a, c, t, g, unknown, or other
  misc_feature (622)..(622): n is a, c, t, g, unknown, or other
  misc_feature (624)..(624): n is a, c, t, g, unknown, or other
  misc_feature (630)..(630): n is a, c, t, g, unknown, or other
  misc_feature (692)..(692): n is a, c, t, g, unknown, or other
  misc_feature (693)..(693): n is a, c, t, g, unknown, or other
  misc_feature (713)..(713): n is a, c, t, g, unknown, or other
tggagctccccgcggtggcggccgctctagaactagtggatcccccgggctgcaggaattcgcacgagaccattacctagaacatcctaatcgaaaaataaatccaattgttccttaaaattacgactcgcacccacggacccaccaaccacgccgccgccggccggccacctttctccattctccgtcaatcgtcatcctatccgatccccaactaggcaactactccgtctcacgcctctcctgtcccctctcgccgctctcgccccgcctctgcctccgcctccgcctcctccatcgcacccagctttcctccccaccccaccgccactcctaccccgccacgtcgtgtagtcgcggcggcggatatgcaagccgccgccgccttcaaccaggcagccttcaccgtccgctcgctgcatcgccccccgaggcccctccatctagctgttgcggaggatgcttttgcggngataagaggcgcgccccttacacggccccggtgctgcgggagcctctctgtcggcgtcggcagctacgacagcgagcacactccagtatttccaagacaacaatcatgggatccctacgagnncttcttggtgttgatcaagatgctcnntnaagagnaggtccggagtgcacggaattttcttctaaacaatacgccggatatgaagaaggtgagaggnncattgaaggtgcttatgacnacgatataatggatagctacacagacc

SEQ ID NO: 19987 - DNA, 782 bp, Zea mays
  misc_feature: Ceres CLONE 1387810-F
  misc_feature: Encodes the peptide sequence at SEQ ID NO. 19988
  misc_feature (366)..(366): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (448)..(448): n is a, c, t, g, unknown, or other
  misc_feature (500)..(500): n is a, c, t, g, unknown, or other
aagctggagctccccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccggnctgatcctggccggcaccgtgatcgcgctcacggtggccacccccgtgctggtgactcgcggnnnnnggggggggcggcggnccccccatcgttttgccgcttatggggggggcgggattcgtcatcatccggngggactcggtcgtccactggccttgaaccgtgtccctaccagttatgaacatgctacctgatctggaaagtcacccgctcgagttgccgaccagaatgtgactcgcctaaggcagaggattgatcgcccaaggaccgcagaacatcaaggatagcagataccggaccgccatcgaggaggggggcccgggtaccttgatacgacaaactagacgtctagtagttacggcgcgcgcccatgctccgtgaatctatgaacggcgtggactgggtaatggcctcg

SEQ ID NO: 19988 - protein, 122 aa, Zea mays
  misc_feature: Ceres CLONE 1387810-F
  misc_feature (80)..(80): Xaa is any aa, unknown, or other
  misc_feature (81)..(81): Xaa is any aa, unknown, or other
  misc_feature (86)..(86): Xaa is any aa, unknown, or other
  misc_feature (103)..(103): Xaa is any aa, unknown, or other
MADHHRGATGGGGGYGDLQRGGGMHGEAQQQQKQGAMMTALKAATAATFGGSMLVLSGLILAGTVIALTVATPVLVTRGXXGGRRXPHRFAAYGGGGIRHHPXGLGRPLALNRVPTSYEHAT

SEQ ID NO: 19989 - DNA, 675 bp, Zea mays
  misc_feature: Ceres CLONE 1387812-F
  misc_feature: Encodes the peptide sequence at SEQ ID NO. 19990
  misc_feature (669)..(669): n is a, c, t, g, unknown, or other
tggagctccccgcggtggcggccgctctagaactagtggatcccccgggctgcaggaattcgcacgagaccattgcctagaacatcctaatcgaaaaattttccgtacgccgtacttccccagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggcgcgcctctcctcgctcgcgggcctgccccgcctcccggcgctccggcgcctctccctccccgacaaccgcctctcgggggccgccgccctcgccgccgtcgccgaggcatgcggcgccacgctgcgccacctcgacctagggaacaaccggttcgcggaggtccaggagctcgcgccactcgccggggtccgggtcgagtcgctcgacctgttccagtgccccgtcaccaaggtcaaggggtacagggatgaggtcttcgcgctgattccagcctcaagtacctcgatggcgctgacgctgaggncaacga

SEQ ID NO: 19990 - protein, 167 aa, Zea mays
  misc_feature: Ceres CLONE 1387812-F
  misc_feature (166)..(166): Xaa is any aa, unknown, or other
MAAAAAGEDDAAWERAISAATKSTSAPKTLTLDGAVKSSTGGLPSAALLERFAASLEELSVAGARLSSLAGLPRLPALRRLSLPDNRLSGAAALAAVAEACGATLRHLDLGNNRFAEVQELAPLAGVRVESLDLFQCPVTKVKGYRDEVFALIPASSTSMALTLRXT

SEQ ID NO: 19991 - DNA, 664 bp, Zea mays
  misc_feature: Ceres CLONE 1387815-F
  misc_feature: Encodes the peptide sequence at SEQ ID NO. 19992
  misc_feature (517)..(517): n is a, c, t, g, unknown, or other
  misc_feature (587)..(587): n is a, c, t, g, unknown, or other
  misc_feature (590)..(590): n is a, c, t, g, unknown, or other
  misc_feature (591)..(591): n is a, c, t, g, unknown, or other
  misc_feature (597)..(597): n is a, c, t, g, unknown, or other
tggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgccccgcggcgcgggcggcgcggttcgcgtgcaacgccacggcgccgcgagcgtccacgtgccaggcgctcgtctcctacgcgccgcccaacgggacggncacgcccacgctggccgccgtgcgggcgatctttcagctccgctccccacgcgcgctgctggggcgcaanggnnctccgntctccacgccgcccacggagcccgcgcccgtgccgctgcgggtccgcctggcctgcctctgctcggg

SEQ ID NO: 19992 - protein, 104 aa, Zea mays
  misc_feature: Ceres CLONE 1387815-F
  misc_feature (56)..(56): Xaa is any aa, unknown, or other
  misc_feature (79)..(79): Xaa is any aa, unknown, or other
  misc_feature (81)..(81): Xaa is any aa, unknown, or other
  misc_feature (83)..(83): Xaa is any aa, unknown, or other
MAPLPASLTPCLWLFLCLLAAPCPAARAARFACNATAPRASTCQALVSYAPPNGTXTPTLAAVRAIFQLRSPRALLGRXGXPXSTPPTEPAPVPLRVRLACLCS

SEQ ID NO: 19993 - DNA, 680 bp, Zea mays
  misc_feature: Ceres CLONE 1387818-F
  misc_feature: Encodes the peptide sequence at SEQ ID NO. 19994
  misc_feature (364)..(364): n is a, c, t, g, unknown, or other
  misc_feature (446)..(446): n is a, c, t, g, unknown, or other
  misc_feature (523)..(523): n is a, c, t, g, unknown, or other
  misc_feature (579)..(579): n is a, c, t, g, unknown, or other
aagctggagctccccgcggtggcggccgctctagaactagtggatcccccgggctgcaggaattcgcacgagaccatacctagaacatcctaatcgaaaaaactactccgtcactttgtttacaaagctcctcctcgatccatcgatcactgcaccggccggcggcaccgcgctcgcaggggctagccaacgagacggcagcaatgggcggaccgtgaccgcagcggcatctacggcggcgcccacgccacctacgggcagcagcagcagcagggaggaggcgggcgcccgatgggtgagcaggtgagggcatgctcacgacaggggccgacggcgtcgcaggcgctgacggtggtgacgctgntccccgctgggccggctgctgctggtgctgtcggggctggcgctgacggcctccggggtggggctgggcgtggccacgccgntgtcctgatcttcagcccgtgctcgtcccccgcgggctggtcatcgggacggccgtcatggggtccctcacgtcggncgcgctggggctcgggggcctggcctcgctcacgtgcctcggcaaacggggggggnagggttccagcgcaccccggactaacgtgaaggaggcccaccgccagaatggcggaggccccggcgcacgccgggccacaagaccgggcaggcagggcagc

SEQ ID NO: 19994 - protein, 105 aa, Zea mays
  misc_feature: Ceres CLONE 1387818-F
  misc_feature (25)..(25): Xaa is any aa, unknown, or other
  misc_feature (52)..(52): Xaa is any aa, unknown, or other
  misc_feature (78)..(78): Xaa is any aa, unknown, or other
MGEQVRACSRQGPTASQALTVVTLXPAGPAAAGAVGAGADGLRGGAGRGHAXVLIFSPCSSPAGWSSGRPSWGPSRRXRWGSGAWPRSRASANGGGRVPAHPGLT

SEQ ID NO: 19995 - DNA, 736 bp, Zea mays
  misc_feature: Ceres CLONE 1387824-F
  misc_feature: Encodes the peptide sequence at SEQ ID NO. 19996
tggagctccccgcggtggcggccgctctagaactagtggatcccccgggctgcaggaattcgcacgagaccattacctagaacatcctaatcgaaaaaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcaacagcagcagcagcgccgcgacgcggaggcggagctcaacctgcccccgggcttccggttccacccgacggacgaggagctggtggcgcactacctctgcgcgcgcgccgcggagcgccgcccgccggtgtccatcatcgccgaggtcgacctgtaccgcttcgacccctgggacctgccggagcgcgccctcttcggccgccgcgagtggtacttcttcacgccgcgagaccgcaagtaccccaacggctcccgccccaaccgcgccgccgggtcgggctactggaaggccacgggcgcgcacaagcccgtggagcacggcggccggacggcgtggatcaagaaggcgctcgtggtactacacggcaagccgccgcgcggggtcaagacggagtgtatcatgcacgagtaccgcctctgcggcgacgcgaaaaagtcaggcggcggcacgctcagggtggatgactgggtgctgtgcccgctgtaa

SEQ ID NO: 19996 - protein, 168 aa, Zea mays
  misc_feature: Ceres CLONE 1387824-F
  misc_feature (21)..(147): Pfam Name: NAM Pfam Description: No apical meristem (NAM) protein
MAAVQQQQQQQRRDAEAELNLPPGFRFHPTDEELVAHYLCARAAERRPPVSIIAEVDLYRFDPWDLPERALFGRREWYFFTPRDRKYPNGSRPNRAAGSGYWKATGAHKPVEHGGRTAWIKKALVVLHGKPPRGVKTECIMHEYRLCGDAKKSGGGTLRVDDWVLCPL

SEQ ID NO: 19997 - DNA, 703 bp, Zea mays
  misc_feature: Ceres CLONE 1387825-F
  misc_feature: Encodes the peptide sequence at SEQ ID NO. 19998
  misc_feature (481)..(481): n is a, c, t, g, unknown, or other
  misc_feature (486)..(486): n is a, c, t, g, unknown, or other
  misc_feature (548)..(548): n is a, c, t, g, unknown, or other
  misc_feature (567)..(567): n is a, c, t, g, unknown, or other
  misc_feature (568)..(568): n is a, c, t, g, unknown, or other
  misc_feature (573)..(573): n is a, c, t, g, unknown, or other
  misc_feature (579)..(579): n is a, c, t, g, unknown, or other
  misc_feature (592)..(592): n is a, c, t, g, unknown, or other
  misc_feature (619)..(619): n is a, c, t, g, unknown, or other
  misc_feature (638)..(638): n is a, c, t, g, unknown, or other
  misc_feature (703)..(703): n is a, c, t, g, unknown, or other
tggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggagaggacaccccgcggaagagggaatgcgagagcgagtgccgagcggcaccagcaagctgacgcgggcgaggacggcgacagcggcgtggacgcctacgtctcccgctccggnaaggngcgagtgccggcgccagtgcctgcgccgccacgagggccaggccgtgggagacccaggaggncatgaggcggtgccgccgnncgcgnactggncgtcgactggagnccaagagtacggtcgcggcagcgaggncgcgggcagtggccccggnagaggtgcgagcgcaccaccgcgggggacttgggtggggagaggcagcgctggctgggaggaaan

SEQ ID NO: 19998 - protein, 73 aa, Zea mays
  misc_feature: Ceres CLONE 1387825-F
MGKGSVGASWWAFLLLAGVLLVVAATAGAEDGVVERDRKEDLRWCKQACEWQYGEDTPRKRECESECRAAPAS

SEQ ID NO: 19999 - DNA, 696 bp, Zea mays
  misc_feature: Ceres CLONE 1387826-F
  misc_feature: Encodes the peptide sequence at SEQ ID NO. 20000
  misc_feature (540)..(540): n is a, c, t, g, unknown, or other
  misc_feature (561)..(561): n is a, c, t, g, unknown, or other
  misc_feature (599)..(599): n is a, c, t, g, unknown, or other
  misc_feature (666)..(666): n is a, c, t, g, unknown, or other
  misc_feature (689)..(689): n is a, c, t, g, unknown, or other
tggagctccccgcggtggcggccgctctagaactagtggatcccccgggctgcaggaattcgcacgagaccattacctagaacatcctaatcgaaaaatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcaggagccggccataaccatgaggtaccacaagggcgcgctcctgtcgggccccatcgccgtcgacttcatctggtacggcgacttctcggcgccgcagcgggcggcgatcaccgacttcgtctcgtcgctgacggcggcggccccggccgcggcgcagccggagccgtccgtgggcacgtggttcaagacggcgcgcaagtactacgccagctccaaggtgccgttcccggngctgcgcctcgggtcccacgncgtcgaccggaactgctccctcggcaggcgcctgacgnagagggacctgctcaggctcggccgcaggggagcccggagccggggcatcaaactggtgctcacggnccgccacgggcccctgggacggnttctgcc

SEQ ID NO: 20000 - protein, 162 aa, Zea mays
  misc_feature: Ceres CLONE 1387826-F
  misc_feature (40)..(159): Pfam Name: Phi_1 Pfam Description: Phosphate-induced protein 1 conserved region
  misc_feature (111)..(111): Xaa is any aa, unknown, or other
  misc_feature (118)..(118): Xaa is any aa, unknown, or other
  misc_feature (131)..(131): Xaa is any aa, unknown, or other
  misc_feature (153)..(153): Xaa is any aa, unknown, or other
  misc_feature (161)..(161): Xaa is any aa, unknown, or other
MACYNTASLAATLLAFALTFQACLAGRRLTALVQEPAITMRYHKGALLSGPIAVDFIWYGDFSAPQRAAITDFVSSLTAAAPAAAQPEPSVGTWFKTARKYYASSKVPFPXLRLGSHXVDRNCSLGRRLTXRDLLRLGRRGARSRGIKLVLTXRHGPLGRXL

SEQ ID NO: 20001 - DNA, 654 bp, Zea mays
  misc_feature: Ceres CLONE 1387831-F
  misc_feature (654)..(654): n is a, c, t, g, unknown, or other
aagctggagctccccgcggtggcggccgctctagaactagtggatcccccgggctgcaggaattcgcacgagaccattacctagaacatcctaatcgaaaaatattgtatcctcactgcctgcgcctccagcgcttacaggtatcgccgagccggatttcatgtcgcaccgtaagttcgagttgccgaggatcgcttccctcggatttgttgccgtgaagagctcctctcgtcaccgcttgaggtcgaactattccctaggtctgaccgcaagaagtcttggcatcgcctgacgttcttgactacgcgactgtctgatcacattggctgcggggctcataaggctgaatcccaactccgtagtagggaaacttgttggatgtaccagcctgaaacccctctcattgattgaaagggacggggcattcgtgaaagctctcgtgatctacaggcctctgatgggatagggcccacatctagctgagaaggagtggatgtctttcgaaaactggggcacggcactacaatagttttcacaagctgatcccaaaatagaaatgaagttggcaaaatgccattcgctcccttttgggatttgaaaaacatgcctctgaaagccgggccttgctcccccccgatttccaggaagaaggtn

SEQ ID NO: 20002 - DNA, 707 bp, Zea mays
  misc_feature: Ceres CLONE 1387835-F
  misc_feature: Encodes the peptide sequence at SEQ ID NO. 20003
aagctggagctccccgcggtggcggccgctctagaactagtggatcccccgggctgcaggaattcgcacgagaccattacctagaacatcctaatcgaaaaaacctcgtgttgttcggagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtggaaaccctgaccgggaagactatcaccctcgagggggaagcctctgaccccatggacaacgtcaagggccaagacccaggacaaggggggcattcctccaaaacaagaaggggttatcttttgtggggaaacaatttggaggacagggggcaccgttttgccgataaaaaaaatcccaaaaaaggaaggcccccccccccttgggggggggggcccccccgggggggggggggtggtgaaaactttttttgggaaaaaaaccctgggccggggggaaagaaatatg

SEQ ID NO: 20003 - protein, 176 aa, Zea mays
  misc_feature: Ceres CLONE 1387835-F
  misc_feature (6)..(74): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVETLTGKTITLEGEASDPMDNVKGQDPGQGGHSSKTRRGYLLWGNNLEDRGHRFADKKNPKKGRPPPPWGGGPPRGGGGGENFFWEKNPGPGGKKY

SEQ ID NO: 20004 - DNA, 680 bp, Zea mays
  misc_feature: Ceres CLONE 1387840-F
  misc_feature: Translation starting site: 361
  misc_feature (342)..(342): n is a, c, t, g, unknown, or other
  misc_feature (347)..(347): n is a, c, t, g, unknown, or other
  misc_feature (356)..(356): n is a, c, t, g, unknown, or other
  misc_feature (513)..(513): n is a, c, t, g, unknown, or other
  misc_feature (514)..(514): n is a, c, t, g, unknown, or other
  misc_feature (556)..(556): n is a, c, t, g, unknown, or other
aagctggagctccccgcggtggcggccgctctagaactagtggatcccccgggctgcaggaattcgcacgagaccattacctagaacatcctaatcgaaaaacggaagtttcggcggcgccggcgtgctcgtgatctcaacccaaggcgtgcctccgctccggtcacccgtcgctccacgcaaccatgtcgaggaggaagaccaggggagcccaaggaggagaacgtcacccttggacccactgtccgtgaaggagagtatgtctttggtgtcgctcacatctttgcatccttcatgacaccttcattctatcactgatttgtctgggagggaaactctggnttcgnatcacccgntggcatgaaggtgaaaggcttgaccgtgacgagtcggcacctttacgctgctatgcttgctgctcaagacgtcgcaaagcgctgcaaggagcttggcattactgcactgcacattaggcttcccgccaccggaggcaacaagaccaagacccctggnnactggtggccagtctgccctcaggccgcttgcctcgttcggnatggaaatcggacgcatggaaggacgtaccccggttcccactgacagactcccaaaaaagggcggtaagaggggaagggagcttaaggcgtctcccctgctggaatttgccggctctgggccgg

SEQ ID NO: 20005 - DNA, 653 bp, Zea mays
  misc_feature: Ceres CLONE 1387845-F
  misc_feature: Encodes the peptide sequence at SEQ ID NO. 20006
  misc_feature (424)..(424): n is a, c, t, g, unknown, or other
cgctctagaactagtggatcccccgggctgcaggaattcgcacgagaccattacctagaacatcctaatcgaaaaatccataggccaccgccatcagcagcccaatacagtggacctggacctccacggcgaagccaccaccacaactccacaagatctagaacctaagaacctgcagaggagaggaagaggagcttggggaggagatggccggcgccgagggcgagaggtgggtggggctagcaacggacttctcggaggggagccgggcggcgctgcggtgggcggcggccaacctgctgcgagccggcgaccacctgctgctgctgcacgtcatcaaggagcccgactacgagcagagcgaggccatcctctgggaatccaccgggctccccgattgattccccctctcgggagttctctngaccctatcattgcgaagaatatgggagcaaggcggacataaaaacctgggacatcctgaccctacggctaccaaaagggaatcggggtgggttgggaaggcctggggggtggaccgggggggaagctcgggcaagttatcctggaaccccgctgacttgtttgggtaaggaaagagggggcctggcaaagtccaaggggggccctggggaggggcgcgaccttttttg

SEQ ID NO: 20006 - protein, 64 aa, Zea mays
  misc_feature: Ceres CLONE 1387845-F
MAGAEGERWVGLATDFSEGSRAALRWAAANLLRAGDHLLLLHVIKEPDYEQSEAILWESTGLPD

SEQ ID NO: 20007 - DNA, 703 bp, Zea mays
  misc_feature: Ceres CLONE 1387847-F
  misc_feature: Encodes the peptide sequence at SEQ ID NO. 20008
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (38)..(38): n is a, c, t, g, unknown, or other
  misc_feature (343)..(343): n is a, c, t, g, unknown, or other
nnnnnccctccccccccccccccccctcccctccactnaaaagggttttatttatacaaagctggagctccccgcggtggcggccgctctagaactagtggatcccccgggctgcaggaattcgcacgagaccattacctagaacatcctaatcgaaaaacacacatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagnggtgtcttcagtatgtgaaaacccaattcttcaaccctacaggatccaacaggcaatcggagcaggcatcttacctttatcacccttggtcctccacaaccggcagccctattacagcaggtacctttggtgcatttgttggcacaaacatcaagggacaacaactaccacaacttgggctaggaaaccttgctgcctactctcagcaacaggagtttcttcccattcaaccaactgggatgcattggaacgccggcggcttatttgccaacaaacaacttaccatttccggtccggcttaggttggcgggcctacgcccccaggcaaattttctttccccaattcaaacgcaagctggg

SEQ ID NO: 20008 - protein, 162 aa, Zea mays
  misc_feature: Ceres CLONE 1387847-F
  misc_feature (43)..(43): Xaa is any aa, unknown, or other
MAAKIFCFLMLLGLSASAATATIFPQCSQAPIASFLPPYLSPXVSSVCENPILQPYRIQQAIGAGILPLSPLVLHNRQPYYSRYLWCICWHKHQGTTTTTTWARKPCCLLSATGVSSHSTNWDALERRRLICQQTTYHFRSGLGWRAYAPRQIFFPQFKRKL

SEQ ID NO: 20009 - DNA, 689 bp, Zea mays
  misc_feature: Ceres CLONE 1387849-F
  misc_feature: Encodes the peptide sequence at SEQ ID NO. 20010
  misc_feature (325)..(325): n is a, c, t, g, unknown, or other
  misc_feature (326)..(326): n is a, c, t, g, unknown, or other
  misc_feature (384)..(384): n is a, c, t, g, unknown, or other
aagctggagctccccgcggtggcggccgctctagaactagtggatcccccgggctgcaggaattcgcacgagaccattacctagaacatcctaatcgaaaaacgcctcctcctccgcctcccgctcctgccgcgcgtcgccgcgttttgtcgcagtccgcgccatggcttcggggaacccctacgccgccgagctcgccgccgccaagaaggccgtcaccctcgccgccaactctgccagacagttcaacaggatattatgcattctggcgttcaggctaagcagacaaagtcctgcacagtggctgatatggatctcaaatatnnggtcgggttttcccttaaagaatggatggaaatcatctgggaaccatttttcattggntggctggagaaggactcagatgaattgagaaaagatggcgcctgaagaatttttgggaagatataactggacctggtccatgaaaacccatctttgatgatgggttcatataacaattccgttaacaaagggaaaggaaacccccctggcaatggaggaagggaaagcctgaggggaggcccttcctggacgaacttgggggggcttggatcccgattgacggacacctaaagggtttctttgggggggggaccaaaaaagccccttggatttggtccccggttaggagagaggtaaaagttgtt

SEQ ID NO: 20010 - protein, 56 aa, Zea mays
  misc_feature: Ceres CLONE 1387849-F
  misc_feature (23)..(23): Xaa is any aa, unknown, or other
MHSGVQAKQTKSCTVADMDLKYXVGFSLKEWMEIIWEPFFIGWLEKDSDELRKDGA

SEQ ID NO: 20011 - DNA, 712 bp, Zea mays
  misc_feature: Ceres CLONE 1387853-F
  misc_feature: Encodes the peptide sequence at SEQ ID NO. 20012
  misc_feature (712)..(712): n is a, c, t, g, unknown, or other
tggagctccccgcggtggcggccgctctagaactagtggatcccccgggctgcaggaattcgcacgagaccattacctagaacatcctaatcgaaaacccgtccctccactcctcccgtcgagcacttggcactgccaatggcggcagccgcccacaccccttcgatgcgcgcaagccgcctcctttcctcctgagatcgacgcacctcctcctctcgtactccattcccgctccaagatcgtttcttcggcaccgagccatcgcacggccgcccccgcatctcgtcctgctctcaggtccttggcctccgccgttcttcgacaggggcgcgccccggtgcccactccgcgaaatccgagtcccttgtgcagctccgtagggtggaagagatccatcaggcggtgagcggtaggaggcgcccgtacaactgaggggacggacaatggcggccgtggcaggcccactctgcacgtggctcgtcgccgcgtgcttgtctgcggcttgcgacgcaaaagagtacaagcagaagcattgctgccccggcggaagcgacgctgggggcggagtcatgctcggactgcgtcgccgcctcggcgcgcggcgtcgcggcttggcgcgctctggaatggctatggctgttgccttacacgctgaaagagtgtcattgaaaagagaaatccgatatcaacaaaggaggttggttgtcactgn

SEQ ID NO: 20012 - protein, 89 aa, Zea mays
  misc_feature: Ceres CLONE 1387853-F
MAAVAGPLCTWLVAACLSAACDAKEYKQKHCCPGGSDAGGGVMLGLRRRLGARRRGLARSGMAMAVALHAERVSLKREIRYQQRRLVVT

SEQ ID NO: 20013 - DNA, 648 bp, Zea mays
  misc_feature: Ceres CLONE 1387867-F
  misc_feature: Encodes the peptide sequence at SEQ ID NO. 20014
  misc_feature (544)..(544): n is a, c, t, g, unknown, or other
  misc_feature (575)..(575): n is a, c, t, g, unknown, or other
  misc_feature (632)..(632): n is a, c, t, g, unknown, or other
tccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggccgtcatggggttcctcacgtcgggcgcgctggggggcttcgggggcctgtncctcgctcacgtgcctcgccaacaccggcgncggcaggcgtttccagcgcaccccggagcttaccgtggaaggaggcgcaccgcaagnaatggcgggaggccgc

SEQ ID NO: 20014 - protein, 151 aa, Zea mays
  misc_feature: Ceres CLONE 1387867-F
  misc_feature (44)..(151): Pfam Name: Oleosin Pfam Description: Oleosin
  misc_feature (117)..(117): Xaa is any aa, unknown, or other
  misc_feature (146)..(146): Xaa is any aa, unknown, or other
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTAVMGFLTSGALGGFGGLXLAHVPRQHRRRQAFPAHPGAYRGRRRTAXNGGRP

SEQ ID NO: 20015 - DNA, 442 bp, Zea mays
  misc_feature: Ceres CLONE 1387880-R
  misc_feature (83)..(83): n is a, c, t, g, unknown, or other
  misc_feature (315)..(315): n is a, c, t, g, unknown, or other
cgattgggaccgggccccccctcgaggtcgacggtatcgataagcttttttttttttttttttgattgatcacttccagtttngatgccgaactacgacgaccgtagaaatatatagttacacacacacgatggaaattaaacagaagtgcatgcagatagactcaacaattaacgtacgtggaactagctggttagcataacaacagcagtagtactagtacagcacaacgtaacgacgaccgacgatgatcatctagtagtagtggtcgatgatctctagtggcacgcgaccgaagcgacactgagctggtangaaaaaaggaaatttgggaattactgggaaaggaaaaacgggccctccccctgggggttcccaaaggggggggggccccccccccccttttaaaaaaaccccaaattccctcttcaaaaaaaagggg

SEQ ID NO: 20016 - DNA, 644 bp, Zea mays
  misc_feature: Ceres CLONE 1387880-F
  misc_feature: Translation starting site: 379
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (431)..(431): n is a, c, t, g, unknown, or other
  misc_feature (442)..(442): n is a, c, t, g, unknown, or other
tggagctccccgcggtggcggccgctctagaactagtggatcccccgggctgcaggaattcgcacgagaccattacctagaacatcctaatcaaaagtaccatgttcaaaacgaaaagtctgatctgaagccagcagacgtgaaaccgacagcacgtacgtacgtacgtgtgagggctgctcggcggccattgggagaatggtgcttcaagaaacgcgcagcttctggtgattatttgtggccatttatttaagctcgcttgcagctgctcctgataacttgctcaagaagctggaggagaaccacgaggtgtggtcgtcgtcatcctcgccggccggtggtcgtggtggcggcgccgtcgtcgtcccgacggcgcggatggggccggacggcgccnnncccctggtttctcggggaaagaagccgttggntggtgtaccanaagcagcgccaaccctctgcccagcggcatcccggcctacaccgtgcagatcatcaacgtctgcggcggagggtgcaccgtgtacgacgtgcacgtctcctgcggcgacttcgcctccacggagctcgtcgacccggccaagttccagcgcgtcgccttcgacgactgcgtcgtcaagggcggcgccgccttggaaccagcg

SEQ ID NO: 20017 - DNA, 656 bp, Zea mays
  misc_feature: Ceres CLONE 1387881-F
  misc_feature: Encodes the peptide sequence at SEQ ID NO. 20018
  misc_feature (393)..(393): n is a, c, t, g, unknown, or other
  misc_feature (447)..(447): n is a, c, t, g, unknown, or other
  misc_feature (539)..(539): n is a, c, t, g, unknown, or other
  misc_feature (547)..(547): n is a, c, t, g, unknown, or other
  misc_feature (598)..(598): n is a, c, t, g, unknown, or other
  misc_feature (600)..(600): n is a, c, t, g, unknown, or other
  misc_feature (624)..(624): n is a, c, t, g, unknown, or other
  misc_feature (643)..(643): n is a, c, t, g, unknown, or other
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatggnagagcgagtgccgcgagcggcaccagcaagctgacgcgggcgaggacggcgacnagcggcgtggacgcctactctccgctcggaaaaagaggggcgaagtgccggcgccagtgcctgcgcccgccacgagggccaggccgtggagnaacccagnaggcgctttgaggcggtgcccgccggcgcccggactggccgtcgaatggangncaaaggagttacggtcgcggcagncgaagacgcgggcaggggncccccgggaaaag

SEQ ID NO: 20018 - protein, 151 aa, Zea mays
  misc_feature: Ceres CLONE 1387881-F
  misc_feature (64)..(64): Xaa is any aa, unknown, or other
  misc_feature (82)..(82): Xaa is any aa, unknown, or other
  misc_feature (112)..(112): Xaa is any aa, unknown, or other
  misc_feature (115)..(115): Xaa is any aa, unknown, or other
  misc_feature (132)..(132): Xaa is any aa, unknown, or other
  misc_feature (133)..(133): Xaa is any aa, unknown, or other
  misc_feature (141)..(141): Xaa is any aa, unknown, or other
  misc_feature (147)..(147): Xaa is any aa, unknown, or other
MGKGSVGASWWAFLLLAGVLLVVAATAGAEDGVVERDRKEDLRWCKQACEWQYGKDTPRKREWXSECRERHQQADAGEDGDXRRGRLLSARKKRGEVPAPVPAPATRARPWXNPXGALRRCPPAPGLAVEWXXKELRSRQXKTRAGXPREK

SEQ ID NO: 20019 - DNA, 629 bp, Zea mays
  misc_feature: Ceres CLONE 1387886-F
  misc_feature: Encodes the peptide sequence at SEQ ID NO. 20020
  misc_feature (360)..(360): n is a, c, t, g, unknown, or other
  misc_feature (376)..(376): n is a, c, t, g, unknown, or other
  misc_feature (388)..(388): n is a, c, t, g, unknown, or other
  misc_feature (408)..(408): n is a, c, t, g, unknown, or other
  misc_feature (426)..(426): n is a, c, t, g, unknown, or other
  misc_feature (473)..(473): n is a, c, t, g, unknown, or other
  misc_feature (629)..(629): n is a, c, t, g, unknown, or other
cgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccaccgccggggcggaagacggagtggtcgaacgggaccgcaaggaggacctgcggtggtgcaagcaggcgtgcgagtggcagtacgnaaaggacaccccgcgnaagagggatgcnagagcgagtgccgcgagcgncaccagcaagctgacgcnggcgaggacggcgacagcggcgtggacgcctacgtctccgctccggnagaggggcgagtgccggcgccagtgcctgcgccgccacgagggcccagccgtggaggaccccagagggcattgaggcggtgccgccgccgcgggactggccgtcgacatggagccaagaagtacggtcgcggcagcgagagcgcgggcagtggccn

SEQ ID NO: 20020 - protein, 115 aa, Zea mays
  misc_feature: Ceres CLONE 1387886-F
  misc_feature (54)..(54): Xaa is any aa, unknown, or other
  misc_feature (70)..(70): Xaa is any aa, unknown, or other
  misc_feature (76)..(76): Xaa is any aa, unknown, or other
  misc_feature (92)..(92): Xaa is any aa, unknown, or other
MGKGSVGASWWAFLLLAGVLLVVAATAGAEDGVVERDRKEDLRWCKQACEWQYXKDTPRKRDARASAASXTSKLTXARTATAAWTPTSPLRXRGECRRQCLRRHEGPAVEDPRGH

SEQ ID NO: 20021 - DNA, 641 bp, Zea mays
  misc_feature: Ceres CLONE 1387887-F
  misc_feature: Translation starting site: 193
  misc_feature (429)..(429): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
tggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttccgncnnnnnnnnnngggggggccgggcaacttgggtgggctctggggggggggcgggtttcgtcacctccggggggcctcgggcgccgctggctctgtccgtgtccctcctgaatgtacaagtacctgacgggcaagcacccgccgggcgccgaccagctggacacgccagggcggaggctggcgtccaaggcccgcgacatcaaggatgcagca

SEQ ID NO: 20022 - DNA, 612 bp, Zea mays
  misc_feature: Ceres CLONE 1387894-F
  misc_feature: Encodes the peptide sequence at SEQ ID NO. 20023
  misc_feature (494)..(494): n is a, c, t, g, unknown, or other
  misc_feature (521)..(521): n is a, c, t, g, unknown, or other
  misc_feature (524)..(524): n is a, c, t, g, unknown, or other
  misc_feature (545)..(545): n is a, c, t, g, unknown, or other
  misc_feature (595)..(595): n is a, c, t, g, unknown, or other
  misc_feature (596)..(596): n is a, c, t, g, unknown, or other
tccccgcggtggcggccgctctagaactagtggatcccccgggctgcaggaattcgcacgagaccattacctagaacatcctaatcgaaaactgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgcctcaaggagggaggcgtcctcctggcatcaggtttgacaggcaccattgaggttgntggcactgataaggagaccacacccanggncatgacgaccttggcaagcgntgcgccaagtactacgagggcaggtgccgctttgccaagtggcgcgctgnntctcagattggcccta

SEQ ID NO: 20023 - protein, 103 aa, Zea mays
  misc_feature: Ceres CLONE 1387894-F
  misc_feature (11)..(103): Pfam Name: Glycolytic Pfam Description: Fructose-bisphosphate aldolase class-I
  misc_feature: SWISSPROT Homolog: EC 4.1.2.13 Fructose-bisphosphate aldolase
MSAYCGKYKDELIKNAAYIGTPGKGILAADESTGTIGKRLSSINVENVEENRRALRELLFCCPGALQYISGVILFEETLYQKTKDGKPFVDASRREASSWHQV

SEQ ID NO: 20024 - DNA, 665 bp, Zea mays
  misc_feature: Ceres CLONE 1387896-R
  misc_feature: SWISSPROT Homolog: EC 1.2.1.12 Glyceraldehyde-3-phosphate dehydrogenase (phosphorylating)
cgattgggtaccgggccccccctcgaggtcgacggtatcgataagcttttttttttttttttttcagaacaaaactgctacctctccacgagcagcaaaaagctaatctcaggtcccatattagcgagcggatctgtcacagatggtagcaggaagggaaacaaaagtgcaaaacatgtccagactcagcatgaacctggcgacccagaggcacgcgccatccacatttattctcggcatcccaagcagcaaccatccatgagaagcaggggggaaaaacccctactgggtcttgaacatgtggcggatcaagtcgacgacgcggttgctgtagccccactcgttgtcgtaccacgagacgagcttgactaagtggtcgttcacagcgatcccggccttggcatcaaagatgctcgacctgctgtcaccaaggaagtcggtagaaaccagatcctcttcctcataacccatgatacccttgagtggaccctccgaagcagccttaatagctttcttgatatcctcataggaggcccccttctcgattctgaccgtgaggtcaacaaccaagacatccactgtatgaacaccgaaggacatacccgagagcttgccgttcagatcaggaagaactttaccaacagccttggcagcaccggtgctgc

SEQ ID NO: 20025 - DNA, 672 bp, Zea mays
  misc_feature: Ceres CLONE 1387901-F
  misc_feature: Encodes the peptide sequence at SEQ ID NO. 20026
  misc_feature (337)..(337): n is a, c, t, g, unknown, or other
  misc_feature (356)..(356): n is a, c, t, g, unknown, or other
  misc_feature (477)..(477): n is a, c, t, g, unknown, or other
  misc_feature (478)..(478): n is a, c, t, g, unknown, or other
  misc_feature (483)..(483): n is a, c, t, g, unknown, or other
  misc_feature (577)..(577): n is a, c, t, g, unknown, or other
  misc_feature (613)..(613): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
tggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgnaccggcggcggcccgacgnaccccggcgggcctgatccgcggcggcggtggcgcacgcgttcgcgctgttccgtgggcgggtgtctgtgggcgcgaacattctccgggcgggcacgggaaaccctgccgtgaccttcggnnggccnttcgtgggcggcaacatcaccctggttccgggggtcctgggaactgggtggcgaaacttgctgggtccccccccgtggcgtgcttcctgctcgncttcttcgagggggcgggcaggcccgggcaccttcngctgaggnnnnnngnnnnnnttgggagaaaagcttttgttttttaaaaaccggaggccc

SEQ ID NO: 20026 - protein, 58 aa, Zea mays
  misc_feature: Ceres CLONE 1387901-F
  misc_feature (48)..(48): Xaa is any aa, unknown, or other
  misc_feature (54)..(54): Xaa is any aa, unknown, or other
MPINRIALGSHQEVYHPGALKAAFAEFISTLIFVFAGQGSGMAFSKLXRRRPDXPRRA

SEQ ID NO: 20027 - DNA, 656 bp, Zea mays
  misc_feature: Ceres CLONE 1387902-F
  misc_feature: Encodes the peptide sequence at SEQ ID NO. 20028
  misc_feature (614)..(614): n is a, c, t, g, unknown, or other
tggagctccccgcggtggcggccgctctagaactagtggatcccccgggctgcaggaattcgcacgagaccattacctagaacatcctaatcgaaaaatcgcacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcgggcggttaggtcgcccctctcccggtggcgaattacgtggtggcggtggcaggtcgtgttgtgttcttggtctagttagtctgtgtgtactatatcggtgctgttttctggggggggttgtactgcatcgttctagtttctagnccatgtgctgtaatatctcgctgctgaaatccatgggaatgt

SEQ ID NO: 20028 - protein, 148 aa, Zea mays
  misc_feature: Ceres CLONE 1387902-F
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGRLGRPSPGGELRGGGGRSCCVLGLVSLCVLYRCCFLGGVVLHRSSF

SEQ ID NO: 20029 - DNA, 677 bp, Zea mays
  misc_feature: Ceres CLONE 1387903-F
  misc_feature: Encodes the peptide sequence at SEQ ID NO. 20030
  misc_feature (383)..(383): n is a, c, t, g, unknown, or other
  misc_feature (467)..(467): n is a, c, t, g, unknown, or other
  misc_feature (473)..(473): n is a, c, t, g, unknown, or other
  misc_feature (504)..(504): n is a, c, t, g, unknown, or other
  misc_feature (507)..(507): n is a, c, t, g, unknown, or other
  misc_feature (525)..(525): n is a, c, t, g, unknown, or other
  misc_feature (533)..(533): n is a, c, t, g, unknown, or other
tggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatgggcggaattggcaggaacatggtggcgccgctcctggtgctncacctcatcatgtacatcatcgtcatcggcttcgcgagctggaacctgaaccactttcatcacggggcagaccaactaccccgncgtggnccgcaaccggcgcgaacgtctactttctggntgntcgccatcctggccggcntgggtggnccccggcttccaggctgggcggggtgcacccagtggcgggcctggggccacaaaagcctggcccacaaagggcgggtggttgtttattggccggggccatccggggcctgccctccgggttggccgggaaggaaacccattcgg

SEQ ID NO: 20030 - protein, 113 aa, Zea mays
  misc_feature: Ceres CLONE 1387903-F
  misc_feature (56)..(56): Xaa is any aa, unknown, or other
  misc_feature (57)..(57): Xaa is any aa, unknown, or other
  misc_feature (63)..(63): Xaa is any aa, unknown, or other
MGGIGRNMVAPLLVLHLIMYIIVIGFASWNLNHFHHGADQLPRRGPQPARTSTFWXXAILAGXGGPRLPGWAGCTQWRAWGHKSLAHKGRVVVYWPGPSGACPPGWPGRKPIR

SEQ ID NO: 20031 - DNA, 658 bp, Zea mays
  misc_feature: Ceres CLONE 1387904-F
  misc_feature: Encodes the peptide sequence at SEQ ID NO. 20032
  misc_feature (315)..(315): n is a, c, t, g, unknown, or other
tggagctccccgcggtggcggccgctctagaactagtggatcccccgggctgcaggaattcgcacgagaccattacctagaacatcctaatcgaaaaaagtccagaacctcgcttccaatctgccctcccgtgtccccctccctgtccgattccccacagtagcgcctcgccctcgtcctcctcctccagtccggatcgccatttcccaccgatccgtcccggcatcggcatggctgcgcccaagccaaaggcgccggcgcccagtgcttcggcagcctagcgtttgtttgcctccgaggattcccgctatcgcngtaccggatcttcggtgggccggcgaccctctacgccactatgagctccgacgggcgcctccgccgcgggctggcccgcgtcggcggcgacgggggggacctccggaaagcggcgcttcccggccgcggcggggaaagccccggtgaactggggggggacccgaaaggatttctccaaaggccttctaccaagggaaaccccgttgcccaatttgggaagcccgaaaacacccccggggccctgtctcccccggagaaagggaaatggacccccccccttgtgggtttttttccctggggggggcgggggtcgcggttttccccccccccccccgaaaagaga

SEQ ID NO: 20032 - protein, 101 aa, Zea mays
  misc_feature: Ceres CLONE 1387904-F
MSSDGRLRRGLARVGGDGGDLRKAALPGRGGESPGELGGDPKGFLQRPSTKGNPVAQFGKPENTPGALSPPEKGKWTPPLVGFFPWGGRGSRFSPPPPEKR

SEQ ID NO: 20033 - DNA, 639 bp, Zea mays
  misc_feature: Ceres CLONE 1387908-F
  misc_feature: Translation starting site: 241
  misc_feature: SWISSPROT Homolog: EC 5.3.99.6 Allene-oxide cyclase
  misc_feature (528)..(528): n is a, c, t, g, unknown, or other
tggagctccccgcggtggcggccgctctagaactagtggatcccccgggctgcaggaattcgcacgagaccattacctagaacatcctaatcgaaaaaaaatgcctagtaaataaacacgccactgaccaacttgactgcttctaagaggtgtagggccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcagcggcggcgtcgccgtgcgggcgtcgctgttctcgcccaagcccgcggcggccaaggacgcgcggccgaccaaggtgcaggagctgtacgtgtacgagatcaacgagcgggaccgcgagagccccgcgtacctgcgcctcagcgccaagcagacggagaacgcgctngggcgatcttgtccccttcaccaacaaggtgtacaacggcagcctggacaagcggctgggcgtcaccgcgggcatctgcgtgctcatccagcacgtccccgaccgcaacgg

SEQ ID NO: 20034 - DNA, 633 bp, Zea mays
  misc_feature: Ceres CLONE 1387915-F
tcagaactagtggatcccccgggctgcaggaattcgcacgagaccattacctagaacatcctaatcgaagaattcttctcttcgactcccactcccactctccctttccactctcaggctcccactccccccctaccggctaccctacccatcacacacaaaaaggcactcctcacctcccccgtcctccggttcatgtcctgctgctccccatgtcgcccccactcgacctcgactacataggtctctcgccggcgggggttgccgccgctgtcccacgacagacctgaaggggaccgagctccgccttggtctgccggggtccggttcaccggaccgccgtgttgtggatgccaccgcaaccaccctggacctgctcccggctaacgctgcccagcgcgggttttctgacgaggccccgacgccatcgcccggtgtagcttccgctaacgaaaagaaggtagcggaagaggaggaccacgagaaggttgcagcgacgccgcagccggtcgcaaaagctcaggtgctgggatggccaccaatccgaagctaccgcaagaacactatgtctaccacccagctgaaggacagcaaggaggatgctgaggccaatctggaccagcggttcctgga

SEQ ID NO: 20035 - DNA, 627 bp, Zea mays
  misc_feature: Ceres CLONE 1387916-F
  misc_feature: Encodes the peptide sequence at SEQ ID NO. 20036
  misc_feature (534)..(534): n is a, c, t, g, unknown, or other
  misc_feature (558)..(558): n is a, c, t, g, unknown, or other
  misc_feature (583)..(583): n is a, c, t, g, unknown, or other
tccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggccgtcatgggttccctcacgtcgggcgcgctgggggctcggnggcctgtccctcgctcacgtgccntcgccaacacggcgcggcaggcgtncccagcgcaccccggactaaacctggaggaggcgcaccgcagga

SEQ ID NO: 20036 - protein, 144 aa, Zea mays
  misc_feature: Ceres CLONE 1387916-F
  misc_feature (44)..(144): Pfam Name: Oleosin Pfam Description: Oleosin
  misc_feature (114)..(114): Xaa is any aa, unknown, or other
  misc_feature (122)..(122): Xaa is any aa, unknown, or other
  misc_feature (130)..(130): Xaa is any aa, unknown, or other
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTAVMGSLTSGALGARXPVPRSRAXANTARQAXPAHPGLNLEEAHRR

SEQ ID NO: 20037 - DNA, 646 bp, Zea mays
  misc_feature: Ceres CLONE 1387933-F
  misc_feature: Encodes the peptide sequence at SEQ ID NO. 20038
ggagctccccgcggtggcggccgctctagaactagtggatcccccgggctgcaggaattcgcacgagaccattacctagaacatcctaatcgaaaaaccaactccaactgcaaccccaccccataccgccgccgcctccgctagggttttggagtgaggatcgccgatgtcgacggctcacaggcgccccttccgaggccgcggcgccccgccccctggcaccggctacgtccgccgcggccccgcccctgccccaggccccgccgacggtgccaagaccctgcgcaagcccgtcttcaccaccgtcgaccagctgcgcccccagacgcacggacacaccctcaccgcccgcgtcatctccgcccgcaccgtcctcgacaagccctccacgcacatcggtcgcacccgcgtcgcagagtgcctcgtcggagacagcaccggcaccgtcctcgtcaccgcccgcaacgaacaggttgaccttctgaagccagatacaacagtgatctttcgcaacgctaagattgacatgtttcagggctacatgagtgctgaggtgcacaagtgccctccgcattgaggagactcaccctgctgatttcaaggtgaaacaagacaatcacatgtccctgtcggaatacgagcctgt

SEQ ID NO: 20038 - protein, 136 aa, Zea mays
  misc_feature: Ceres CLONE 1387933-F
MSTAHRRPFRGRGAPPPGTGYVRRGPAPAPGPADGAKTLRKPVFTTVDQLRPQTHGHTLTARVISARTVLDKPSTHIGRTRVAECLVGDSTGTVLVTARNEQVDLLKPDTTVIFRNAKIDMFQGYMSAEVHKCPPH

SEQ ID NO: 20039 - DNA, 635 bp, Zea mays
  misc_feature: Ceres CLONE 1387952-F
  misc_feature (593)..(593): n is a, c, t, g, unknown, or other
aagctggagctccccgcggtggcggccgctctagaactagtggatcccccgggctgcaggaattcgcacgagaccattacctagaacatcctaatcgaaaagagattgagcgattccatcttctaactagagacatagagtcgcctgccgctgaagcctcatccttctcgttcccgtctcaaatgtcgacggacgccggcagagacggcgtcgccgccgagagagtaaccggtggcaccgaggatggaggatgattcaccgctgaccaatagaagaaagctgcctcgacaggactctccgcgtcgtaccatctggggtaccgtcggcgcacacctggtacgacatgtgccgtgtgtagcgccacgtcgcgctctctgcgcttatccggaggtgcaagatgagcagcacctacgggagctgcttcggcaccatcggggggatctacatcgcagtcgaggagctcgtgaaaagttagcgcaagaacggcgacttcgtcaaggaggccgtcggcgcgtgcattgccgcagcctctgtgtgcggctacagaggaaatagtattcagtcagccctcatcgaaggctcctgtatggctntcacatgtgctgtgctggacattgacggcaatacgaacagag

SEQ ID NO: 20040 - DNA, 648 bp, Zea mays
  misc_feature: Ceres CLONE 1387956-F
  misc_feature: Encodes the peptide sequence at SEQ ID NO. 20041
  misc_feature (575)..(575): n is a, c, t, g, unknown, or other
  misc_feature (591)..(591): n is a, c, t, g, unknown, or other
  misc_feature (613)..(613): n is a, c, t, g, unknown, or other
aagctggagctccccgcggtggcggccgctctagaactagtggatcccccgggctgcaggaattcgcacgagaccattacctagaacatcctaatcgaaaaagatcgggtcctaggctacagcagccgccgcatccgtcaccttcacaccgcgtgcgtggtctctctccccctccccctctccgtgcgacgactgggtgggctaccgccgccctacgcaaggtgccgagaacttcgccgatatctgcgccggagaagagcgcccaccagatcaggcgcttagaaggcgcgctggccggtgcatgacgatggcgcatggcgacggactgaaccggtcttcatcgagggggcagctgccgccgcaagagctgcttgacgatctctgcagccgtatccttctgaatgtgcccaaggaggagctggagtcgttcgagcggatcctgttcctgctggagcaggcgcactggttctatgatgactactccgttgagcacaacctcgaccctcagtccctctaccttcaggacttcacttccctcatgttcaagagctgcactgctctccggccctacatcngcgcactggatgatantctacaggacttcactactacnagtttcgtgtgccctgtgtgcggcgccatcatcct

SEQ ID NO: 20041 - protein, 113 aa, Zea mays
  misc_feature: Ceres CLONE 1387956-F
  misc_feature (19)..(103): Pfam Name: DCP2 Pfam Description: Dcp2, box A domain
  misc_feature (90)..(90): Xaa is any aa, unknown, or other
  misc_feature (95)..(95): Xaa is any aa, unknown, or other
MAHGDGLNRSSSRGQLPPQELLDDLCSRILLNVPKEELESFERILFLLEQAHWFYDDYSVEHNLDPQSLYLQDFTSLMFKSCTALRPYIXALDDXLQDFTTTSFVCPVCGAII

SEQ ID NO: 20042 - DNA, 655 bp, Zea mays
  misc_feature: Ceres CLONE 1387957-F
  misc_feature: Encodes the peptide sequence at SEQ ID NO. 20043
aagctggagctccccgcggtggcggccgctctagaactagtggatcccccgggctgcaggaattcgcacgagaccattacctagaacatcctaatccaaaaatccggcatatgctcgacgccgaatagagatctactactcatgctagcgctgcgacattgaattttaattcatattgacaacacatgatccaccaactttctacatatgattgtacgccatgcatatgccgatcgagctcatctatcatctatagactggccttctactaccagaacctgcgagcagtccaggctacactcgtgaggctactaactacttgcacgtaagggagaggactggcaagcctatcttgcgttctagcgtaatcagctgtgcgctccggcgctctgtccgccctattgctgctgtgaccctggtggtgcttctctacggagactctcgtcgcgcaccaacagctgcaggtggttgtctgacaccttgatctccaccgcttgccgaggcatcatgatctccgtcaccagctaccgtgccttgaacttcctctgttattcgggctccaccaactaccatacagccagctcttgtatgtgtaccgcgacgagtcaccctcggtcgtcgacgtgtcaagactgaactctcctgatcgtcgacg

SEQ ID NO: 20043 - protein, 47 aa, Zea mays
  misc_feature: Ceres CLONE 1387957-F
MIHQLSTYDCTPCICRSSSSIIYRLAFYYQNLRAVQATLVRLLTTCT

SEQ ID NO: 20044 - DNA, 643 bp, Zea mays
  misc_feature: Ceres CLONE 1387958-F
  misc_feature (535)..(535): n is a, c, t, g, unknown, or other
  misc_feature (540)..(540): n is a, c, t, g, unknown, or other
  misc_feature (596)..(596): n is a, c, t, g, unknown, or other
  misc_feature (608)..(608): n is a, c, t, g, unknown, or other
aaagctggagctccccgcggtggcggccgctctagaactagtggatcccccgggctgcaggaattcgcacgagaccattacctagaacatcctgatcggaaaactcttctcccctctctctcttccccgccccctctgtctcgacatcggtgccgtcatcttctcggcctctcgccggttggatccatcgggcgctggtcggatctgcctttcggtcgccgttgcccctccgccacgcctcgcgccagccggtcctgctgagcgccggcctgatccgcctccctctagtcggatctgcttggcgtcggcctctcgccgctactgctccgcatcctgtgcttcctcaccgatgcacgatcctggcaccacgccacgccggtgtgctaccggctccttgcggcggagcggaccacatgatctgtgctcacgctgagcagggaaccacgatcgctcgcgttcctcatcattaagccgactttctacttctcgacgctggagcagcttgacctctcactggtgtcgtcgtcgcctctcngcggncggtcgggtctcccggtggcaggcgagcggccctgttgccaatggctgagtaccgntgacatggccgnccccggtggcttcgatcgccggggctgggaaacgg

SEQ ID NO: 20045 - DNA, 659 bp, Zea mays
  misc_feature: Ceres CLONE 1387970-F
  misc_feature (388)..(388): n is a, c, t, g, unknown, or other
aaagctggagctccccgcggtggcggccgctctagaactagtggatcccccgggctgcaggaattcgcacgagaccattacctagaacatcctaatcgaaaactcggttcatctcgtttttctatttcggcccctctactggtccaataataatactaagattctcgattctgtttactcgcctattttctgggagcggtggcgatcgggttcggatcggcgcagtgcggcgtagcgtacatgtgtgccgtgtaggtggatggcctgatccgcggagcggacgccgtgccgtcggcagagagataagcggtgaggtagctagctgagcatcgcgcgcccaagacggcgaggattgatcgaacaaggaggagccgacgcagtatgatanccacatgcatgaactgcatgagctgctttctaagctgatcccatcggagagatttcgtgccgcaataccgactacgcggggaaggcgggcatcccggctttcggccaatgcggccgggttccagtcctgggcgatggattaaaaggggggccccacctggttccgggcgcccaatttttgggcctgggcccaacccaatgcggggcctcaaatttggggggggggcccacggcggggggaaatgggggggccccccttggaggggcccccc

SEQ ID NO: 20046 - DNA, 655 bp, Zea mays
  misc_feature: Ceres CLONE 1387974-F
  misc_feature: Encodes the peptide sequence at SEQ ID NO. 20047
  misc_feature (637)..(637): n is a, c, t, g, unknown, or other
aaagctggagctccccgcggtggcggccgctctagaactagtggatcccccgggctgcaggaattcgcacgagaccattacctagaacatcctaatcgaaaaatcacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggacggatcgggcgctacctcaagaaggggcggtacgcgcagcgcgtgggcaccggcgcccccgtctatctcgccgccgtgcttgagtacctcgccgccgaggagctggagctggccgcgaacgcggcgaatgacaacaagaagacgcgcatcgtcccgcgacacttgctcctggcgattcttaacgacgttgagctcggcaagctgctgtctggcgtcaccatcgcgcacggcggtgtcctccccaacatcaacccggttctcctgcccaagaaggtggcgcagaaagcgtccagcggcgacagcaaggagagcagtcccctaagaaagtcgccnagtcaccaaagaaggcac

SEQ ID NO: 20047 - protein, 157 aa, Zea mays
  misc_feature: Ceres CLONE 1387974-F
  misc_feature (29)..(102): Pfam Name: Histone Pfam Description: Core histone H2A/H2B/H3/H4
MDASGAGSKAKKGAAGRKAGGPRKKSVSRSVKAGLQFPVGRIGRYLKKGRYAQRVGTGAPVYLAAVLEYLAAEELELAANAANDNKKTRIVPRHLLLAILNDVELGKLLSGVTIAHGGVLPNINPVLLPKKVAQKASSGDSKESSPLRKSPSHQRRH

SEQ ID NO: 20048 - DNA, 652 bp, Zea mays
  misc_feature: Ceres CLONE 1387985-F
  misc_feature: Encodes the peptide sequence at SEQ ID NO. 20049
  misc_feature (625)..(625): n is a, c, t, g, unknown, or other
aagctggagctccccgcggtggcggccgctctagaatagtggatcccccgggctgcaggaattcgcacgagaccattacctagaacatcctaatcgaaaaacatttcctccgatccgtctccgatcatcgcatcttctgtacgccacactcggtctcaagtctcaagccaccgacgacatgaacgcggcgacatctgacccaaggactctcatcagtgcttacggaggcggacggccaactctactaccaacgaagacccgccgagctgcctatgctgcccagatctctctcatcctaatctcatactacccttcgctcgagcccgaaatgtcgatccttatctactacgactccgcgatgggcaaatatcctctaagatgagggaaccattgcgatgtcttactacgcgatcacataaaacatacccggcatcatctgaatgatcgagacctactgtcgctgcccttcttgcggctacgtggacgccaccgccgacatgatgatcagacggacccacgggcgcgtctcctcgtcgaagctcgtatgtctcccttatctgcagaactggcattaccctagctacgatctcgtggatctcgtctacgatctcggcgacgacttcgntaacgatcctcgtctatagtcccgacg

SEQ ID NO: 20049 - protein, 67 aa, Zea mays
  misc_feature: Ceres CLONE 1387985-F
  misc_feature (62)..(62): Xaa is any aa, unknown, or other
MIETYCRCPSCGYVDATADMMIRRTHGRVSSSKLVCLPYLQNWHYPSYDLVDLVYDLGDDFXNDPRL

SEQ ID NO: 20050 - DNA, 661 bp, Zea mays
  misc_feature: Ceres CLONE 1387987-F
  misc_feature: Encodes the peptide sequence at SEQ ID NO. 20051
aaagctggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtgctctaacgggaccgcaaggaggacctgcggtggtgcaagcaggcgtgcgagtggcagtacggaaaggacaccccgcgcaacagggaatgcgagagcgagtgccgcgagcggcaccagcaagctgacgcgggcgaggacggcgacagcggcgtggacgcctacgtctcccgctccggtaggggcgagtgccggcgtcagtgcctgcgccgccacgagggccagccgtgacagacccagcagtgcatgacgcggtgccgtcgccgcgtactggccgtcgacatggagcaagagtacggtcgcgtcagcgagagcgcgggcaagtgccgagagaagtgccagcgccacatcgc

SEQ ID NO: 20051 - protein, 34 aa, Zea mays
  misc_feature: Ceres CLONE 1387987-F
MGKGSVGASWWAFLLLAGVLLVVAATAGAEDGVL

SEQ ID NO: 20052 - DNA, 658 bp, Zea mays
  misc_feature: Ceres CLONE 1387988-F
  misc_feature: Translation starting site: 182
  misc_feature: SWISSPROT Homolog: EC 2.7.8.23 Carboxyvinyl-carboxyphosphonate phosphorylmutase
aaagctggagctccccgcggtggcggccgctctagaactagtggatcccccgggctgcaggaattcgcacgagaccattacctagaacatcctaatcgaaaatcgcctttccgatcccatccctctccagccaccttcctccgctcgccgtgcttctgcttcctccgccaccaccgccggcatggctgcgcgctgcccctacttcgccgacgaggagtcctcccgcggcatccgctcggtggagtccccggccgcggcgctccgccggatcctcgcgacgcctggtgcgcaccaggcgccctgctgctacgacgcgctcggagcgcgcctcgtcgagcgcgcgtggtttccgatcggcctcatgggcgttttctgtgtggctgccgcgcgacttgtcttgcctgatgttgccctcatttcctatggagaaatgaagatcaagggcgactcatcaatgaagctgttaccatcccagagattgccgatggagacaatggttacgcaaactctatgaatatcaagagaaccatattaggatatatcaatgctgcttgtgctggaattatgcttgaggatcaggcgtcacctagagcatgtggacatactgaacgaacgaacgtcatatcaagggcggaagctgtcatgcacatattagctg

SEQ ID NO: 20053 - DNA, 651 bp, Zea mays
  misc_feature: Ceres CLONE 1387993-F
  misc_feature: Encodes the peptide sequence at SEQ ID NO. 20054
  misc_feature (549)..(549): n is a, c, t, g, unknown, or other
aagctggagctccccgcggtggcggccgctctagaactagtggatcccccgggctgcaggaattcgcacgagaccattacctagaacatcctaatcgaaaactttttctatatcgcgatacgtccctccctacccagcgatctaggccgccgcctctcctactgcatctccctcgctctcgtcgccgcgttcggttcgcctcctccccgccccaacccgagccgaggagagcgcaggcctatccggagctgggatggcgcacgggaagcagcagcagtagcagccacagcaggcggcagcggcagccaccggcgtgcggaacacggtcaagcccttcgttaacgcagctgcctctggaatgctcgcgacctgcgtcatccagcctatcgacatgctataagtgcagatacgattgggggagtgctccgctgatcaggtcacaacacacatgcttgcacatgatggtgtacgatacttctacagaggattgtctgccggattgctgaggtcagtcacgaaacgactgctcgtactgcatcctttaaggtncaaactacccaactgttgaaaggatgaagcgaagccatgcctccaagtagaaagcttttatggcctgacggctgaagaatgtgggcttgtttggaaacccac

SEQ ID NO: 20054 - protein, 39 aa, Zea mays
  misc_feature: Ceres CLONE 1387993-F
  misc_feature (34)..(34): Xaa is any aa, unknown, or other
MLAHDGVRYFYRGLSAGLLRSVTKRLLVLHPLRXKLPNC

SEQ ID NO: 20055 - DNA, 648 bp, Zea mays
  misc_feature: Ceres CLONE 1388001-F
  misc_feature: Encodes the peptide sequence at SEQ ID NO. 20056
tggagctccccgcggtggcggccgctctagaactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaacttctaggaagatgatccgatctacggaaggctgtgcaaagagcattactttggagaggaacaacaaatcagacgatgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatgttccaacccggaaataggagcatcaaacataccaggaccaactttgccatgagagtcaacagtttcttgcgtcagctacgcactcatcctactcttaataagtttgttattaagttcgggctgcgcaggaagcac

SEQ ID NO: 20056 - protein, 133 aa, Zea mays
  misc_feature: Ceres CLONE 1388001-F
  misc_feature (38)..(85): Pfam Name: F-box Pfam Description: F-box domain
MAKQKEGVDKRTSRKMIRSTEGCAKSITLERNNKSDDVQLHDLPNDILGSILSRLTFRESSQMGLVSHTWRRLWRSCCRKLVFTSATMFQPGNRSIKHTRTNFAMRVNSFLRQLRTHPTLNKFVIKFGLRRKH

SEQ ID NO: 20057 - DNA, 742 bp, Zea mays
  misc_feature: Ceres CLONE 1388004-F
cccgctgtagctcaccgcggtggcggccgctcaatactagtggatcccccgggctgcaggaattcgcacgagaccattacctagaacatcctaatcgaaaaataatcaagcatcacagagatacgggtcttcgtactcgcctacctccgcggttgcaaacctttcccccttctcccaattccctccgtcggccgccgctccatcccgtacgacgacaccatgagggagtgcatttcgatccacatcggacaggacggcatccagggcggaaacgcgtgcagggagctgtactgacttgagcacgccatcccggctgacgatcatatgccccgccgcccacaccattggacggaaccgccccccgctcccccccccctcgcccccccgcaccccgccccacccgcccacgccccaccccgaccagcctggaacccgcaccccccccccgccgcgagcggccgtaccccgtccatcggcagccagctgacgccagcagtcgtcctccgggatagggtaccagacctcctccacccaacgccgacaccccggactggctacgcacccccgcccgacgcccgactttcgcccccccctccccggcccacttccccgcctggcaccaccctgccgattcatccgcccccctccccacacgacgtcacccacgccgtgggtccctcaccctactccccatgcccccctgacgatctctccctccgtcctccgacccagatcccacccc

SEQ ID NO: 20058 - DNA, 680 bp, Zea mays
  misc_feature: Ceres CLONE 1388006-F
  misc_feature: Translation starting site: 223
cccgctggagctccacgcggtggcggccgctctagactagtggatcccccgggctgcaggaattcgcacgagaccattacctagaacatcctaatcgaaaaacagtgcctctcgctcactgactgactactgtaataccagagatcgaacaacttggtcctgcagctcaagaagagagttttgtgcatttgggggccgggggcaagagagagagagagagccatggcggcggaccagcagccgcagctgcaggaggagatgaacgacgctgccggcggcggcctcacgctgcctcccagggttccccttccccccgaccgacttcgagattgtcagcttctacctcaccaccaaggtgcttaatttgtgtcttccctgcagcgagagaacggaggccgacccacccccgactcggcctgggcccctcccgacctaggcccggacgcgccacccagacaggcactgtccccctcgcgactcaccgccacgtacacccccggccccccccggccgatcccgccccagtgagggagcgctactggctgtgcggccttgctcaagacaggggaccgcctaaccatctcccccctccgcgctgccgtcgcccgcgctctccccgaccttagtcggctccccacttcaactgtcactccgcacgccacccacgccccccgacgctc

SEQ ID NO: 20059 - DNA, 645 bp, Zea mays
  misc_feature: Ceres CLONE 1388009-F
  misc_feature: Translation starting site: 220
aaagctggagctccccgcggtggcggccgctctagaactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaaccccactgtcatcgatgacgtgaggactggtacctaccgacagatcttgcaatgtgcccaccccatcctcgggaaggaggatgcagccaacaactttgcccgtggtcactacaccatggctaaggagattgctcaaccatgcctcggtcccctctggaacctcgccgacccacagcaatggtctacaaggctctaccagcactcaaagctgag

SEQ ID NO: 20060 - DNA, 660 bp, Zea mays
  misc_feature: Ceres CLONE 1388013-F
  misc_feature: Encodes the peptide sequence at SEQ ID NO. 20061
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (58)..(58): n is a, c, t, g, unknown, or other
aaagctggagctcccctcggtggnggnngcttttttacttgtggattcggcggggtgnaggtttccccacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggcagacgttacccctccaatgggcgaatgcagaacggagtacaggggcctgcccgacgccaatggcgaggacgcggggacggtgccggccgcgctccgcaaggtgtccatagtcccgctcgttttcctcatcttctacgaggtctccggcgggccgttcggcatcgaggacagcgtgggcgcagcggggccgctcctcgccatcgtcggcttccttgtcctccccgtcatctggagcatcccggaggcgctgattaccgcggagctgggcaccatgttcccggagaacggcgggtacgtcgtgtgggtcgcctcggcgctcggcccctactggggattccagcaagggtgggtgaagtggctcagtggcgtcatcgacaatgccctgtaccccgtcctcttcctggactacctcaagtccgccgtgcctgccctgggc

SEQ ID NO: 20061 - protein, 140 aa, Zea mays
  misc_feature: Ceres CLONE 1388013-F
MGECRTEYRGLPDANGEDAGTVPAALRKVSIVPLVFLIFYEVSGGPFGIEDSVGAAGPLLAIVGFLVLPVIWSIPEALITAELGTMFPENGGYVVWVASALGPYWGFQQGWVKWLSGVIDNALYPVLFLDYLKSAVPALG

SEQ ID NO: 20062 - DNA, 701 bp, Zea mays
  misc_feature: Ceres CLONE 1388014-F
  misc_feature: Encodes the peptide sequence at SEQ ID NO. 20063
ccagctggagctcaccgcggtggcggccgctcttcaactagtggatcccccgggctgcaggatttcgcacgagaccattacctagaacatcctaatcgaaaagaaggtaccaagttctgcggccacggcttcctcgatcccgagaggtttgaactacgagcggatgcggatgccatcccgctcagctacagccagctcgacaccatcctgaggatgcttcggatcccgtgggtgtctaacaacctcaatcaagtcggcgattcgctccggacatgcggcggcggaacctgcataggttagtggatgcgacatattcgagcggtgcgccggtctactgtgcccgccttcccgccccgggcccgtctctctcagccccccccccatcaccccctcccccccacgctaaggctaagccacccccccacccacgccgggggccgcgcatgcccccccccccccccccgctgcgcgcgcacggccgcccccgcgtcgacccgcgcggcggcccccccgccgcgttggtccgcaatccgcgttcgcatcctcccccccgccccgcccccccccggccctcacctctcgctcccccccgccccagcccccacaacccacacgccgcgcccccatgacgaagcctcccccccgcccccccctccactatatgggccgcgccgctcatcccctcatcacctcccacccca

SEQ ID NO: 20063 - protein, 118 aa, Zea mays
  misc_feature: Ceres CLONE 1388014-F
MRRRNLHRLVDATYSSGAPVYCARLPAPGPSLSAPPPSPPPPHAKAKPPPHPRRGPRMPPPPPPLRAHGRPRVDPRGGPPAALVRNPRSHPPPRPAPPRPSPLAPPRPSPHNPHAAPP

SEQ ID NO: 20064 - DNA, 712 bp, Zea mays
  misc_feature: Ceres CLONE 1388015-F
  misc_feature: Encodes the peptide sequence at SEQ ID NO. 20065
  misc_feature (236)..(236): n is a, c, t, g, unknown, or other
  misc_feature (526)..(526): n is a, c, t, g, unknown, or other
cccagctggagctcaccgcggtggcggccgctctagaactagtggatcccccgggctgcaggaattcgcacgagaccattacctagaacatcctaatcgaaaaatcccatcccctcaggcctcagtcgtcagtccctcacacactcactatacactgctctgctgcagcaagaaggaagaagctagcgcctccctagctctcgttgtcagcaatggccaccaccgccgcgtccagnctcctcaagtcctccttcgcgggctcccggctcccttcggccacgcgcaccaccaccccgtcgcacgtggcccgcggccaccccgcgcgccggcgttgttctaattcgccggtccatctccgcctcccccagccggccccatgaggtgagggcactgcgcgcgccccccccctcgaggaagccctccgcgtccccccccgatccaaccgacccaccagggatggacgtcctcccctcccccccttgccctgcagctggcgctccgtggcccccccccccccaacaacacnataatttgatcaccgcccatcccacttctacaggccctccccattgcagtggggcccaatacacatcagaccgtaacggccggacgcccgacgacagtccagagtctaacatcaccccaccatccgtctttccaaccccctctcacccccccccgcacgcatactgccccccctcccaccccctca

SEQ ID NO: 20065 - protein, 85 aa, Zea mays
  misc_feature: Ceres CLONE 1388015-F
  misc_feature (24)..(24): Xaa is any aa, unknown, or other
MDVLPSPPCPAAGAPWPPPPQQHXNLITAHPTSTGPPHCSGAQYTSDRNGRTPDDSPESNITPPSVFPTPSHPPPHAYCPPSHPL

SEQ ID NO: 20066 - DNA, 600 bp, Zea mays
  misc_feature: Ceres CLONE 1388019-F
  misc_feature (269)..(269): n is a, c, t, g, unknown, or other
  misc_feature (271)..(271): n is a, c, t, g, unknown, or other
  misc_feature (272)..(272): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (283)..(283): n is a, c, t, g, unknown, or other
  misc_feature (284)..(284): n is a, c, t, g, unknown, or other
  misc_feature (286)..(286): n is a, c, t, g, unknown, or other
  misc_feature (290)..(290): n is a, c, t, g, unknown, or other
  misc_feature (291)..(291): n is a, c, t, g, unknown, or other
  misc_feature (294)..(294): n is a, c, t, g, unknown, or other
  misc_feature (295)..(295): n is a, c, t, g, unknown, or other
  misc_feature (298)..(298): n is a, c, t, g, unknown, or other
  misc_feature (299)..(299): n is a, c, t, g, unknown, or other
  misc_feature (302)..(302): n is a, c, t, g, unknown, or other
  misc_feature (303)..(303): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (326)..(326): n is a, c, t, g, unknown, or other
  misc_feature (331)..(331): n is a, c, t, g, unknown, or other
  misc_feature (337)..(337): n is a, c, t, g, unknown, or other
  misc_feature (341)..(341): n is a, c, t, g, unknown, or other
  misc_feature (346)..(346): n is a, c, t, g, unknown, or other
  misc_feature (349)..(349): n is a, c, t, g, unknown, or other
  misc_feature (350)..(350): n is a, c, t, g, unknown, or other
  misc_feature (361)..(361): n is a, c, t, g, unknown, or other
caagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagngnntnnnngnnnanntngggnnggnnggnntgnnggnnnggnnnggggggtgggaantttantggctngagnatggnatnnagcctgatggntaagtggttggagataagagggggggaaatgaggatgatgggtttaggagctttttgaggaagagtggtggtgggaagaaggttccccgcggaatgcttggggacccacaccccactggcgaccgacggtgtgcgtactggcacgtaccccccacctcttcccccctgagcccttcattcgtcgcacaggcggacgcccgctacacatttcgcccccgccccccaccccactccccgcc

SEQ ID NO: 20067 - DNA, 730 bp, Zea mays
  misc_feature: Ceres CLONE 1388021-F
  misc_feature (730)..(730): n is a, c, t, g, unknown, or other
cccgctggagctcaccgcggtggcggccgctctagactagtggatcccccgggctgcaggaattcgcacgagaccattacctagaacatcctaatcgaaaaattttgatttccccacctctctaaaaccctcgctcttgcccgctgttttacacctaaaagaaaggtcctcgccgtcgaggcgccggctcccatctcccgcgccgtcgacgacgaggacacaccagacgcctcgctgatggccttggctcgcctcggacggactcttgccgaccgcctcccacgttctatctaccgcccacccgggcctcagagactaaccatgcctccgtgtcccgacccctccctccggccccacccggtggatggcgcaccacgccctgccaggcttgtctcacctgcctgtgttccccccccgccgactctccgcggggtgcgcggtccgccccccctcgggagggtcccgccttctcctctatcctacgggaacagggagggggggcggggggagccccccccgcctccccacgtgccggcgtcgtagacccctcacgcttccctcccccaccgccccccgtcgcgcccgcacccccgtcgcccgccgggcgcgcgcgccaggccctcccgcacctctacgacgcgcctttctgccgtacaccgcgcccgaaacacatcacggagctctcgcccgccccccctccgccggcgctcctgcccgcccggccaacccn

SEQ ID NO: 20068 - DNA, 655 bp, Zea mays
  misc_feature: Ceres CLONE 1388023-F
  misc_feature: Encodes the peptide sequence at SEQ ID NO. 20069
cccagctggagctcaccgcggtggcggccgctcttgaactagtggatcccccgggctgcaggaattcgcacgagaccattacctagaacatcctaatcgaaaaccgaatctcacacccaaaagtttcccactgccctcgtcccccattcaattcttccaactccgccgcttcgcctcgttccgtccgccgccctcatggcgtccgccgccgccacgaccacctccgcccccgcccagaacatcaatccccttagtatcaacatcaagctccccccatggctcagcgggctgcgctgccccttcaccttcgtctgcccgcccccgcccccgcctccgccgccgccgccgcctcctcccccgctgccacctacggaacccggggtcccacggtcgcgcaggttaccaagcctgcggctgaccacggagtacgatagcgaagagggcgtgtctgcgacaccgacgcgcgaaagcttgggagcgatccccccaactgagactgccgttgcggggcgacccgcaggcgcccgctgctgtgcccctcttcggcatccccaccaccccccccacactcccccctcccccacatcggtcacagcctcgagtgaggctccgccgcacctccgcctccgcccccccccgcctcccgccacctcca

SEQ ID NO: 20069 - protein, 52 aa, Zea mays
  misc_feature: Ceres CLONE 1388023-F
MAQRAALPLHLRLPAPAPASAAAAASSPAATYGTRGPTVAQVTKPAADHGVR

SEQ ID NO: 20070 - DNA, 653 bp, Zea mays
  misc_feature: Ceres CLONE 1388024-F
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaaatcgcacatattattgagaccaactagcaacatagaaagcacaatattgtaccaataatggcagccaaaatattttgcctcattatgctccttggtctttctgcaagtgctgctacggcgagcattttcccgcaatgctcacaagctcctatagcttcccttcttcccccatacctctcaccagcgatgtcttcagtatgtgaaaatccaattcttctaccctacaggatccaacaggcaatcgcagcaggcatcttacctttatcacccttgttcctccaacaatcatcagccctattacaacagttacctttggtgcatttattgggacaaaacatcagggcacaacaactaccacaactcgtgctagcaaaccttgctgcctactctcagcaacagcagttacctttgggggcatttgtgggcccaaaacattcgggacaacaaactataacaactcgtgctagcaaaccttgggtggcaactcccagaaaccaacagtttttggcctttcaacacactaccctgcattggaactcgctggcctaatn

SEQ ID NO: 20071 - DNA, 750 bp, Zea mays
  misc_feature: Ceres CLONE 1388025-F
  misc_feature (33)..(33): n is a, c, t, g, unknown, or other
cccgctgtaggctcacgcggtggcggccgctcnatcatagtggatcccccgggctgcaggatttcccacgagaccattacctagaacatcctaatcgaaaactccactcctactcctctctccctccacatttcctctcccgataagagtgaggcctcggctaagcttgagcttcccctccctcccctccaggggggcagatcccctccatcctcggccaaaatttgggcggggggttccgatgcggtcggattacacaccaagccgacgtatagggggagaggctcgccggccggcgtgttgaaaacaattaagacctctcgtttgtgagatgaggagggaggtgcgacggggggataaaaatctttttttaaatcttatgctccctcgcgccgcgggcgggggcgtccccccctgcgcgcgccctcatgtaggatcagcgccccccccccctccgccccccgccctgcctgggggcagccgctcgtctgctatggttcgcgcggccaccaccctcgcgcccggctcgccgggcgccggcgcccccaccccctcccgccgccgtcggtcgcccccccacggcagactggcgcgtgtcggcagccaggagtccgtccggcgagcgctgggacgatcgcgcgtcaaccccccatcctgcatccacacagccacgcccccacgcactccgcggcttggcccgcgagaccgcgaagcggcccccccgtggggcaccacgtgttcgcgtctgtt

SEQ ID NO: 20072 - DNA, 662 bp, Zea mays
  misc_feature: Ceres CLONE 1388029-F
caagctggagctccccgcggtggcggccgctctatcactagtggatcccccgggctgcaggaattcgcacgagaccattacctagaacatcctaatcgaaaaattctcgtctcatctgtggaagaggagagaagactgaagagaagggaagacgtgcccgtcgcggggaccgcgctcgcagggacgtagcaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctgctgctgtcgccgctggcgctgacgcgccccgcggcggggcttgccgtgtgtcctcccccgctccccgccctcccgcctcgcgctcccccccgcccgtccccccccccgcccccccccgcccgggggtcctctccccccccgctcccgccgcgttcgtgcctcttcccggccttcccccgccctctccgccgcccccgcccccccccccttccctccctcccccgctccccccccccccccccccccctcctctcgccctccctcccccctc

SEQ ID NO: 20073 - DNA, 664 bp, Zea mays
  misc_feature: Ceres CLONE 1388031-F
  misc_feature: Translation starting site: 185
  misc_feature: Pfam Name: Methyltransf_3 Pfam Description: O-methyltransferase
  misc_feature: SWISSPROT Homolog: EC 2.1.1.104 Caffeoyl-CoA O-methyltransferase
  misc_feature (290)..(290): n is a, c, t, g, unknown, or other
  misc_feature (476)..(476): n is a, c, t, g, unknown, or other
aaagctggagctccccgcggtggcggccgctctagaactagtggatcccccgggctgcaggaattcgcacgagaccattacctagaacatcctaatcgaaaaaacgaagccacaagcagcgccgcgagccacagctagcaccaccaccttgcaccgcacccgcaccgagacgaacagatcgaccatggctgccggcggcgacgacaccaccatcgcgcaggtccacagcggcatcgacagcagcaacaagacgctgctcaagagcgaggccctctacaagtacgtgctgngacacgtcggtgctgccgcacgagccggagagcatgcgtgagctgcggctggtgaccgacaagcacgagtgggggttcatgcagtcgtccccggacgaggcgtcgctgctgcggatgctgatcaagctgagcggcgcgcgcggacgctggagagttgggcgtgttcacgggctactcgctgctgcnggacggctctggcgctgcccgccgacggcaaggtcatcgcattcgacgtgagccgcgagtactacgacatcggccgccccttcatcgagcgcgcccggggtggcgggcaagtggacttttccgggagggcccggcgctggagcagctggacgagctcctcgccgacccggccacccacggcgccttcg

SEQ ID NO: 20074 - DNA, 688 bp, Zea mays
  misc_feature: Ceres CLONE 1388038-F
  misc_feature: Encodes the peptide sequence at SEQ ID NO. 20075
cccgctggagctcaccgcggtggcggccgctctagtactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagagtttccgcaaggcgcagtgccccatcgttgagccgccttacaaactccctcatgatgcacggggcgaacaaccggcaagaagggcttgggttgtccccctcatccagcatcccccggcagatcattcacctgggtacaccgagccccccccactcccaggtccgtcggtcggaggggacccaccaaccagagccccccccacggtggcatgcccccccgtcctccgcctcccctcgatccttcggacataatttctagcgaggggggaccccgctccccccctgccgggggggcggagcaccgcgcaccactcccacttcgggaggccgct

SEQ ID NO: 20075 - protein, 137 aa, Zea mays
  misc_feature: Ceres CLONE 1388038-F
MAEVEQQQDTPKLFNRWTFDDVQVNDISLNDYLAVNATKHAMYLPHTAGRYSKKSFRKAQCPIVEPPYKLPHDARGEQPARRAWVVPLIQHPPADHSPGYTEPPPLPGPSVGGDPPTRAPPTVACPPVLRLPSILRT

SEQ ID NO: 20076 - DNA, 775 bp, Zea mays
  misc_feature: Ceres CLONE 1388039-F
ccgagtggagctccccgcggtggcggccgctcatacatagtggatcccccgggctgcaggatttcccacgagaccattacctagaacatcctaatcgaaaaagagactcaccagtcaccaccccaggccagccgccacgtttagtcgggataaacaaacacgggcgcacaatcggaactcgctgcactgcttgcaatccaacgagccaatcattcaaatcctctccggaaccgcgttgagtatggccccgtccattggacccagggtgaccccccccaccccaacaaactcccacgtgaaccccccccgcgctggtgtctcgcccgcccaccttgtggacccccccccaacgccatgggtaggccccgcgtagtaaaccccccacacacgcagccccccccccagactgcagcatctcgaggagaagccaacgaagccgcacgtgcggcgccagccgcgcactgcccggacaccaaccccccgccacaccagctaccccccgcccaccccgtggtcctctcctcgtatccggtgatccccccgctcccccccgccttacctccttccacctgtcttacagtccgcctcactccatatcagtgccgtgacggaacagcaacaaatcaccacaccaaccaccgcccctcagctctcccaccctttcctcccttctctccccgccacacctcagaacccactccgccgctcatcgccccttcgctccgcctccttcctcgctccttggccatcttcttattcccaccacctcccaccg

SEQ ID NO: 20077 - DNA, 748 bp, Zea mays
  misc_feature: Ceres CLONE 1388042-F
  misc_feature (16)..(16): n is a, c, t, g, unknown, or other
  misc_feature (17)..(17): n is a, c, t, g, unknown, or other
  misc_feature (21)..(21): n is a, c, t, g, unknown, or other
  misc_feature (748)..(748): n is a, c, t, g, unknown, or other
gacagcttggactccnngcgntggcggccgctcatgcctagtggatcccccgggctgcaggattcccacgagaccattacctagaacatcctaatcgaaaaatttttcgaccgcctttgcccccagtccccgatccgaagttgtgcctcgtaccatttcgatccaatggcgccgacgtctgtgctgttgtggggtcgggggcgcgcttcgtggtggggggacgtgcgggggggtgcggtggggggcccccccggcagcccggttgtgcgccctcctgcggcctagtgggtttgtttgttgtggtgggggtcttgggtcgtgctttggtagtggcgttgggccgcgggcggggggcgggggtgggggttttttttttgcgcagggcggccgcgcccgtggggggcctcgccctcgcggcgcggcatctgttggaggggggggcggtcggaggcggcgccggcccgctcgtgcggccgcgagttgatggtggggcgggtggtcggccacggctctctgtcgcgtctacgtcgcggtttgttgtgccctgtctgcgggagacgcggtaccggcaggggcgcttttgcgggcgtcttggtcctgcggcgtggtggttggctgcttggttgcagcggcgtcgcgattgtgttgcggcggcctgtccgccgatgcgcccccgcgccggcgctgctcgcccggcctgagatccctcgctacctgcctttgagtgtcgcgccctgcgcccgctctn

SEQ ID NO: 20078 - DNA, 713 bp, Zea mays
  misc_feature: Ceres CLONE 1388047-F
  misc_feature (322)..(322): n is a, c, t, g, unknown, or other
  misc_feature (354)..(354): n is a, c, t, g, unknown, or other
ccagctggagctcaccgcggtggcggccgctctatcactagtggatcccccgggctgcaggaattcgcacgagaccattacctagaacatcctaatcgaaaaatgctcttcgcccctcgcgcttaccgctgccgcgcctcccgacttgccgcctccgcctagctccgggctctccaatggcctccatgctcgccatcctcaggccctccgcgccggccccgctcgcggggcgccggggcagggcggccgcgccgcgcaccgggggggcgcccccggcgccccggcccggcgcggcggggcgcggcggggcggcgggcgcggngggccgcgcccgcgcggcggcgcggccgggcnccggttttttttccccccccccccggggggccgcctccctctctcctctccctgcctccccccggccggcccggcgtcggcctcccgcccctcgctccgcccccgccccctcccccttcctcctctccgctctgtgcttcggtgccccccccccctccgtcgccggtctctccttccttgcctctcccccccttcggcgtccccccccctcccgcgtctcctcgcccctcccgctccccccccccccctcgtcttctctccccctccctccctcccccctgtcttcttcgcgtcgtgtgccctgtgccgtcgcggtgttggcccggcggcttgtcgcgccccgcgctctccccccccag

SEQ ID NO: 20079 - DNA, 658 bp, Zea mays
  misc_feature: Ceres CLONE 1388051-F
  misc_feature: Encodes the peptide sequence at SEQ ID NO. 20080
  misc_feature (611)..(611): n is a, c, t, g, unknown, or other
  misc_feature (616)..(616): n is a, c, t, g, unknown, or other
aaagctggagctccccgcggtggcggccgctctatcactagtggatcccccgggctgcaggaattcgcacgagaccattacctagaacatcctaatcgaaaaatccctttccccaacccccgaagccgagccagcgaaccaccccgcccgctgccgcaagcaagcaagcagccaagcagtgtgaactgaccgaccgttccgtccagcccaccatggaggcgccgccggtaccggagcccatggatctggacgcgccccctcccgccgctgccgacgccgcagccgcggcgccggttccccctgccgtcagcgacaagaagaaggaaggggaagggggagacactgttacgggccacatcatctccaccaccatcggtgggaagaacggcgagccgaagcggaccatcagttacatggcagaacgtgtcgtgggtacgggctcatttgggatcgtcttccaggctaagtgtttggagactggagagaccttcgccattaagaaggtgctgcaggatcggcgttacaagaaccgggagctgcaacttatgcgtgccatggagcaccccaacgtcatctgcctgaagcactgcttcttctcaacacgagcaggnacgangtgtttctaaacttgtcatggaatttgtccccgagaccctgt

SEQ ID NO: 20080 - protein, 137 aa, Zea mays
  misc_feature: Ceres CLONE 1388051-F
  misc_feature: SWISSPROT Homolog: EC 2.7.11.1 Non-specific serine/threonine protein kinase
  misc_feature (135)..(135): Xaa is any aa, unknown, or other
MEAPPVPEPMDLDAPPPAAADAAAAAPVPPAVSDKKKEGEGGDTVTGHIISTTIGGKNGEPKRTISYMAERVVGTGSFGIVFQAKCLETGETFAIKKVLQDRRYKNRELQLMRAMEHPNVICLKHCFFSTRAGTXCF

SEQ ID NO: 20081 - DNA, 669 bp, Zea mays
  misc_feature: Ceres CLONE 1388055-F
  misc_feature (215)..(215): n is a, c, t, g, unknown, or other
  misc_feature (216)..(216): n is a, c, t, g, unknown, or other
  misc_feature (232)..(232): n is a, c, t, g, unknown, or other
  misc_feature (233)..(233): n is a, c, t, g, unknown, or other
  misc_feature (474)..(474): n is a, c, t, g, unknown, or other
  misc_feature (475)..(475): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (641)..(641): n is a, c, t, g, unknown, or other
  misc_feature (642)..(642): n is a, c, t, g, unknown, or other
aagctggagctccccgcggtggcggccgctctagaactagtggatcccccgggctgcaggaattcgcacgagaccattacctagaacatcctaatcgaaaaactcgcctcgacgcgcctctgaaagttcggagccgccggcccgtccgcctccctctccgcctcccgtccccaaggccaatagttttcaagtggcaatggcggaccaggcttaannccaacccactttgtcnnctttcataaaagctcggtggcagttccacctgcgctcgatcatctctgaagtgaacgggcccgtaactattgccatcttgctcatcttatgaaaggggaatttggccccagggaaattacctttggaccccaaagccccttttgggggggcccttttcaaggttggttaggggggggttcaatgggcccacggggtgggaaaacccccccccttggggggaaaagggccccccctcttttnnaaaannnnnnnnnaagatcagacgcgtggagggnnnnaccggagggggggggggggttcccggtggggtgttaaaaaagagggccccggcgcccccgcccaagggggggggggaaaaaatgtttttttttttcacaaacccagcggagagaggggggttttttttnncgggcgggggggggggtttataaaaag

SEQ ID NO: 20082 - DNA, 668 bp, Zea mays
  misc_feature: Ceres CLONE 1388062-F
  misc_feature (363)..(363): n is a, c, t, g, unknown, or other
  misc_feature (372)..(372): n is a, c, t, g, unknown, or other
  misc_feature (421)..(421): n is a, c, t, g, unknown, or other
  misc_feature (438)..(438): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
aaagctggagctccccgcggtggcggccgctctataactagtggatcccccgggctgcaggaattcgcacgagaccattacctagaacatcctaatcgaaaactcctgaacacaccacccctcgtctccccacggaggccgtcctctcctctcctctgcgtccgccactgcccaccgctcgcccgcgcgcgctccattacctcggcgggcgatggccgacctatccaacaccggctccacctaacacgagcagcgcccccgcctaggcggcagctggctggtcggtcgtcgagcagctagcggcggcagcgcccggagggaggccgtctcactctcctcgtcggggcggcaggagatggaggncatcgtggncgtccgcgcgccgccgcgtggccgtgcctggggcgccctcgagaagcgncgcgcgccgcttgctgncgcagagtcccgacgnnngagctcgcggtcgcggggaaacagccgcgaaggttggtgctgctggccccaatacgggaaggcccgggatccggccttcggtgggcccgcaatttggaggaaaaggaaaggcccctaacccggggagaccctccccaaatcacgaaaaaaccccggagaggtcccgcctaattggggggcgccgggggtttattttggggaaaagggggtca

SEQ ID NO: 20083 - DNA, 668 bp, Zea mays
  misc_feature: Ceres CLONE 1388070-F
  misc_feature: Translation starting site: 160
gctcttaactagtggatcccccgggctgcaggaattcgcacgagaccattacctagaacatcctaatcgaaaaacaacaccaagaagcaagaaaactagaaaaggctcctcccgaccgcaacgcccctcatctccctcgaccccgacatccccgacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaagggcaagaagagcgtggagacctacaagatctacatcttcaaaggtgctgaagaaggtgcaccccgacatcggattatccttcaagggcattgtccatcatgaactccttcataaacgactttttttaaaaattggcccggggaggcccccaagttgggcccggaccaacaaaaacccccccttcccggccccgggaaaaacaaaaccccggggcggcaaatccccccccgggaaatttcccaaaaaaccccctttcccggggaaacacagggggccgccccaatttttccccccaaaatgggggggggggtggggggcccccgggtttttttaaaaaaaaggttttttct

SEQ ID NO: 20084 - DNA, 656 bp, Zea mays
  misc_feature: Ceres CLONE 1388076-F
  misc_feature: Encodes the peptide sequence at SEQ ID NO. 20085
aaagctggagctccccgcggtggcggccgctctagaactagtggatcccccgggctgcaggaattcgcacgagaccattacctagaacatcctaatcgaaaagcaatcaactctagtctctagccacaactctaagtacgagtaactccggagtccggatggctgcagcgatggacgtcgacgaagccggcggcgaggagaggcgaccgtcagagaatgagctcttccgcgccgctgagtccggcgacgcctccgcgttcgcctccctcgcccccgccgacctctccctgcgcaacgaggacggccgctccctcctccacgtcgccgccgctgccgggtatccccaggtggcgctcgcgcttgcccagtgcggtgttgacgccgcgcctaccgtgctgaatgcgcaggaggaggaggggtggccgccgatccactccgccgcgagctccggaaactctcagatcgtcgacatcctgcttgagcgaggtgctgatgttaacctggttactgatggcggtcgaactgctcttcattatgctgcgagtagagggaggcttaacatagctgagcaagtactaccctatggtgctaatgtcaactagagagacaagtttgtctgcacaactttgcatatagctgcaagtactgtaaacgcg

SEQ ID NO: 20085 - protein, 147 aa, Zea mays
  misc_feature: Ceres CLONE 1388076-F
  misc_feature (86)..(118): Pfam Name: Ank Pfam Description: Ankyrin repeat
  misc_feature: SWISSPROT Homolog: EC 2.4.2.30 NAD(+) ADP-ribosyltransferase
MAAAMDVDEAGGEERRPSENELFRAAESGDASAFASLAPADLSLRNEDGRSLLHVAAAAGYPQVALALAQCGVDAAPTVLNAQEEEGWPPIHSAASSGNSQIVDILLERGADVNLVTDGGRTALHYAASRGRLNIAEQVLPYGANVN

SEQ ID NO: 20086 - DNA, 658 bp, Zea mays
  misc_feature: Ceres CLONE 1388086-F
  misc_feature: Encodes the peptide sequence at SEQ ID NO. 20087
  misc_feature (354)..(354): n is a, c, t, g, unknown, or other
  misc_feature (356)..(356): n is a, c, t, g, unknown, or other
  misc_feature (455)..(455): n is a, c, t, g, unknown, or other
  misc_feature (510)..(510): n is a, c, t, g, unknown, or other
  misc_feature (511)..(511): n is a, c, t, g, unknown, or other
  misc_feature (543)..(543): n is a, c, t, g, unknown, or other
  misc_feature (621)..(621): n is a, c, t, g, unknown, or other
  misc_feature (622)..(622): n is a, c, t, g, unknown, or other
aaagctggagctccccgcggtggcggccgctctagaactagtggatcccccgggctgcaggaattcgcacgagaccattacctagaacatcctaatcgaaaactaaatcctcggttcccaaatggcgacgccgccgactgcgctgctgttgctcctcgcggcggcagcggcattccacggcgcgacggcgaagacgacgatcgagccgtgctctggcgcggacgcgtgcccggctcttctgggctacaagctctacgcggacatgaaggtgtccgaggtggcggcgctcttcggcgccgacccggcagcggtactggctgccaacgcgctcgacttcgcctctccaggcgccgncnaccgcatcctccccgcgcgaacacccctccgcgtgcccacccgctgcgcctgcgcccgacgcgtccgcaagtccgtcgccatccgctacgccgcccggncttccgacacgctcggctccatctccgaggtcgtcttcgccggcctcccctcggnncgacagatccgcaccgccaacgggctcgccgncgaggaccccgacgcgccgctcaccccgggccaggagctcgtcatcccgctcccctgcgtctgctttcactcaccganncacacctccccggtgtgtaccctctctatgtcgtgg

SEQ ID NO: 20087 - protein, 179 aa, Zea mays
  misc_feature: Ceres CLONE 1388086-F
  misc_feature (78)..(78): Xaa is any aa, unknown, or other
  misc_feature (79)..(79): Xaa is any aa, unknown, or other
  misc_feature (112)..(112): Xaa is any aa, unknown, or other
  misc_feature (130)..(130): Xaa is any aa, unknown, or other
  misc_feature (141)..(141): Xaa is any aa, unknown, or other
  misc_feature (167)..(167): Xaa is any aa, unknown, or other
MATPPTALLLLLAAAAAFHGATAKTTIEPCSGADACPALLGYKLYADMKVSEVAALFGADPAAVLAANALDFASPGAXXRILPARTPLRVPTRCACARRVRKSVAIRYAARXSDTLGSISEVVFAGLPSXRQIRTANGLAXEDPDAPLTPGQELVIPLPCVCFHSPXHTSPVCTLSMSW

SEQ ID NO: 20088 - DNA, 743 bp, Zea mays
  misc_feature: Ceres CLONE 1388088-F
  misc_feature: Encodes the peptide sequence at SEQ ID NO. 20089
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
gaggggcccccnnncnccnnnnncnccccgcaccccnnnccccacacttattcaacagctggactccccgcggtggcggccgctctataatagtggatcccccgggctgcaggaattcgcacgagaccattacctagaacatcctaatcgaaaaacaaattagagctaaaatggaaaccatagtccacaagtcgatgatcgccggagtacagagcgttatgccggtggaaatgacgcaacaccgtgaagtacgttccatatccgtcggagatcccgtcggagcaggaatattcaggagaacactaaacatagttacgtactacaagcaatccggtgatagtggtgagagagggtggttagtcgccggttggataaaggagtcgttagggagagccttgaccgagcagcctttgctttgtggtagactgcggcggaggaggacggtgacgggagaggaagatggcctggaggtggtgaccaacgatagtggcgctaggctggcggaggctaggttcccggcgagtttgccggagttttttgaaatggtggagagaccaaaaaacctagctgaagcacagaatggtctcctgcagagacattggatgaaagcggatcctccggtttcctccattgggtctatgtttcagggggacttaattctcggaaggggggcggaatacctccagttcgggacaagcctggcaggcatccctcaataaggctgactctccctccctctggac

SEQ ID NO: 20089 - protein, 182 aa, Zea mays
  misc_feature: Ceres CLONE 1388088-F
METIVHKSMIAGVQSVMPVEMTQHREVRSISVGDPVGAGIFRRTLNIVTYYKQSGDSGERGWLVAGWIKESLGRALTEQPLLCGRLRRRRTVTGEEDGLEVVTNDSGARLAEARFPASLPEFFEMVERPKNLAEAQNGLLQRHWMKADPPVSSIGSMFQGDLILGRGAEYLQFGTSLAGIPQ

SEQ ID NO: 20090 - DNA, 662 bp, Zea mays
  misc_feature: Ceres CLONE 1388090-F
  misc_feature: Encodes the peptide sequence at SEQ ID NO. 20091
atagctggagctccccgcggtggcggccgctctagaactagtggatcccccgggctgcaggaattcgcacgagaccattacctagaacatcctaatcgaaaaaccaccaccaccaccaccaatctctgcgtttttcgtctgcggcggcggcggcagcagcggaggaggtagacgagatgctgtccgccgacgtccccccgaaccagaccatctacctcaacaacctcaatgagaaggtcaagaaagaagagttgaagagatcgctttatgccctgtgctcgcagtatggaaggatcctggatgtggtggctctgaaaacacagaaactgagagggcaggcatgggtggtgtttagcgagattacagctgctaccaatgctttccgtggattgcaagactttgatttctacggcaaaaaaatgcgagtacaatatgcaaaaacaaaatcagactgtattgcaaaagaagatggtacttatgcacctaacgagaagaggaagaagcaagaggagaaagctgctgagaaaaaacgacgagcagaagaggcacagcaagctggtcccaatgctgctgctgctcaaagcagtggaactggctatcaagcgtctcgtctggggcaggcttcgcaggagccacctggctctcagacaacatcctcatca

SEQ ID NO: 20091 - protein, 162 aa, Zea mays
  misc_feature: Ceres CLONE 1388090-F
  misc_feature (12)..(84): Pfam Name: RRM_1 Pfam Description: RNA recognition motif. (a.k.a. RRM, RBD, or RNP domain)
MLSADVPPNQTIYLNNLNEKVKKEELKRSLYALCSQYGRILDVVALKTQKLRGQAWVVFSEITAATNAFRGLQDFDFYGKKMRVQYAKTKSDCIAKEDGTYAPNEKRKKQEEKAAEKKRRAEEAQQAGPNAAAAQSSGTGYQASRLGQASQEPPGSQTTSSS

SEQ ID NO: 20092 - DNA, 667 bp, Zea mays
  misc_feature: Ceres CLONE 1388092-F
  misc_feature: Encodes the peptide sequence at SEQ ID NO. 20093
  misc_feature (642)..(642): n is a, c, t, g, unknown, or other
aaagctggagctccccgcggtggcggccgctctagaactagtggatcccccgggctgcaggaattcgcacgagaccattacctagaacatcataatcgaaaaacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggtccttgctcaggggctgatcgctgagggtgttaaggttgtggcagctggtgctaatcctggntcagatactcgtggtatcgagaaaa

SEQ ID NO: 20093 - protein, 156 aa, Zea mays
  misc_feature: Ceres CLONE 1388092-F
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPGSDTRGIEK

SEQ ID NO: 20094 - DNA, 657 bp, Zea mays
  misc_feature: Ceres CLONE 1388096-F
  misc_feature: Encodes the peptide sequence at SEQ ID NO. 20095
  misc_feature (584)..(584): n is a, c, t, g, unknown, or other
aaagctggagctccccgcggtggcggccgctctagaactagtggatcccccgggctgcaggaattcgcacgagaccattacctagaacatcctaatcgaaaagcaccaccaccgtcactcaacacagcacaggcagctcgagagagagagagaaagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgccatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacnaggaccacggcggcgtgcacgacggcaccggcgtcgtgctctgggagtggtgcaagggcgagaaccagagctg

SEQ ID NO: 20095 - protein, 165 aa, Zea mays
  misc_feature: Ceres CLONE 1388096-F
  misc_feature (142)..(142): Xaa is any aa, unknown, or other
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDXDHGGVHDGTGVVLWEWCKGENQS

SEQ ID NO: 20096 - DNA, 680 bp, Zea mays
  misc_feature: Ceres CLONE 1388099-F
  misc_feature: Encodes the peptide sequence at SEQ ID NO. 20097
  misc_feature (599)..(599): n is a, c, t, g, unknown, or other
aaagctggagctccccgcggtggcggccgctctagaactagtggatcccccgggctgcaggaattcgcacgagaccatacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgccccgcagcagcgacctggacccgcctctgcttgcaggctgcgccaagattgtccccagcatacgaccacgcgcccggaagaccggagaggaataaggggacagtaccaagaccccgcggaagaggcgaaggacccccaccgggaaccccagggagcccgccagaaggatggcccggggaaccaaaaagcagggcgcaagaacaaagccggcccgctggggggaacaaaggttcggttattggccaaggggccaaggaccaagnaaaagggtggggggaaagaacccccgaaacccggggtcccggggggaggggggggaaggaaaaaaaaaaacccggggaccg

SEQ ID NO: 20097 - protein, 59 aa, Zea mays
  misc_feature: Ceres CLONE 1388099-F
  misc_feature (32)..(32): Xaa is any aa, unknown, or other
MARGTKKQGARTKPARWGEQRFGYWPRGQGPXKRVGGKNPRNPGSRGEGGEGKKKTRGP

SEQ ID NO: 20098 - DNA, 657 bp, Zea mays
  misc_feature: Ceres CLONE 1388111-F
  misc_feature: Encodes the peptide sequence at SEQ ID NO. 20099
  misc_feature (527)..(527): n is a, c, t, g, unknown, or other
  misc_feature (528)..(528): n is a, c, t, g, unknown, or other
  misc_feature (565)..(565): n is a, c, t, g, unknown, or other
  misc_feature (596)..(596): n is a, c, t, g, unknown, or other
  misc_feature (645)..(645): n is a, c, t, g, unknown, or other
  misc_feature (657)..(657): n is a, c, t, g, unknown, or other
aagctggagctccccgcggtggcggccgctctagaactagtggatcccccgggctgcaggaattcgcacgagaccattacctagaacatcctaatcgaaaagttctgttctgttctgtcctgtccatcacaattcacgcgacgacgacccggcctgcgggcagatctttcttgacctagccagctcgttcttggcgcactagctagccagccagctagtagctatcctcgctcctccccaccgtcctcagtgctagactattcgtccgatgggcggcgtccaactcgacgacctctccgaattggccgtgctccggccgatccagacagcggcagcggctcggccgccgggcgacgacgccaaagacggcccggacgccgccgacacgggctgcgtcacgccaacggcctcgagctcccggctgatgccgatgccgcgcctggacggcggctgcggcgccctggacagtaccgacgccgccgccgccgcctgcgtcacgccggcggcgtcaccttgcctgctgcggnncggcacggtgtgccctcccgcgccgcgaaaaccgggngaaggccggcccgcgccgccgcccgacaacnagaggaaagcgctgctgctgcgcccgcgccttcttccccgtgcgcacgnccttctccgggn

SEQ ID NO: 20099 - protein, 129 aa, Zea mays
  misc_feature: Ceres CLONE 1388111-F
  misc_feature (87)..(87): Xaa is any aa, unknown, or other
  misc_feature (110)..(110): Xaa is any aa, unknown, or other
  misc_feature (126)..(126): Xaa is any aa, unknown, or other
MGGVQLDDLSELAVLRPIQTAAAARPPGDDAKDGPDAADTGCVTPTASSSRLMPMPRLDGGCGALDSTDAAAAACVTPAASPCLLRXGTVCPPAPRKPGEGRPAPPPDNXRKALLLRPRLLPRAHXLLR

SEQ ID NO: 20100 - DNA, 650 bp, Zea mays
  misc_feature: Ceres CLONE 1388112-F
  misc_feature: Encodes the peptide sequence at SEQ ID NO. 20101
tggagctccccgcggtggcggccgctctagaactagtggatcccccgggctgcaggaattcgcacgagaccattacctagaacatcctaatcgaaaagcgattggcgattccatttctaccccgagacctccagccttccgcccctgaaccctcagccttctccgtcccgcctcggcactcgacggccgccggcacacaccgcgcagtctcgagacaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagaggcagcgcaagaaggcgcgacttccttcaacggggcccccggggggggttctttcccgaaaaccttttttggggttaaaagggaaaaaaaatttccgccccccctctccgggggggccggggggggggtttccaaccccgggggggggggaaaattgggggggaaaacacccccaaattttccacccgc

SEQ ID NO: 20101 - protein, 138 aa, Zea mays
  misc_feature: Ceres CLONE 1388112-F
MEDDSPLTKTMKGAVTGLAAGTIWGTVVATWYDVPRVERHVALPGLIRTLKMCGTYGATFATIGGLYIGVEQLVQRQRKKARLPSTGPPGGVLSRKPFLGLKGKKNFRPPSPGGPGGGFPTPGGGENWGGKHPQIFHP

SEQ ID NO: 20102 - DNA, 655 bp, Zea mays
  misc_feature: Ceres CLONE 1388115-F
  misc_feature (352)..(352): n is a, c, t, g, unknown, or other
  misc_feature (436)..(436): n is a, c, t, g, unknown, or other
  misc_feature (587)..(587): n is a, c, t, g, unknown, or other
gctggagctccccgcggtggcggccgctctagaactagtggatcccccgggctgcaggaattcgcacgagaccattacctagaacatcctaatcgaaaagtcggtcgctcgttcgcctgttccccttgttcgtctgtctgtctttgacaccacagcgcccgcctccgtttgcactgttgcctgccgccctccttcctgctcctgctcggctcgctacggctacgggcactggcatcgacagtgacatccccgctcgcgccgtcctcggtcctccctttcttctgcctctcgctcgcgcgtgcagttgagagcggctcgacagcgcagcgtgcgcggacacggcagcgccagntactctctctctctctctctctctctctctctctctctctctcctcgctgctcggcgtccaattcaatgcgctcctgcgcaacngggcagagcagcgacctccttccttctccaccattgggttgagctccgccactcaattcaatgcctgtccgctcttgaagaaacgcctcctcctctcttctttaccgccccgtgtcatcactcttactcgtacgtgctcgcgcacgccagnttcaatacgtccgctggcctctgcgtgcgtcgtctcgtcacgcaagcagcaagccgtgcagagagaaa

SEQ ID NO: 20103 - DNA, 618 bp, Zea mays
  misc_feature: Ceres CLONE 1388119-F
  misc_feature: Encodes the peptide sequence at SEQ ID NO. 20104
  misc_feature (164)..(164): n is a, c, t, g, unknown, or other
  misc_feature (199)..(199): n is a, c, t, g, unknown, or other
  misc_feature (273)..(273): n is a, c, t, g, unknown, or other
  misc_feature (289)..(289): n is a, c, t, g, unknown, or other
  misc_feature (294)..(294): n is a, c, t, g, unknown, or other
  misc_feature (295)..(295): n is a, c, t, g, unknown, or other
  misc_feature (308)..(308): n is a, c, t, g, unknown, or other
tggagctccccgcggtggcggccgctctagaatagtggatcccccgggctgcaggaattcgcacgagaccattacctagaacatcctaatcgaaaaaatatcgcattgacagatcgttcatcgtagcctcctccagtcgtctcccgggatcttctccggctatnaatttccgccccaattccccaatccagatgcgcanacatcgaatcgtctcgctcgtggctgccctgctcatactgcttgccctcgccgtatcgtccaccccgcacgcanaggaggattccatggncgacnnacacgggacgttngcgggcggcatcagggacggtgcggggaaacgagaacgactttcacctccggaactcgcccgcttcgccgtcgatgagaacaacagaaagccaatgctcctcttggggtcaaaaaattttgggaggcaagaaaaaagggggtggtggccgatgtattttttccctttggaagggagggggggaaatgaaaaaattttccaaaattttgggttgggaaaaaccgggggaaaaatttgggggggttggggaaattcaggccctgttaaaaaagggggtaaacccccaaaaaatcttcccctctccgcggggg

SEQ ID NO: 20104 - protein, 142 aa, Zea mays
  misc_feature: Ceres CLONE 1388119-F
  misc_feature (3)..(3): Xaa is any aa, unknown, or other
  misc_feature (28)..(28): Xaa is any aa, unknown, or other
  misc_feature (33)..(33): Xaa is any aa, unknown, or other
  misc_feature (35)..(35): Xaa is any aa, unknown, or other
  misc_feature (39)..(39): Xaa is any aa, unknown, or other
MRXHRIVSLVAALLILLALAVSSTPHAXEDSMXDXHGTXAGGIRDGAGKRERLSPPELARFAVDENNRKPMLLLGSKNFGRQEKRGWWPMYFFPLEGRGGNEKIFQNFGLGKTGGKIWGGWGNSGPVKKGGKPPKNLPLSAG

SEQ ID NO: 20105 - DNA, 500 bp, Zea mays
  misc_feature: Ceres CLONE 1388129-F
  misc_feature (151)..(151): n is a, c, t, g, unknown, or other
  misc_feature (152)..(152): n is a, c, t, g, unknown, or other
aagctggagctccccgcggtggcggccgctctagaactagtggtcccccgggctgcaggattcgcacgagaccattacctagaacatcctaatcgaaaaacaagctcgatcaccaacccagctcggtcgtcccagctgatcaggtcgaagnncaccttgcgacctgctcgatcatcagtgtagaagtgtctggtaggtgtctgtctctcttggtggctggttgcaacggtcatggcgacgtcgtctcgtcgggtgccctttgctgctggctggtcctgggcgtgctggtgtcgtgctccttcggcgcggggaagcttggaccaggagctggaatcacgttgggcgacggccgggaaagtcctgaaaacggggggttgttgacctttcccgtgaacccaactcccgtctcggtttcaagccccggaaaaatacttgttgcgaaaaaaaaataaacttggggggggggggggggaaacccccccggaacgctcccccccaaa

SEQ ID NO: 20106 - DNA, 717 bp, Zea mays
  misc_feature: Ceres CLONE 1388135-F
  misc_feature: Encodes the peptide sequence at SEQ ID NO. 20107
  misc_feature (683)..(683): n is a, c, t, g, unknown, or other
aaagctggagctccccgcggtggcggccgctctagaactagtggatcccccgggctgcaggaattcgcacgagaccattacctagaacatcctaatcaaaaaactactccgtcactttggttgcaaagctcctcctcgatccatcgatcactgcaccggccggcggtaccgcgctcgcaggggctagccaacgaaacggcagaaatggagaaccgtgaccgcagcggcatctacggaggtgcccacgccacctacggacagcggcagcagcagggaggaggcggacgcccgatgggtgagcaggtgaagggcatgctccacgacaaggggccgacagcgtgacaagcgctgacggggccgacgctgttcccgctgggcggactgctgctggtgctgccgggactggccctgactgcctccggggtggggctggacgtggtcacgccggggtttcctggatctgcaccccgggctggtcccccgccggcgtgttcatcgggacgggccgccatgggggttccctacgtccaggccgggctggggggttggggggccctggccctcccttacccgggcctcctccaaaaccgcgggcgcagggtgttttccgggggcacccccgggaactaatgggaaaagaaagggccccccccccaagaaatggtgaggaaaggccgccttgnaccaacaccgcggtgtaccaaaaagaacagcggg

SEQ ID NO: 20107 - protein, 45 aa, Zea mays
  misc_feature: Ceres CLONE 1388135-F
MENRDRSGIYGGAHATYGQRQQQGGGGRPMGEQVKGMLHDKGPTA

SEQ ID NO: 20108 - DNA, 675 bp, Zea mays
  misc_feature: Ceres CLONE 1388137-F
  misc_feature: Encodes the peptide sequence at SEQ ID NO. 20109
  misc_feature (271)..(271): n is a, c, t, g, unknown, or other
  misc_feature (283)..(283): n is a, c, t, g, unknown, or other
  misc_feature (426)..(426): n is a, c, t, g, unknown, or other
  misc_feature (648)..(648): n is a, c, t, g, unknown, or other
aagctggagctccccgcggtggcggccgctctagaactagtggatcccccgggctgcaggaattcgcacgagaccattacctagaacatcctaatcgaaaacttttttccccgctcttctcccacacaaacgccaccgccgcatcgaatccgagacgccgatctcggattcgccgtcaccacacgctgccctcgtcgcgctctcccgccgccgccgctcgtctcgtcagccatggcaggattggcaccagaagggtcgcaatttgatgacnagcagtatgacnagaaaatgcaggagatattaactgaagacttcttcacttcatatgatgatgtttgtgaaagttttgacagcatgggactgcaagagaaccttctgagaggcatctatgcctatggttttgagaagccatcggctattcagcanaggggaatagttcccttctgcaaggggcttgacgtgattcagcaagctcagtctggaactggaaaaacagctaccttctgttctggaatcttgcagcaacttgattatggattgggtgaatgcccagcattggttcttgctccaccccgtgagcttgctcagcaaattgagaaggttatgcgtgctcttggggactatttgggtgtaaagtgcatgcctgtngtgtgggacatctggtcgtgaggacaa

SEQ ID NO: 20109 - protein, 145 aa, Zea mays
  misc_feature: Ceres CLONE 1388137-F
  misc_feature (14)..(14): Xaa is any aa, unknown, or other
  misc_feature (18)..(18): Xaa is any aa, unknown, or other
  misc_feature (65)..(65): Xaa is any aa, unknown, or other
MAGLAPEGSQFDDXQYDXKMQEILTEDFFTSYDDVCESFDSMGLQENLLRGIYAYGFEKPSAIQXRGIVPFCKGLDVIQQAQSGTGKTATFCSGILQQLDYGLGECPALVLAPPRELAQQIEKVMRALGDYLGVKCMPVVWDIWS

SEQ ID NO: 20110 - DNA, 652 bp, Zea mays
  misc_feature: Ceres CLONE 1388144-F
  misc_feature: Encodes the peptide sequence at SEQ ID NO. 20111
  misc_feature (364)..(364): n is a, c, t, g, unknown, or other
  misc_feature (484)..(484): n is a, c, t, g, unknown, or other
  misc_feature (508)..(508): n is a, c, t, g, unknown, or other
  misc_feature (526)..(526): n is a, c, t, g, unknown, or other
tggagctccccgcggtggcggccgctctagaactagtggatcccccgggctgcaggaattcgcacgagaccattacctagaacatcctaatcgaaaaaccatctccagcggcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacngcatgatcacggacgcagaggagaaagggctgattactccaggcgtgagtgttctgattgaaccaactagcggcaacacaggcattggactggcctttatggctgctgccaagggctacnaacttacactcacaatgcctgccntcatgagcatggagaggnagatcatattgaaggcttttggtgctgaacttgtccttactgacccactcctgggaatgaaaggagctgtcaagaaagcggagagataccagcaaagacaccccactcttacatcccttcacaatt

SEQ ID NO: 20111 - protein, 150 aa, Zea mays
  misc_feature: Ceres CLONE 1388144-F
  misc_feature (12)..(150): Pfam Name: PALP Pfam Description: Pyridoxal-phosphate dependent enzyme
  misc_feature: SWISSPROT Homolog: EC 2.5.1.47 Cysteine synthase
  misc_feature (55)..(55): Xaa is any aa, unknown, or other
  misc_feature (95)..(95): Xaa is any aa, unknown, or other
  misc_feature (103)..(103): Xaa is any aa, unknown, or other
  misc_feature (109)..(109): Xaa is any aa, unknown, or other
MGEASPSIAKDVTELIGNTPLVYLNKVTEGCVGRVAAKLESMEPCSSVKDRIGYXMITDAEEKGLITPGVSVLIEPTSGNTGIGLAFMAAAKGYXLTLTMPAXMSMERXIILKAFGAELVLTDPLLGMKGAVKKAERYQQRHPTLTSLHN

SEQ ID NO: 20112 - DNA, 657 bp, Zea mays
  misc_feature: Ceres CLONE 1388145-F
  misc_feature: Translation starting site: 208
  misc_feature: Pfam Name: Ribosomal_L44 Pfam Description: Ribosomal protein L44
  misc_feature (402)..(402): n is a, c, t, g, unknown, or other
tggagctccccgcggtggcggccgctctagaactagtggatcccccgggctgcaggaattcgcacgagaccattacctagaacatcctaatcgaaataaaagcacagctcttgtgtccccgccgccgccacctgctgcagcttctcaaccggataggtagcaccggagcaggtacaacgctgcacaatccccttcgccgccgccaagatggtgaacgttcctaagaccaagaagacgtactgcaagaacaaagagtgcaagaagcacacactccacaaggtgactcagtataagaagggaaagatagcctgtctgctcagggaaagcgcccgtatgacccgcagcagtcaggatatggtggtcagaccaagcctggcttcccacagaagggccagaccaccnagaaagattggtctgaagctgcagtgccagagctgcaagcactactcacagcaggccatcaggagatgcaagcattttgaaaatggtggggaacaaaaaggcaagggaccttctcttttctaagttccccgccacctttttttgtggttagaattaaccttggggcctaacaacaacgggtcaaaaaaccctctcccaaatttcaggggtaatggaaaaagaaaaccaaccccggttttgtccccaatccccagg

SEQ ID NO: 20113 - DNA, 650 bp, Zea mays
  misc_feature: Ceres CLONE 1388149-F
  misc_feature: Encodes the peptide sequence at SEQ ID NO. 20114
  misc_feature (407)..(407): n is a, c, t, g, unknown, or other
  misc_feature (411)..(411): n is a, c, t, g, unknown, or other
  misc_feature (459)..(459): n is a, c, t, g, unknown, or other
  misc_feature (512)..(512): n is a, c, t, g, unknown, or other
aagctggagctccccgcggtggcggccgctctagaactagtggatcccccgggctgcaggaattcgcacgagaccattaccacatcctaatcgaaaaaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggncagnccttttgtgatgtccctcaggaggggagcgtcctccctggcatcaggntgaccaggggcaccatgaggttttgtgcactgataaagagacaccacccaggncatgacgacctgggcaagggtggcgcaaagaacaacaggcaggtgcccgctttgccaaggggccgctgtccccaagatgggccctatgggccatcaaagttggcatcaacctgaaacctaggggctggttcctattcc

SEQ ID NO: 20114 - protein, 158 aa, Zea mays
  misc_feature: Ceres CLONE 1388149-F
  misc_feature (11)..(156): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (88)..(88): Xaa is any aa, unknown, or other
  misc_feature (104)..(104): Xaa is any aa, unknown, or other
MSAYCGKYKDELIKNAAYIGTPGKGILAADESTGTIGKRLSSINVENVEENRRALRELLFCCPGALQYISGVILFEETLYQKTKDGQXFCDVPQEGSVLPGIRXTRGTMRFCALIKRHHPGHDDLGKGGAKNNRQVPALPRGRCPQDGPYGPSKLAST

SEQ ID NO: 20115 - DNA, 489 bp, Zea mays
  misc_feature: Ceres CLONE 1388152-F
  misc_feature: Encodes the peptide sequence at SEQ ID NO. 20116
  misc_feature (403)..(403): n is a, c, t, g, unknown, or other
aagctggagctcaccgcggtggcggccgctctagaactagtggatcccccgggctgcaggaattcgcacgagaccattacctagaacatcctaatcgaaaaatccgcgtcactcaccagtctcctcccctaatcccactccgccgccgccagcttgcccatggcggcgacaacccacgccgcctccatgtcgttcctcctctctcacccccagtcgcgctctgccaccccaagccgccacctcccgctccgtccggcagcccgccgcgtccagtgcgccaccgacgccgccgccctttccccggcggtcaccaccaagcaccggcgcgcggcggatgagaacatcgcgaggaggcggcgcgcacccgccccgagcaggcctgtcgcgtggacaagccttcccngcgccccgacgggacccaacgagcctactccctgagagatcgtgtccgggtcagctcgggggcctcctcgacgtggggacgaaagg

SEQ ID NO: 20116 - protein, 92 aa, Zea mays
  misc_feature: Ceres CLONE 1388152-F
  misc_feature (82)..(82): Xaa is any aa, unknown, or other
MAATTHAASMSFLLSHPQSRSATPSRHLPLRPAARRVQCATDAAALSPAVTTKHRRAADENIARRRRAPAPSRPVAWTSLPXAPTGPNEPTP

SEQ ID NO: 20117 - DNA, 647 bp, Zea mays
  misc_feature: Ceres CLONE 1388153-F
  misc_feature (335)..(335): n is a, c, t, g, unknown, or other
  misc_feature (405)..(405): n is a, c, t, g, unknown, or other
  misc_feature (498)..(498): n is a, c, t, g, unknown, or other
aaagctggagctccccgcggtggcggccgctctagaactagtggatcccccgggctgcaggaattcgcacgagaccattacctagaacatcctaatcgaaaaagccagccaggcccaggagcgcgagttctgtgcctgtgcctctgctccacctcccctgcccctgcgccccaagtccacgtccaccactcagcactcacgctgctcgctcgctcgctcgtacacgcgcccgcttcgcgcaggtgcgtgtagaacgacggaggcattccatttccgactgagccgtgtgtgtttggatcggacaacccctgccaaaaccgcgtgagccagcgctngtctgcctctgatcgtgtgtgctgctgtttgttttggttttggttttggttggctagggaagaaccgtgntggggggaagcgacggacatgatgcacgccaagtcggagtcggacgtgacgagctgggcgcgtcgtcgccgccgggccgccgagccggggcgnggggccggaaacggggttactactgcaaagcccgtccgggaaatccacaaacggggtaaaagtcctcgtgattgaaccccgccggataaaaagcccaaaaagtcgccgtcgaccccttcaagggccgcattccgcttccccccggaagc

SEQ ID NO: 20118 - DNA, 654 bp, Zea mays
  misc_feature: Ceres CLONE 1388157-F
  misc_feature: Encodes the peptide sequence at SEQ ID NO. 20119
aaagctggagctccccgcggtggcggccgctctagaactagtggatcccccgggctgcaggaattcgcacgagaccattacctagaacatcctaatcgaaaaatttgaacctccaagttcagaaactgaccccctcgtccctccccaccatcgcgatggctgacgacgccgcggcggcggcgttcgcgccctctccctcgccaccgtcacccgtagcgcaacctctgcccgacctctccccgccgccgcccttctccccaccagccggcacccctgcttccggggcgcagacgccgagcctcccggacaccccggcctccctagatccggacacccccttctccgacgccaccccgacccccgccgacgcctccgacgccgccctcgcttcggacgacggcatcaccaacccgtcggggggcaccgccggcaagcacatgacgctcgcgccgcccgccccgcccgccaagaaaccgtccaagaagaagggcggcaacagcgtctggacccgccccggcctccgcaagggcagaagaaggcgaggcagccgggcgggctcggccacggcttcgggcggcccggccggggccgccagaggttccaaacctaagcccaacgccggggggggaggaggagttcctcctcgtccccgcg

SEQ ID NO: 20119 - protein, 72 aa, Zea mays
  misc_feature: Ceres CLONE 1388157-F
MTLAPPAPPAKKPSKKKGGNSVWTRPGLRKGRRRRGSRAGSATASGGPAGAARGSKPKPNAGGGGGVPPRPR

SEQ ID NO: 20120 - DNA, 656 bp, Zea mays
  misc_feature: Ceres CLONE 1388158-F
  misc_feature: Translation starting site: 226
  misc_feature: SWISSPROT Homolog: EC 2.4.1.207 Xyloglucan:xyloglucosyl transferase
  misc_feature (356)..(356): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (648)..(648): n is a, c, t, g, unknown, or other
  misc_feature (652)..(652): n is a, c, t, g, unknown, or other
aagctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggnacggcgggcgcggctggacctgacgctggaccgcacgtccggctcccgggtccagtccaagagcgagtacctgtnnncgcagatcgacatgcagatcaagctggtgcccagcaactccgtggcacggtcaccaccttctacctgtcgtcccagggcgacgcgcacgacgagatcgacttcgagttcctgggcaacgtgagcggggagccctacacgctgcacaccaacgtggtcacgcgcggacaggggcagcgggagcagcagttcccgctctggttcgaccctacactgncttncacc

SEQ ID NO: 20121 - DNA, 686 bp, Zea mays
  misc_feature: Ceres CLONE 1388159-F
  misc_feature: Translation starting site: 171
  misc_feature (337)..(337): n is a, c, t, g, unknown, or other
aaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctaacgcgacaattttcccccataccttccatcaattatagcttcaatatgtgaaaacccagctcttcaaccatataggcttcaacaagcaatcgcagcaagcaacataccntttatcgcccttgttgtttcaacaatcgcccagccctatctttggtgcagtcattggtacaaaccatcagggcacaacagctgcagcaactcgtgctacttctgatcaccaagaagctctggaaaacctttctccctactctaagaaaaaaaattccttcattcacccaattgtcaaccttgaacccgggttgtttattggcgaaaaaaactattaccttttaccccggtaggttatgggctaactccaaaaaaaaaaaatttcttccatttaaacacaatggggccgcaaagaaaccccggttgatatattttgcaagagaaaaaattctactcactttttagccggg

SEQ ID NO: 20122 - DNA, 652 bp, Zea mays
  misc_feature: Ceres CLONE 1388163-F
  misc_feature: Encodes the peptide sequence at SEQ ID NO. 20123
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcaaaaaatctcactcatcagctagcaccaccaggaagtaggaacacacctcccaccagtccactgtttcatcgctcatcactaggctgcaatggctgcaaagtcacctgtgcttgcagcactggtactgctcctgagctccgcccagctgtccacgggggcaaggatgcgcatggagctgtaccagcccgatccggcggacatgctctcctaccacaacggatccgtgctccactccgacatcttcgtgtccgtgctctggtacggcagcttcacgcaggtgcagaaggggatcatctacgacttcttgctctcgctcacaaccacgccccaggccgactcgccgtccgtcgcgaagtggtgggacatgatcgagcaacagtacctgtccaaggtggcgcagacacccggcataccaccacccgggtgatgctgaacaccacccaggtgtcctccgaacgacggttggtccatgggcaccttcctccccctggcgcaaggcccccccctcccccggcgggacaggcccaagaaaggggggtttccccctggtgctn

SEQ ID NO: 20123 - protein, 112 aa, Zea mays
  misc_feature: Ceres CLONE 1388163-F
MAAKSPVLAALVLLLSSAQLSTGARMRMELYQPDPADMLSYHNGSVLHSDIFVSVLWYGSFTQVQKGIIYDFLLSLTTTPQADSPSVAKWWDMIEQQYLSKVAQTPGIPPPG

SEQ ID NO: 20124 - DNA, 630 bp, Zea mays
  misc_feature: Ceres CLONE 1388170-F
  misc_feature: Encodes the peptide sequence at SEQ ID NO. 20125
  misc_feature (422)..(422): n is a, c, t, g, unknown, or other
  misc_feature (460)..(460): n is a, c, t, g, unknown, or other
  misc_feature (476)..(476): n is a, c, t, g, unknown, or other
  misc_feature (480)..(480): n is a, c, t, g, unknown, or other
  misc_feature (495)..(495): n is a, c, t, g, unknown, or other
  misc_feature (560)..(560): n is a, c, t, g, unknown, or other
  misc_feature (561)..(561): n is a, c, t, g, unknown, or other
  misc_feature (622)..(622): n is a, c, t, g, unknown, or other
  misc_feature (630)..(630): n is a, c, t, g, unknown, or other
aaagctggagctccccgcggtggcggccgctctagaactagtggatcccccgggctgcaggaattcgcacgagaccattacctagaacatcctaatcgaaaacttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgancagaaatcatttgtgtcttacatcaaaaaatacatcangaatctcactgctgtngtgnagccagagaaagcgnatgagttcaaaaagggtgtcgagggtgcaaccaagtttctcctttagcagctgaaggacctccannttttttgtggtgagtccatgaaagatgatgcgtctgtggtattcgcctatttacagatggntgcactan

SEQ ID NO: 20125 - protein, 121 aa, Zea mays
  misc_feature: Ceres CLONE 1388170-F
  misc_feature (1)..(122): Pfam Name: TCTP Pfam Description: Translationally controlled tumour protein
  misc_feature (82)..(82): Xaa is any aa, unknown, or other
  misc_feature (95)..(95): Xaa is any aa, unknown, or other
  misc_feature (102)..(102): Xaa is any aa, unknown, or other
  misc_feature (107)..(107): Xaa is any aa, unknown, or other
MLVYQDLLSGDELLSDSFTYKELENGVLWEVEGKWVTQGPVDVDIGANPSAEGGEDESVDDTAVKVVDIVDTFRLQEQPPFXQKSFVSYIKKYIXNLTAVVXPEKAXEFKKGVEGATKFLL

SEQ ID NO: 20126 - DNA, 659 bp, Zea mays
  misc_feature: Ceres CLONE 1388172-F
  misc_feature: Encodes the peptide sequence at SEQ ID NO. 20127
aaagctggagctcaccgcggtggcggccgctctagaactagtggatcccccgggctgcaggaattcgcacgagaccattacctagaacatcctaatcgaaaagttatatctcctcaaggcacgttcaccacagtcctctctttccccggcaccaccaccacccaggctaaccggactggaccgagtgttgaacaacactgagggcgaggcagatagagcgacggcaggcatggtgagccgtgaaaatttgcacctggtgctggacccggcgtctctgggcgcgccgtgggccgacccgtccgccgcagagatcccgccgcagctcctcgccgcgctgggagagtacctctcctccacccgcgccgagggcggcgacgtcgcgacggaggcggacgacgagttcatgatgcacgagttcaaggtgcggcggtgcgcgcgcgcgcgaaaccacgactggacggtgtgcccctactcgcacccggtggaggtcgcgcggcgccgggacccgcgccgcttggcctacacgggggagacgtgcccggacttcaggcgccgcccaggcgcgggctgcctggtgcccacggggggccgcctgcaccaatagaaaaggtctccttagagaaagtgggttcaaccggtccggataacgtacgcgtccg

SEQ ID NO: 20127 - protein, 124 aa, Zea mays
  misc_feature: Ceres CLONE 1388172-F
MVSRENLHLVLDPASLGAPWADPSAAEIPPQLLAALGEYLSSTRAEGGDVATEADDEFMMHEFKVRRCARARNHDWTVCPYSHPVEVARRRDPRRLAYTGETCPDFRRRPGAGCLVPTGGRLHQ

SEQ ID NO: 20128 - DNA, 547 bp, Zea mays
  misc_feature: Ceres CLONE 1388173-F
  misc_feature: Encodes the peptide sequence at SEQ ID NO. 20129
  misc_feature (333)..(333): n is a, c, t, g, unknown, or other
  misc_feature (421)..(421): n is a, c, t, g, unknown, or other
  misc_feature (438)..(438): n is a, c, t, g, unknown, or other
tggagctccccgcggtggcggccgctctagaactagtggatcccccgggctgcaggaattcgcacgagaccattacctagaacatcctaatcgaaaaaagttgtttctcttctcttgctccgcaaaccagcgcaagcccttccctgacagcggcggcgacatggtgctcgaggcgacgatgatctgcatagacaactcggagtggatgcggaacggcgactacgccccgtcgcggttccaggcgcaggccgatgccgtcaacctcatatgcggtgccaagacccagtcgaacccggagaacacagtaggcgtgatgacgatggccgggaaggncgtccgcgtgcttgtcactcccaccagcgacctcgggaagattctcgcctgtatgcacgggttggaaagtggtgctgaggcaaacttnggctgcgcaatccaggntgctcagcttgcgctaaagcatcgccagaacagaggcagcagcagaggatatagcatttcatcggagtcctgtggagtaccacaagaaaattttaagaccatcgggaaa

SEQ ID NO: 20129 - protein, 129 aa, Zea mays
  misc_feature: Ceres CLONE 1388173-F
  misc_feature (58)..(58): Xaa is any aa, unknown, or other
  misc_feature (87)..(87): Xaa is any aa, unknown, or other
  misc_feature (93)..(93): Xaa is any aa, unknown, or other
MVLEATMICIDNSEWMRNGDYAPSRFQAQADAVNLICGAKTQSNPENTVGVMTMAGKXVRVLVTPTSDLGKILACMHGLESGAEANXGCAIQXAQLALKHRQNRGSSRGYSISSESCGVPQENFKTIGK

SEQ ID NO: 20130 - DNA, 714 bp, Zea mays
  misc_feature: Ceres CLONE 1388183-F
  misc_feature: Encodes the peptide sequence at SEQ ID NO. 20131
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (460)..(460): n is a, c, t, g, unknown, or other
  misc_feature (461)..(461): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (632)..(632): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
ttgggtgtggntnnnggtgcccccccgggggaaaaaaaaannngnggagggggggctctcgcggggagggggataatataaaagggattttgcccccccccccccccnnnncaaagctggaactccccgcggtggcggccgctctagaatagtggatcccccgggctgcaggaattcgcacgagaccattacctagaacatcctaatcgaaaagttatccccccaccggacaatcttccttcaggcttcagctgtccgcccggggcccaccctccgccgtttccacaattccgccgttccaccacgcccttcgcagtttgggacttccctcttgctccccccctttgaaaaaagggggggaacccccttccccccccccgagggggggcatttttctctcaggggcccccggtttctgttaaaaatttccccccccccccgagcggggggggggccccgnngttttttcccccccgggggcccccccccaaaaaaacccgggggggcgttctttttttataaacacccgccccccgcggtttttcatgggcgggctccctccccccccttctcttttcggggggggggagggnnnggacgaggggggggccaagacccccccccccccctcnccannnaacaaaacaaagtcgtcggtcgtcggcggggggtggacgccacaccaaccaacggcagtccgcgccgcgtccgcgg

SEQ ID NO: 20131 - protein, 56 aa, Zea mays
  misc_feature: Ceres CLONE 1388183-F
  misc_feature (17)..(17): Xaa is any aa, unknown, or other
  misc_feature (31)..(31): Xaa is any aa, unknown, or other
MGGLPPPPSLFGGGEGXDEGGAKTPPPPSPXNKTKSSVVGGGWTPHQPTAVRAASA

SEQ ID NO: 20132 - DNA, 634 bp, Zea mays
  misc_feature: Ceres CLONE 1388188-F
  misc_feature: Encodes the peptide sequence at SEQ ID NO. 20133
  misc_feature (416)..(416): n is a, c, t, g, unknown, or other
  misc_feature (433)..(433): n is a, c, t, g, unknown, or other
  misc_feature (444)..(444): n is a, c, t, g, unknown, or other
aaagctggagctccccgcggtggcggccgctctagaactagtggatcccccgggctgcaggaattcgcacgagaccattacctagaacatcctaatcgaaaaacaacaagagagagagagagagacagagagagagagactgccaacgaggcgaagcagccggccaatctagcatcagcgcgcggggtctgagagcagagcggcagggcgccatggcggcatcggtggcgctgagcagcgggcaccggatgccggcggtggggctgggcgtgtggcggatggagaaggcggacatccgcggcctcatccacacagcgctccgcgtcggctaccgccacctggactgcgccgctgactaccagaacgaagctgaaagtggtgacgcgctcgcagaggcattccagaccggactcgtncagcgggaggacctggntcatcacaccnagctggtggactcaaaccatgggcatgtgcttgaagcctgcaaggacagcctgaaagaagctgcagctagactatctcgacctctacctcattcatttcccagaagcaactcgggacaccggagtcgggacgacttctagcgctctgggtgacaatggcgtggctgaacatcaacccactttttccctga

SEQ ID NO: 20133 - protein, 123 aa, Zea mays
  misc_feature: Ceres CLONE 1388188-F
  misc_feature: SWISSPROT Homolog: EC 1.1.1.200 Aldose-6-phosphate reductase (NADPH)
  misc_feature (74)..(74): Xaa is any aa, unknown, or other
  misc_feature (78)..(78): Xaa is any aa, unknown, or other
MAASVALSSGHRMPAVGLGVWRMEKADIRGLIHTALRVGYRHLDCAADYQNEAESGDALAEAFQTGLVQREDLXHHTXLVDSNHGHVLEACKDSLKEAAARLSRPLPHSFPRSNSGHRSRDDF

SEQ ID NO: 20134 - DNA, 643 bp, Zea mays
  misc_feature: Ceres CLONE 1388189-F
  misc_feature: Encodes the peptide sequence at SEQ ID NO. 20135
  misc_feature (506)..(506): n is a, c, t, g, unknown, or other
  misc_feature (580)..(580): n is a, c, t, g, unknown, or other
aaagctggagctccccgcggtggcggccgctctataactagtggatcccccgggctgcaggaattcgcacgagaccattacctagaacatcctaatcgaaaaaactaggagagtggtggaggaggagacccaccgtcggctcgcccgtgtcccgattcccactcacgacatcaacctgtccccatccatctcgcccgcgacgtttgatggagtctctcctcgcctcgcgatccattaggtcttccttctccgccgtcgccagcaccaggggcgccgcttcccccaggccctcgcgcgtcgccaccctcgccagcgccggcgccggcgcccgctcccgcgcgctccgtgctggccacacggactcaatccttgaggtgctggcacaggacgatatgctgaacgagaaggagctggtccaatgggagaatggcttgtcattcaatgacatagcggctaggcaggggattcgcatccgcagacactgccgccccactggctccttgaangagatagaggaggagctgggagccccccttaacatctagagagatcatttgggacaaggagatgaagtagctgnagggcatgctaagaagctcttgaggagtgaatcaggctgcaacgaaagccctccttcagagac

SEQ ID NO: 20135 - protein, 112 aa, Zea mays
  misc_feature: Ceres CLONE 1388189-F
  misc_feature (100)..(100): Xaa is any aa, unknown, or other
MESLLASRSIRSSFSAVASTRGAASPRPSRVATLASAGAGARSRALRAGHTDSILEVLAQDDMLNEKELVQWENGLSFNDIAARQGIRIRRHCRPTGSLXEIEEELGAPLNI

SEQ ID NO: 20136 - DNA, 647 bp, Zea mays
  misc_feature: Ceres CLONE 1388191-F
  misc_feature: Translation starting site: 346
  misc_feature (122)..(122): n is a, c, t, g, unknown, or other
  misc_feature (129)..(129): n is a, c, t, g, unknown, or other
  misc_feature (139)..(139): n is a, c, t, g, unknown, or other
  misc_feature (363)..(363): n is a, c, t, g, unknown, or other
  misc_feature (373)..(373): n is a, c, t, g, unknown, or other
  misc_feature (447)..(447): n is a, c, t, g, unknown, or other
  misc_feature (448)..(448): n is a, c, t, g, unknown, or other
  misc_feature (472)..(472): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (532)..(532): n is a, c, t, g, unknown, or other
  misc_feature (536)..(536): n is a, c, t, g, unknown, or other
  misc_feature (541)..(541): n is a, c, t, g, unknown, or other
aagctggagctccccgcggtggcggccgctctagaatagtggatcccccgggctgcaggaattcgcacgagaccattacctagaacatcctaatcgaaaaatcgatcgtcaatgcaagtttngtccatntcgcattggntctgaatactggtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcagnaacatggtgncgccgctcctggtgctcaacctcatcatgtacatcatcgtcatcggcttcgcgagctggaaccctgaacacttnncatcacggcagaccactaccccgncgtggcccgcaccgggcgcgacgtctacctttcctggtgtcgcatcctggcccnnntggngggncccgnctccaaacttaggggcggtgaccacgtgcgcggctggggccacgaaagctggcaccaaaggcccgggtgcgtttatgcgctgggcatacgggctccgccttcgttg

SEQ ID NO: 20137 - DNA, 863 bp, Zea mays
  misc_feature: Ceres CLONE 1388195-F
  misc_feature (17)..(17): n is a, c, t, g, unknown, or other
  misc_feature (18)..(18): n is a, c, t, g, unknown, or other
  misc_feature (22)..(22): n is a, c, t, g, unknown, or other
catcccccccgcgccgnntccncacccgccccccccttctcccaaagccgccgctccccgcggtggcgggcgctctagaactagtggatcccccgggctgcaggaattcgcacgagaccattacctagaacatcctaatcgaaaactctatcatgcatccaatccagatcagcaaagcggcagtgcgtacagaggatcgtcgaacagaacagcatgaagatggtcatcgttctcgtcgtgtgcctggctctgtcagctgccagcgcctctgcaatgcagatgccctgcccctgcgcggggctgcaaggcttgcacggcgctggcgccggcctgactacgatgatgggcgccggcgggatgtacccctacgcgtagtacctgaggaagccgcagtgcatcccgctgccggtggcgcccctactaacgccggacgtgggccgcccagcggacttgtctccagcccctcccgggcaccagtgcttgtccagcacgtagaaggaggatgatgccacgtggacgcccgctccccgcaccaaccagccaaatggaggatgcccgctttgcagcggcgccggctggccgcccccgcgcaagccacggtccccatcccgtttcctgattggcaggccccccacccattagccctgcgcggatggtcccaaggggtctacaacccccacgcgccctcattgactcgtcccaaaaactatggttcctggacgggcgggccactcgctcccagttttcccccgcgctccaaactctgcctatctagcaccccggggcgggcatatccggcttccctatgaccggccctaaatacatggcttcttctgaaaactttaggtacgagcagccgtcct

SEQ ID NO: 20138 - DNA, 816 bp, Zea mays
  misc_feature: Ceres CLONE 1388198-F
  misc_feature: Encodes the peptide sequence at SEQ ID NO. 20139
  misc_feature (19)..(19): n is a, c, t, g, unknown, or other
  misc_feature (21)..(21): n is a, c, t, g, unknown, or other
  misc_feature (816)..(816): n is a, c, t, g, unknown, or other
tcccttttttcccccgtgncncccctttccccaccttatttttaaaactgaagctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgcttccacccgtccgtcgcctctctctcggctgcctgattgatttggttgccccggttccagcaatggcggtccaggcgcattatcaccaccactaccaccgcgagtcccctttcctcgtcagcggcgcgccggagggcagtcggttggcggcagcgatggagctgcatcatcaggcgcagaaggaggctatggcgccgcagcaggctcaggctccgcccctcttcttggacttctcgcatgcagattacggcggcggtaggaagcggcagcgcgaggcggagcccatggccctgcagttcttctctctgcaccagcaaccgcaggtgcaggggtccaaggcgatcaaactggcgcaacttccgaagcggacggcgatgggcccccggtctcgacttcaacgagggtccggagcaacgtgtgtgcaagtccccccgacctcggtcctcgggccctcatggccccccctcctaagaaactcgccggcggcgccgcggattcagaacatggtaaccagcataggcaccggcctggaacccaagggaacattggggggtacggggttcccggggcgcgtgctctttggggcccgaccaccn

SEQ ID NO: 20139 - protein, 178 aa, Zea mays
  misc_feature: Ceres CLONE 1388198-F
MAVQAHYHHHYHRESPFLVSGAPEGSRLAAAMELHHQAQKEAMAPQQAQAPPLFLDFSHADYGGGRKRQREAEPMALQFFSLHQQPQVQGSKAIKLAQLPKRTAMGPRSRLQRGSGATCVQVPPTSVLGPSWPPLLRNSPAAPRIQNMVTSIGTGLEPKGTLGGTGFPGRVLFGARPP

SEQ ID NO: 20140 - DNA, 712 bp, Zea mays
  misc_feature: Ceres CLONE 1388199-F
  misc_feature: Encodes the peptide sequence at SEQ ID NO. 20141
cgcggtggcggccgctctagaactagtggatcccccgggctgcaggaattcgcacgagaccattacctagaacatcctaatcgaaaacgcaaacccctctcgatcgacacacgcagccgcgacccatcgcgacctgacccgaccctcccgaggccgccagccttatcctctccgcctccgcctcccgccgtcccctccgacccatcacaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtcgtggcagctggtgctaatcctgttcagattactcgtggtattgagaaaacagctaaagcactagttg

SEQ ID NO: 20141 - protein, 162 aa, Zea mays
  misc_feature: Ceres CLONE 1388199-F
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALV

SEQ ID NO: 20142 - DNA, 726 bp, Zea mays
  misc_feature: Ceres CLONE 1388205-F
  misc_feature: Encodes the peptide sequence at SEQ ID NO. 20143
  misc_feature (630)..(630): n is a, c, t, g, unknown, or other
  misc_feature (645)..(645): n is a, c, t, g, unknown, or other
  misc_feature (667)..(667): n is a, c, t, g, unknown, or other
  misc_feature (670)..(670): n is a, c, t, g, unknown, or other
tggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacgtgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcagcaacacaacttncttccattaacccantggccgcactggaacccgctgnctnattgcagcagcaaatactactaccatttagccagctagctgcagcaaaccgtgctc

SEQ ID NO: 20143 - protein, 180 aa, Zea mays
  misc_feature: Ceres CLONE 1388205-F
  misc_feature (155)..(155): Xaa is any aa, unknown, or other
  misc_feature (160)..(160): Xaa is any aa, unknown, or other
  misc_feature (168)..(168): Xaa is any aa, unknown, or other
  misc_feature (169)..(169): Xaa is any aa, unknown, or other
MATKIFSLLMLLALSTCVANATIFPQCSQAPIASLLPPYLPSIIASICENPALQPYRLQQAIAASNIPLSPLLFQQSPALSLVQSLVQTIRAQQLQQLVLPLINQVALANLSPYSQQQQFLPFNQLSTLNPAAYLQQQLLPFSQLATAYSQQHNXLPLTXWPHWNPLXXCSSKYYYHLAS

SEQ ID NO: 20144 - DNA, 696 bp, Zea mays
  misc_feature: Ceres CLONE 1388206-F
  misc_feature: Encodes the peptide sequence at SEQ ID NO. 20145
  misc_feature (478)..(478): n is a, c, t, g, unknown, or other
  misc_feature (479)..(479): n is a, c, t, g, unknown, or other
  misc_feature (527)..(527): n is a, c, t, g, unknown, or other
  misc_feature (551)..(551): n is a, c, t, g, unknown, or other
tggcggccgctctagaactagtggatcccccgggctgcaggaattcgcacgagaccattacctagaacatcctaatcgaaaaaattgaaaacagggccttggtcgagttaaaaaaaacgcgagtgaaacacactgacaccgcaaacacgccaaccggcctaccgccttcttctcttgtctcgtcctcctcgcgactatggccgccgccgccgaggtagaccccagccccaacccgccgccaactacagcctccggcctctccaagaccaagacgcgggaggccgaccgccgccgacgccgccgcagcaaggccaagaagaacaagtccgtcactgaggctgatgcccaggacgctgacgggggagcttccagctccgacgccaaggagaacgccgatcccaaccccgaagcacaggttgaggtggagatagagtacgtgccggagaaaggcgagcttgacgaccctctcctggatgannttcagggccatctcgaggaagtcaccttcaaggacgctgctgcagcgncggccgaggatgataataaagacnagggtgccgctgatgccacaaagaaggggtcactggatgatgatgaccaccaccaaaatgatgagcaggaggcaaacaggaagaaggacgggggccatcccataaaaaaaaaaacttgaaccacgaatgaaaattgcaaacctca

SEQ ID NO: 20145 - protein, 157 aa, Zea mays
  misc_feature: Ceres CLONE 1388206-F
  misc_feature (94)..(94): Xaa is any aa, unknown, or other
  misc_feature (95)..(95): Xaa is any aa, unknown, or other
  misc_feature (111)..(111): Xaa is any aa, unknown, or other
  misc_feature (119)..(119): Xaa is any aa, unknown, or other
MAAAAEVDPSPNPPPTTASGLSKTKTREADRRRRRRSKAKKNKSVTEADAQDADGGASSSDAKENADPNPEAQVEVEIEYVPEKGELDDPLLDXXQGHLEEVTFKDAAAAXAEDDNKDXGAADATKKGSLDDDDHHQNDEQEANRKKDGGHPIKKKT

SEQ ID NO: 20146 - DNA, 707 bp, Zea mays
  misc_feature: Ceres CLONE 1388209-F
  misc_feature: Encodes the peptide sequence at SEQ ID NO. 20147
cgggctgcaggaattcgcacgagaccattacctagaacatcctaatcgaaaaacgggtcaccagtcaccacatccctccctcactgccatttgtttggttgttcctctcgctcgccagtcgccaccacagcagcaggcatcccaatctcgcgagagccagtagcggcggcggcgcttccggcttcccttcccattggcctccgggatggcgctccgcctccacgacgtcgcgctctgcctctccccgacgctcgccgcccgccgccgcagcggcggaagtttcgtcgccgtcgcctccatgacgtccgccgccgtctccaccagggtggagaacaagaagccatttgctcctccgagggaggcacatgtccaggctcaccattcaatgccatctcacaagattgaacttttcgagtcccttgatgattgggctaaagataatatcctggcacatctcaagccagtcgagaagcgctggcagccacaggaattccctccctgaccccgcatctgaaaggattcatggaggaagttaagcgggtccgaaaacgtggcaacgagcatccctgaggattattttggtttgtttgggtcggcgacctgagtactggggaaggctcccccaacattaccatattatgcctaacccccctccacggttggccgacgaggaaacagggggcaccccccccctgctttggcctgtt

SEQ ID NO: 20147 - protein, 98 aa, Zea mays
  misc_feature: Ceres CLONE 1388209-F
  misc_feature: SWISSPROT Homolog: EC 1.14.19.2 Acyl-[acyl-carrier-protein] desaturase
MALRLHDVALCLSPTLAARRRSGGSFVAVASMTSAAVSTRVENKKPFAPPREAHVQAHHSMPSHKIELFESLDDWAKDNILAHLKPVEKRWQPQEFPP

SEQ ID NO: 20148 - DNA, 828 bp, Zea mays
  misc_feature: Ceres CLONE 1388210-F
  misc_feature (264)..(264): n is a, c, t, g, unknown, or other
  misc_feature (281)..(281): n is a, c, t, g, unknown, or other
  misc_feature (282)..(282): n is a, c, t, g, unknown, or other
  misc_feature (288)..(288): n is a, c, t, g, unknown, or other
  misc_feature (291)..(291): n is a, c, t, g, unknown, or other
  misc_feature (748)..(748): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
aaagctggagctccccgcggtggcggccgctctagaactagtggatcccccgggctgcaggaattcgcacgagaccattacctagaacatcctaatccaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcanggagatggtgactgtgnnaggaanaangagctctagtgatcagacggcgacatgaggtacgtgagtgactcccccgcctacgatggccgtggtctccaacgccctcctggtgggttcgggtggaaggggtccaaaacccgtttgggaaactccacccgttttttcccggggccctttcaagagttggaaaagggttaaaggggttcccccttctttaccccaaagggggggggccccttggtcccccctaaagggggacaccctcccggggcccccccaaaaatttttttttttgagaaagggtgtcccaaaaaaaaaaaactcctttctccaaaggggggccccccccaaaaaaaaagaaagcacaaaaaggggggtttttttccgccgcgggggggtgtgttacaacaacaaaaaaaaaaaagaggggccccccccctctccttccacacaatggtggtgggtgggggggaaaaaaaaaaancnnnnnaaaaaaaaaataaaaaaaaaaacacacccccggggggggggtctccctttttgtggggggggggggggcgcctt

SEQ ID NO: 20149 - DNA, 722 bp, Zea mays
  misc_feature: Ceres CLONE 1388211-F
  misc_feature: Encodes the peptide sequence at SEQ ID NO. 20150
  misc_feature (377)..(377): n is a, c, t, g, unknown, or other
  misc_feature (378)..(378): n is a, c, t, g, unknown, or other
  misc_feature (409)..(409): n is a, c, t, g, unknown, or other
ggagctccccgcggtggcggccgctctagaactagtggatcccccgggctgcaggaattcgcacgagaccattacctagaacatcctaatcgaaaatcctcccccctcaacaaccgcgagatcttcagctaccgctctctccggtcgcgtttgcatccgcattcctcagatccagattcgagccccagccccgcttcgagatccagctagctctctatcaagcatccggcggagcgagcagcgggaggctcggcaagagagaagatgaagcggaagacgcggaacaagatcatcgtatggacgctggccctggctgcagtggcgattctggtgggtggcacgattgcgctggtgctcacggcggggacgtggaaggnncagataaagaagtcgcaggagaagatctggntacaggggtgggagtgctcggggagcaagtactgctggcacgacaccatcaccgacttcttcaaggtgtaccagttcgaagacctcttcgccaggggaaaaaccccgtcgggaagccggtggggttctggggactacagggctttattaccggcggggccctttcgaaccccagggggttttggccccccgggggaaagaaaatggaaaagggtggggctttgggcctccccgggggacgggggggcaaaattttttggtggaaaacggggggcaccgggggcccaaaaagggggggggggggggggaaaaaa

SEQ ID NO: 20150 - protein, 152 aa, Zea mays
  misc_feature: Ceres CLONE 1388211-F
  misc_feature (38)..(38): Xaa is any aa, unknown, or other
  misc_feature (49)..(49): Xaa is any aa, unknown, or other
MKRKTRNKIIVWTLALAAVAILVGGTIALVLTAGTWKXQIKKSQEKIWXQGWECSGSKYCWHDTITDFFKVYQFEDLFARGKTPSGSRWGSGDYRALLPAGPFRTPGGFGPPGERKWKRVGLWASPGDGGAKFFGGKRGAPGAQKGGGGGGK

SEQ ID NO: 20151 - DNA, 913 bp, Zea mays
  misc_feature: Ceres CLONE 1388213-F
  misc_feature (913)..(913): n is a, c, t, g, unknown, or other
ccaccccccccccccccgccgtcacccccccccccccacactaaacctgccgctccccgcggtggcggccgctctagactagtggatcccccgggctgcaggaattcgcacgagaccattacctagaacatcctaatcgaaaaaaatctaggtgactgctccgaattccgaaccttcatacacatcgtactcgtttccgatttccccaaattcaggccacaggcgctacaggagccaggctccactcggtcggcggccgccgcgccgccccgcctgctcgcttgggcccgcgcgagtgagaggacagaattgtgccgcgttaggaacgtgatatcttgtactcgcgtacaaagggccaacacgggcgccttgcacctacacctctggcctccgtctctgcgcgccatggcacacgtcctgatacccggcatatggcccgagcgcctttgtagtcacgacgtctaccaccactatcctacacagatcaatgggttacacacgcctgatgactatggcgtaaccgcggagcacaggtgataatgcactcatggggtgtccctacatctctcccacccgaagacgtcccccaaaagaagctcacttggcgtgcaaatcgtcacttttttgcatttgcacggaacctggtcccctaccgcaaagctgaacgaatttccggttaccaaattgaacgaagttgcgaacaaggtgtctgacacctctcccacgcccactgccacctgccgcgcacgagcctccacgggctacatctcgccgcggcttacctcaacgcaggtggcgcggcggcaccaagcgaccaggattcctccttgtgcggtcgccttgcgtcatgtcccactaaataactcttcctggggcgggcctaggcctccgaacgactcgtgacggagccgan

SEQ ID NO: 20152 - DNA, 748 bp, Zea mays
  misc_feature: Ceres CLONE 1388215-F
tggagctccccgcggtggcggccgctctagaactagtggatcccccgggctgcaggaattcgcacgagaccattacctagaacatcctaatcgaaaagtccctctcctctcgtccatccgttcctcccttcccctgcttcccgggtctccctcccccccatccctgcacgtcccttttcatgcgcaaggagggggcgcggacaccaccaccagcacctccatccgcgcgcatgtcgcggtggagctcctcctcctcctccccctgctcccggagcgggcgctctcctgttcctcctcctcctgccgctggtgccagcgtcccgagggcatccgcgaagctggcgctcaaggggatcaacgacaacggctcggcgcccaccgccaaccgccgtaatagtgaaaatggccacctccgatatggagtggccagatctcccgggaaaagagaatacatgcaggacttctatgaagcaaggctagacgattattcacggacagaaagttgtactgtccgaccgcgtaggatgatcatggagctactgctactttttgacaacaacaaaccaacacccttttcagcaaattcaatcccaccccccagagatcttctccgattccccggactacccattgttggaacccttgccgcctaatttaaattccacaaaccaccgaaaacctgactacccccccaaaaccgaaggagcgcggggtcccttcgcccccaaaagattaaataacgggggcg

SEQ ID NO: 20153 - DNA, 711 bp, Zea mays
  misc_feature: Ceres CLONE 1388227-F
  misc_feature: Encodes the peptide sequence at SEQ ID NO. 20154
  misc_feature (553)..(553): n is a, c, t, g, unknown, or other
gctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgagcggcaccagcaagctgacgcgggcgaggacggcgacagcggcgtggacgcctacgtctcccgctccggaaggggcgagtgccggcgccagtgcctgcgccgccacgagggccagtcgtgggagacccaggagtgcatgaggcggtgccgccgccgcggactggncgtcgacatggagcaagagtacggtcgcggcagcgagagcgcgggcaagtgcccgtgagaggtgcgagcgccaccaccccgggggactgggtgggagtaggaacggctggctgatggactggcaaaaccgggtagcgggaaggagtaggctggcaccg

SEQ ID NO: 20154 - protein, 73 aa, Zea mays; identical to SEQ ID NO: 14723
  misc_feature: Ceres CLONE 1388227-F

SEQ ID NO: 20155 - DNA, 693 bp, Zea mays
  misc_feature: Ceres CLONE 1388230-R
  misc_feature: Encodes the peptide sequence at SEQ ID NO. 20156
ccgattgggtaccgggccccccctcgaggtcgacggtatcgataagcttttttttttttttttttcatataagaagacaattctagaagaaaaagtatgaagatacaaaagcaaatcagtgtagttctcctgataattcttgatggatagctggatttacaacaactttaccaggggactagaaaaggacaaaaactcaagctccggcgtggtgatgactgatgagtacttgaacggttgagccacaaagatgatcaaggtagaaagagcagatatgcaacatatggtagatatcatattattatgtgcagctgttcgaccctgttaccgtggcatgtgaatcacacatctcaagcacttgttttctagcatcaactcaagcgctttgttgatttcattgaatggtatatcatgcgtgactaggccatcaacttggatttcctttgctgcatatttatccaccaatgaaggtagatcagatttaggtttccatcctccaaacatagatcccttcagtgttcttccggatagaagaaatgcataatgagtagacacttctagttttccttttggtaagccaagagttacagttactccccaaccctagcaagttggaaatgcaaatgaatagaagggaataggatatgtgaagtatgcatgtatggaaacaaaaggcatgacaagaaattacac

SEQ ID NO: 20156 - protein, 32 aa, Zea mays
  misc_feature: Ceres CLONE 1388230-R
RLGTGPPLEVDGIDKLFFFFFSYKKTILEEKV

SEQ ID NO: 20157 - DNA, 826 bp, Zea mays
  misc_feature: Ceres CLONE 1388230-R3
  misc_feature: SWISSPROT Homolog: EC 1.1.1.1 Alcohol dehydrogenase
  misc_feature: SWISSPROT Homolog: EC 1.1.1.90 Aryl-alcohol dehydrogenase
gacttctgggcgaaaagtatgaagaacaaaagcaaatcagtgtagttctcctgataattcttgatggatagctggatttacaacaactttaccaggggactagaaaaggacaaaaactcaagctccggcgtggtgatgactgatgagtacttgaacggttgagccacaaagatgatcaaggtagaaagagcagatatgcaacatatggtagatatcatattattatgtgcagctgttcgaccctgttaccgtggcatgtgaatcacacatctcaagcacttgttttctagcatcaactcaagcgctttgttgatttcattgaatggtatatcatgcgtgactaggccatcaacttggatttcctttgctgcatatttatccaccaatgaaggtagatcagatttaggtttccatcctccaaacatagatcccttcagtgttcttccggatagaagaaatgcataatgagtagacacttctagttttccttttggtaagccaagagttacagttactccccaaccctagcaagttggaaatgcaaatgaatagaagggaataggatatgtgaagtatgcatgtatggaaacaaaaggcatgacaagaaattacatcagaacatgattgaagtgcagtggagactactccagaatcacccacacattcaaatgagtaatccacccctccatcagtaatccttttgattacctgttgaacaggttcactcaattcatctgggttaataaagtccgtgacaccaaatgatttccccttttcttgcttctcaggattagtatcaactcctataatcttggacgcccctccc

SEQ ID NO: 20158 - DNA, 693 bp, Zea mays; identical to SEQ ID NO: 20155
  misc_feature: Ceres CLONE 1388230-R2
  misc_feature: SWISSPROT Homolog: EC 1.1.1.1 Alcohol dehydrogenase

SEQ ID NO: 20159 - DNA, 726 bp, Zea mays
  misc_feature: Ceres CLONE 1388230-F
ggagctccccgcggtggcggccgctctagaactagtggatcccccgggctgcaggaattcgcacgagaccattacctagaacatcctaatcgaaaaatgaatactcactcactccagcgtccactggccactgctcactgtccgacgaggaagtttcctcttcccaacccgaataaatcgaacccccaagggagagcgacgagcgatccccgaaattaaactgtcccacccgtaccgatcctccccccctcggactcggactccctccggacatgtaggtgttctactacccccagtcctttgcgctggtcgccgaacacgctgaaggtctagctcggttagagcgagataggaccttgagctcaccacctccgcagtatactccatcaagaaagagtatctgcctcttccacaccctcatgatgtacgatgactgggagaaaggtatcatacgttcactagctctacacacaatatgacttcgacgaggtcgacatccgacgcctcataatcgacggattctgatcctcatgatcttaaatacctcctcttccccctcaccgaccacaggtctcaacaggactgcgaccctatagaacatctatttccccgtgctcctcaacactccccaatacaggacctctgtcgccccatcataaggttcaaaaccctgacatcacgatattggccggacaagagaccctaagaaagttcactcagacacca

SEQ ID NO: 20160 - DNA, 595 bp, Zea mays
  misc_feature: Ceres CLONE 1388233-F
  misc_feature: Encodes the peptide sequence at SEQ ID NO. 20161
tccccgcggtggcggccgctctagaactagtggatcccccgggctgcaggaattcgcacgagaccattacctagaacatcctaatcgaaaaaagatccgatctccctctctctccccaatcctccccgcctccccgcctccccctaccaaatcagcaccacccaaggcgcatccgagccacggccgcgcaatgccgccctctgtcgatgcaatgccggcccccggagacgccgcgggcggcggcgacgtgcgcatgatctcctccagggaggctccgctctcacgcggtccggcggacgaactcttggatttccatttccggggaagggaaaacagtccgcctgggctccccccccccccggggggggaccccccgttttcccccctggggggggaagaacccccaaaaagttttttgcggtaaaaccccccctggggggcccgcccccccgcctgtttttttgtgggggcctcccagaaaaaagggtccccccccggggggaaaaaaaccgcccccccccggaaaataattccccggggggcctttataaaaggggggccccccccccccaagaaaatttttttggttttgtgg

SEQ ID NO: 20161 - protein, 77 aa, Zea mays
  misc_feature: Ceres CLONE 1388233-F
MPPSVDAMPAPGDAAGGGDVRMISSREAPLSRGPADELLDFHFRGRENSPPGLPPPPGGDPPFSPLGGEEPPKSFLR

SEQ ID NO: 20162 - DNA, 794 bp, Zea mays
  misc_feature: Ceres CLONE 1388239-F
  misc_feature: Encodes the peptide sequence at SEQ ID NO. 20163
tctgcactagtggatcccccgggctgcagtttccgcacgagaccattacctagaacatcctaatcgaaaaaattttctgaagcttgggcgccatctcggctcgcctccgtccatctctatggcgccacggggccaccacctggcggaggtggccctcctcgcctctgcttcgtcggacctcgcagccgcaggcgccggcgagagggaggggtggttggacgaccccgccatcctcgcctcggtcgggcgccgcgcgggatccctcgtagcggtgcagagcgaggcactagggcgctctcgaagactcgacaggtccgcgggggtttttttttttccccccccgggcggggggggggggggggttggagggattgagaggggacccccccgttgaggcgaaaaaaaacacgcccgagcggggccaggccgcgcgcctgtgaaacgggccgaggggaggggtacggcccaagagaccgtcctttggcggaggggtgtcggcttggtggatggtttataagcacagagcgcagagtggagcgtggatcccacggcgagaagggagcggcgcgccagcgtcgggaagtgggggcgacgggggcaggggagctaggaagggcggctgggagggtgcttgttgcgccgggtagcgcatgagaaggggcctggaatgggcgccgggacaggcgatactacggccggagtgaaccggaggcgcggagcagagcggccgccggccactggagggcgaggggagcaggggtggaacgcgtggtcgtcgggaggagacgcgggcg

SEQ ID NO: 20163 - protein, 91 aa, Zea mays
  misc_feature: Ceres CLONE 1388239-F
MAPRGHHLAEVALLASASSDLAAAGAGEREGWLDDPAILASVGRRAGSLVAVQSEALGRSRRLDRSAGVFFFPPPGGGGGGVGGIERGPPR

SEQ ID NO: 20164 - DNA, 661 bp, Zea mays
  misc_feature: Ceres CLONE 1388267-R
tcgaggtcgacggtatcgataagcttttttttttttttttttcttaaaagcgcaggggaactgctccttaaatatattaagaagaggaaaaaggtctatagcagaccagaggttacaacattaaactccttacggaggccagtaccgcacataagtgaaagagtccaaggaagccggactcaaaaaactactaaagtaaaaacaggggggttcagtgattaggcaaagaagctgccaagaaagagagacccttggccccagctaattcccaaactcttctctcgtcgtcagcctgccgaaggatagaggggagactgggagtctggccgtcaaacacgcatctgttgcggtgatttgagatcacccaggccctcaaagagatcagagaactcagacctttcttgaccattccttgaactggttcagaagctatcacgctgagaagactatccaacactgtctgactacctgtccccaccctggctctgcagggcctccttagccaccatttgtctgttggagtataggttgtgtttaagtcctgtagatgataagtgggtaagggttggtggtcctaaacaaaaaacacttgcccgtccgaccctgtatccagggttcccccccttagcctcctttcttcttataccaatgatggccggtt

SEQ ID NO: 20165 - DNA, 665 bp, Zea mays
  misc_feature: Ceres CLONE 1388272-F
  misc_feature (471)..(471): n is a, c, t, g, unknown, or other
  misc_feature (515)..(515): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaagtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacggggcagaccaactaccccggcgtggncggcaacggcgcgacgttctacttccctggtgtcgccatcctgnccgccgtggtgggcgcggcgtccaagctgggcggcgtgcaccacgtgcgcgcctggcgccacgacagcctggccaccaacgccgcgtcgtcgctcatcgcctggggcatcacgncgctcgcctttcggctggcctgcaaggagatccact

SEQ ID NO: 20166 - DNA, 851 bp, Zea mays
  misc_feature: Ceres CLONE 1388277-F
  misc_feature (22)..(22): n is a, c, t, g, unknown, or other
  misc_feature (23)..(23): n is a, c, t, g, unknown, or other
  misc_feature (45)..(45): n is a, c, t, g, unknown, or other
  misc_feature (46)..(46): n is a, c, t, g, unknown, or other
tttttctcttcctttttccccnnccccccccggcgcgggggcggnnttgggcaacactggtgctccccgcggtggcggccgctctataactagtggatcccccggggtgcaggaattctcacgagaccatacctagaacatcccaatcgaaaagttcctttcgtgccgcttcgtggtggcgccgtggcgcccaccaccacctcagctctctctctctcctcagctatatcgctactcaccagtccacacatccatggaatcgacctacactacaccgctcgcccggcgacgaccacggcgacagccgacagccaatccccaactaccctctgcacacaccccctgatccgtcgagctgcggctcatttctcgccgccgtcgtcacctcactaccccgcgccacggcactacacccccacaacctcaccgttgatgacccttcaccgacgctgagacctgggaccgttctcaggggcgccccctccgccgacgagaagctccgagggggcccctcaaccgacccccagaacagctccgtccttcaaaaatcatccccaccgctgccgccccctccttaacacgcccgaacttctctctaactttaatacggtcagggcactaatggtgcaaccactaccccccttttccggatccacccctggtcttaagcacttcattccacaaatatctccttaccaaccggcgtcggaggagctggtcatcaccaactcgcccttccaataaccggcttctatcgagaaggaggagaaaggacacaactccaaccctcgtgctcgatcgtctcaatccagcactccgccccacgcaatgcgccactccggcccgacaga

SEQ ID NO: 20167 - DNA, 661 bp, Zea mays
  misc_feature: Ceres CLONE 1388281-F
  misc_feature: Encodes the peptide sequence at SEQ ID NO. 20168
  misc_feature (584)..(584): n is a, c, t, g, unknown, or other
agagctggagctccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacnaggaccacggcggcgtgcacgacggcaccgccgtcgtgctctgggagtggtgcaagggcgagaacagagctggaaga

SEQ ID NO: 20168 - protein, 167 aa, Zea mays
  misc_feature: Ceres CLONE 1388281-F
  misc_feature (142)..(142): Xaa is any aa, unknown, or other
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDXDHGGVHDGTAVVLWEWCKGENRAGR

SEQ ID NO: 20169 - DNA, 674 bp, Zea mays
  misc_feature: Ceres CLONE 1388292-F
  misc_feature (201)..(201): n is a, c, t, g, unknown, or other
  misc_feature (609)..(609): n is a, c, t, g, unknown, or other
aaagctggagctccccgcggtggcggccgctctagaactagtggatcccccgggctgcaggaattcgcacgagaccattacctagaacatcctaatcgaagaattcactcctccctctgcctgtattcttcgtttcgcccctgggatcctcgtcacgactcacgccatccgcccccaccgccaccaccagccacaccatcntctgttctccagtcacgccagacggccagaacccacaattttcatcacaccaaaccatccactcctcacctttccccccaaacaagtccaatctttacaacgacattgtcgccaactacaacccctttcccttctgggtgcctcaccagattacccactcaaatccagctaccaagcacaaaagctgcggcatttgccatactgtttcatccgcggaacccaatcttgccgcccgatccttcgcaaaatcaccgtacgtgcttgctgcccctgtccagtccagactctagacaatgctgtctgcgccgtgggatccggagcgtgccagctaattccgctcgggaacacgcacgaggagatccgccagttcgcaagaagcgatattccatccacgccgttgcccctggntgctcgcgctcccccagctcccatggcggaaaacggagctgtccaaaaaaacgggggggtttggg

SEQ ID NO: 20170 - DNA, 550 bp, Zea mays
  misc_feature: Ceres CLONE 1388303-F
  misc_feature: Encodes the peptide sequence at SEQ ID NO. 20171
  misc_feature (137)..(137): n is a, c, t, g, unknown, or other
  misc_feature (301)..(301): n is a, c, t, g, unknown, or other
  misc_feature (466)..(466): n is a, c, t, g, unknown, or other
aaagctggagctccccgcggtggcggccgctctagaactagtggatcccccgggctgcaggaattcgcacgagaccattacctaaacatcctaatcgaaaagtccttgtgcgttccttgtagccatctccgactccngcgcctccgctgcctcccgaaagcattgccagttcctccgcacaacatgacgcgcatccaccgcctccgccccctcttcctcttcgttctcttggcgtcgctgcaatgcggtgcggcgaccgcggcggctggatcccgagggtgcgccgaggggttctgctcgncggagccgtccagcaagtgctcccggggatcagcccgtcttactggaaagggaacccattcccaccccctctgggccccggggaacctttcaaaaaaaattatccaccggggggtttccccccccccagggggggttttaaaaaggggaaacttttttttttttntttaaaaaaaaccccccacaagagagggggggttcccccccccctcccggggggggggggccccaccgggggggaaattttttt

SEQ ID NO: 20171 - protein, 94 aa, Zea mays
  misc_feature: Ceres CLONE 1388303-F
  misc_feature (40)..(40): Xaa is any aa, unknown, or other
MTRIHRLRPLFLFVLLASLQCGAATAAAGSRGCAEGFCSXEPSSKCSRGSARLTGKGTHSHPLWAPGNLSKKIIHRGVSPPPGGVLKRGNFFFF

SEQ ID NO: 20172 - DNA, 689 bp, Zea mays
  misc_feature: Ceres CLONE 1388309-F
  misc_feature: Encodes the peptide sequence at SEQ ID NO. 20173
  misc_feature (422)..(422): n is a, c, t, g, unknown, or other
  misc_feature (447)..(447): n is a, c, t, g, unknown, or other
  misc_feature (448)..(448): n is a, c, t, g, unknown, or other
aaagctggagctccccgcggtggcggccgctctagaactagtggatcccccgggctgcaggaattcgcacgagaccattacctagaacatcctaatcgaaaagccaagtattttttaactatacaatccaggaaggaagtcactgtcacttggtgagatcgatggcccgcgtcgccgccgtcctcgttgctctcctcgccctctttgccgtcgcggccacggcgcaggcccctgccgcgtcgcccaagcgcgccccagcccctgcgccacccaagatggcccctctcccgccgccgccgaccagggcccccatggcctccccgccctcgcctcccacgatgtcgccggcgtccgccccctccgccgacgctccagccacgagccccgccggtgcgggattttggcgacgcgatggcccccgncgggagcctccgctctgactccggnncgcgcgcccgtcacggagagagcacagccgcatctgccctcggcatcagcttcgtcggcatcgccggggctgtggaaccccccccggtcgtggtctaaacttccggaaatggatttgaagagttgcagttgcacctggaccgctctggtgttgtggaaaaaggccctcgtttgccccggtttccaaccctgggtaaattattaaatgggggggggggaattaaaaggttaaaacaaaatga

SEQ ID NO: 20173 - protein, 44 aa, Zea mays
  misc_feature: Ceres CLONE 1388309-F
  misc_feature (4)..(4): Xaa is any aa, unknown, or other
  misc_feature (13)..(13): Xaa is any aa, unknown, or other
MAPXGSLRSDSGXRARHGESTAASALGISFVGIAGAVEPPPVVV

SEQ ID NO: 20174 - DNA, 647 bp, Zea mays
  misc_feature: Ceres CLONE 1388311-F
  misc_feature: Encodes the peptide sequence at SEQ ID NO. 20175
  misc_feature (135)..(135): n is a, c, t, g, unknown, or other
  misc_feature (186)..(186): n is a, c, t, g, unknown, or other
  misc_feature (381)..(381): n is a, c, t, g, unknown, or other
ggggtcaccccgagccttcgggctgcaggaataacaaaaacaccattaggctagaacatcctaatcgaaaaaagatccgatctccctctctctccccaatcctccccgcctccccgcctccccctaccaaatcancaccacccaaggggcatccgagccacggccgggcaatgccgccctctgtcnatgcaatgccggcccccggagacgccgcgggcgggggagacgtgcgcatgatctcctccaaggagatccgctctcacgcgtccgccgacgacctctggatctccatctccggcgacgtgtacgacgtcacgccctggctcccccaccacccgggcggcgaccggcgcgggggtctcaccctggcggggcaggacnccaccgacgccttcggcgcctaccacccgccctcggggcggccgctcctccgccggttctttcgtggccgcctctccgactacgccgtctcccgcgggtgcgccgactaccgccgcctcctcgggcaggtatcctcccgggggccttcttcaaagcgtccggccccacccccaaggttccagctcctccctagagggcccggcctccttttatcgccggggtttggcctccggccctccgccgggggccaaaaggctcgggggggg

SEQ ID NO: 20175 - protein, 159 aa, Zea mays
  misc_feature: Ceres CLONE 1388311-F
  misc_feature (22)..(96): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
  misc_feature (6)..(6): Xaa is any aa, unknown, or other
  misc_feature (71)..(71): Xaa is any aa, unknown, or other
MPPSVXAMPAPGDAAGGGDVRMISSKEIRSHASADDLWISISGDVYDVTPWLPHHPGGDRRGGLTLAGQDXTDAFGAYHPPSGRPLLRRFFRGRLSDYAVSRGCADYRRLLGQVSSRGPSSKRPAPPPRFQLLPRGPGLLLSPGFGLRPSAGGQKARGG

SEQ ID NO: 20176 - DNA, 679 bp, Zea mays
  misc_feature: Ceres CLONE 1388317-F
  misc_feature: Encodes the peptide sequence at SEQ ID NO. 20177
ctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgcgcgcccgatgggtggagcaggtgaagggcatgctccacgacaaggggccgaccgcgtcgcaggcgctgacggtggtgacgctgttccccgctgggcgggctgctgctggtgctgtcggggctggcgctgacgggcctcccgtgggggggctggccgtgggccacgccggggttcctgatcttcagcccccgggcttcgtccccgccgcgctggtcatcgggaccggccgtcatgggggtccctcacggtcgggcgccctgggggctccggggccctggcccccgctcaagtggcctcggccaacacgggggggggaagggggttccaggggacccccgggactaagggggaaggaaggcccccccccaaggaagggccgaaggcccccgggccaacacccgggcccccaaaaaacccgcgccagg

SEQ ID NO: 20177 - protein, 132 aa, Zea mays
  misc_feature: Ceres CLONE 1388317-F
MLHDKGPTASQALTVVTLFPAGRAAAGAVGAGADGPPVGGLAVGHAGVPDLQPPGFVPAALVIGTGRHGGPSRSGALGAPGPWPPLKWPRPTRGGEGGSRGPPGLRGKEGPPPRKGRRPPGQHPGPQKTRAR

SEQ ID NO: 20178 - DNA, 694 bp, Zea mays
  misc_feature: Ceres CLONE 1388321-F
  misc_feature: Encodes the peptide sequence at SEQ ID NO. 20179
  misc_feature (372)..(372): n is a, c, t, g, unknown, or other
aaagctggagctccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactggtggccttaccgcttcanacgatgccagtgatgatgccacagatgatgaccgctaacatgatgtcaccattgatgatgccgagcatgatgtcaccaatggtcttgcccagcatgaggccccaaatgataatgccacaatggacctgggaagccctctccaaaattttgttgcaaacggagttaccctttctggtccacccaagggccctggacaattcccccccttgttttaaccaaaaccccttgggggggccgcctctcaaaaaaaaaaatatttggggggtcccaaaaaaggggtggccccccccctcccgggggcccttttttttaaaaaaaaacg

SEQ ID NO: 20179 - protein, 177 aa, Zea mays
  misc_feature: Ceres CLONE 1388321-F
  misc_feature (70)..(70): Xaa is any aa, unknown, or other
MAAKMLALFALLALCASATSATHIPGHLPPVMPLGTMNPCMQYCMMQQGLASLMACPSLMLQQLVALPLXTMPVMMPQMMTANMMSPLMMPSMMSPMVLPSMRPQMIMPQWTWEALSKILLQTELPFLVHPRALDNSPPCFNQNPLGGPPLKKKNIWGVPKKGWPPPSRGPFFLKKN

SEQ ID NO: 20180 - DNA, 653 bp, Zea mays
  misc_feature: Ceres CLONE 1388323-F
  misc_feature: Encodes the peptide sequence at SEQ ID NO. 20181
aaagctggagctccccgcggtggcggccgctctagaactagtggatcccccgggctgcaggaattcgcacgagaccattacctagaacatcctaatcgaaaagttcgcctttccaaaggaaaaacagagatagaatcctacctctctagcatggcgaccggcgacgaggcggagacggcggtgcgggcgtctgaggagttgcgggactggtccgacatgacgccagtgtgtcttgccgaagcgttctcgcggctggcgctggaggacctgtggcgcggcgccatgccgtgctgtcgctcctggcgggacgccgcgcgctcgcgcccgggactcttcgcggtgcttgacctcgagcccgggtttgctgagtccacacctggcgccgaggcggcagcgtggtggacgccctccttccagcgccgtgtcgacgccatggtgcgctccgcccgcacgttcgccgtgggggagctgtgtgagatccatgtcccgcactggttcgacgacgcgctcgccttccgcgccgagagatctcaaggactagtatccctttcgggcaaaactagcccggcagtaaccgatcgatcaaggtttattggcggagaatgctgccccatggtcacaaaattggacatcagcaactgctaccaaatttc

SEQ ID NO: 20181 - protein, 167 aa, Zea mays
  misc_feature: Ceres CLONE 1388323-F
MATGDEAETAVRASEELRDWSDMTPVCLAEAFSRLALEDLWRGAMPCCRSWRDAARSRPGLFAVLDLEPGFAESTPGAEAAAWWTPSFQRRVDAMVRSARTFAVGELCEIHVPHWFDDALAFRAERSQGLVSLSGKTSPAVTDRSRFIGGECCPMVTKLDISNCYQI

SEQ ID NO: 20182 - DNA, 630 bp, Zea mays
  misc_feature: Ceres CLONE 1388324-F
  misc_feature: Encodes the peptide sequence at SEQ ID NO. 20183
  misc_feature (295)..(295): n is a, c, t, g, unknown, or other
  misc_feature (310)..(310): n is a, c, t, g, unknown, or other
  misc_feature (311)..(311): n is a, c, t, g, unknown, or other
  misc_feature (319)..(319): n is a, c, t, g, unknown, or other
  misc_feature (322)..(322): n is a, c, t, g, unknown, or other
  misc_feature (337)..(337): n is a, c, t, g, unknown, or other
  misc_feature (407)..(407): n is a, c, t, g, unknown, or other
  misc_feature (498)..(498): n is a, c, t, g, unknown, or other
agagctggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcgncggaaaggaaagcgnntgaggcgncanctgcggagggcgcgnccaagggcgtgaggggggaaatcgggaaaggagaggtgagggagtatgaaagcgacatgaggaagctggnagagctgctttctaagctgaacccctcgccggaggagttcgtgccgccatcccgcccgcgcgtgaacgggggggctccccccgcttttcgncgaacggccccgggttcggggtcccccggaatttattaataacgggggcacccacaagttcccgcgggccgaattttttggaaaaaaaaaaacccaagggcacgggtttggaattttggggggggggccccc

SEQ ID NO: 20183 - protein, 98 aa, Zea mays
  misc_feature: Ceres CLONE 1388324-F
  misc_feature (19)..(19): Xaa is any aa, unknown, or other
  misc_feature (24)..(24): Xaa is any aa, unknown, or other
  misc_feature (27)..(27): Xaa is any aa, unknown, or other
  misc_feature (28)..(28): Xaa is any aa, unknown, or other
  misc_feature (33)..(33): Xaa is any aa, unknown, or other
  misc_feature (56)..(56): Xaa is any aa, unknown, or other
MVAVAVDGLIRGADAVPAXERKAXEAXXAEGAXKGVRGEIGKGEVREYESDMRKLXELLSKLNPSPEEFVPPSRPRVNGGAPPAFRRTAPGSGSPGIY

SEQ ID NO: 20184 - DNA, 653 bp, Zea mays
  misc_feature: Ceres CLONE 1388330-F
  misc_feature: Translation starting site: 448
gctcttgaactagtggatcccccgggctgcaggaattcgcacgagaccattacctagaacatcctaatcgaaaaaaccatttcttcttcctttttctatatcgcgttacgtccctccctacccagcgatctaggccgccgcctctcctactgcatctccctcgctctcgtcgcctcgttcgcttcgcctcctccccgccccgccccgagccgagcagagcgcagccctatccggagctgggatggcggacgcgaagcagcagcagcagcagccacagcaggcggcagcggcagccaccggcgtgtggaagacggtcaagcccttcgttaacggcgccccctctgggaggctcgcggacctgcgtcatccagcctatcgacatggtcaaggtgaggatccaattgggtgagggctccgctggtcaggtcacaaggaacatgcttgcaaatgaggggtgtccgttctttctacaagggtttgtctgccggattgctgaggcaagcgacgtacacgactgctcgtcttggatcctttaggggtctaactaacaaagcagttgaaaagaatgaaggggagccattgcctctaattcagaaagcttttattggtctggactggctggagcaattgggggcttgcccctgcacgccccg

SEQ ID NO: 20185 - DNA, 678 bp, Zea mays
  misc_feature: Ceres CLONE 1388331-F
  misc_feature: Encodes the peptide sequence at SEQ ID NO. 20186
  misc_feature (443)..(443): n is a, c, t, g, unknown, or other
  misc_feature (534)..(534): n is a, c, t, g, unknown, or other
  misc_feature (555)..(555): n is a, c, t, g, unknown, or other
  misc_feature (564)..(564): n is a, c, t, g, unknown, or other
aaagctggagctccccgcggtggcggccgctctagaactagtggatcccccgggctgcaggaattcgcacgagaccattacctagaacatcctaatcgaaaaagtttcccggctccctcgctcacgcgccgcggcatcactccggccggctggccagtcgcccactcttcccacccacaccgccgctgcctttccttccacggcgaactctccgcgggcgacgtccagactggcaacggcattccaataaaagaatgcgcccctgctctggccaactctctccacctgcattccccgttccgctaaaccctagccgcctccggcgcgtagtagattcgccatcagagacgacgctcggcggccctgaggagggatgacctacgtcaacccagacccccagccgctcgccgccgctacggcggatgattccgcaacccagcatncagctgcggtgaccgccgcgccgcagtcgacgcgaggcgctctcgggttttttgcgaacgcggagccgaagcagggcgcgaccatggtggncgcatcgtccccgcagggcgntcccggggntccgcggtcgtgcccagggcccagggggtcgaggacatagcgccccccgcggccccgcagggcctccgggggttttgggtgacgcccgggctcgggccacaggagggggctccg

SEQ ID NO: 20186 - protein, 76 aa, Zea mays
  misc_feature: Ceres CLONE 1388331-F
  misc_feature (24)..(24): Xaa is any aa, unknown, or other
  misc_feature (54)..(54): Xaa is any aa, unknown, or other
  misc_feature (61)..(61): Xaa is any aa, unknown, or other
  misc_feature (64)..(64): Xaa is any aa, unknown, or other
MTYVNPDPQPLAAATADDSATQHXAAVTAAPQSTRGALGFFANAEPKQGATMVXASSPQGXPGXPRSCPGPRGSRT

SEQ ID NO: 20187 - DNA, 682 bp, Zea mays
  misc_feature: Ceres CLONE 1388333-F
  misc_feature: Encodes the peptide sequence at SEQ ID NO. 20188
aagctggagctccccgcggtggcggccgctctataactagtggatcccccgggctgcaggaattcgcacgagaccattacctagaacatcctaatcgaaaaatccgggtagatgaggtccctccccactcgaggctccgagctttattttttcttgagctgctttgtctttcttgatacgagtaaccatatcttctggttcccgttcttcctcctcgtgtctctacctcgagtatatatcaatacagagatctgcggaggcaacgattcaagactcgaataagggaattctagatctaatcgactagcttgacacttgacagaacaagacatacctttgatatcgcatgaaccacttctcctccttcgccttcttgagccagctcagtatggctacaaccctgacagataccaccaagatgcttttgttatggaacgagtccaaggatctttgggcgaccctatggtgccacagactgaacaactccatgctgaggtggatcggtaccatactgcagatgaacatcgctttttcccacaatgcttgactgagtcactccttccccctattcaatacccacaggtactgaatcactgtgctgattcgataaacatcaactacgaaggtgtggaatgtgtacttcacacatcttcattccaccgtctgctctatccagagggag

SEQ ID NO: 20188 - protein, 84 aa, Zea mays
  misc_feature: Ceres CLONE 1388333-F
  misc_feature: SWISSPROT Homolog: EC 5.4.99.5 Chorismate mutase
MERVQGSLGDPMVPQTEQLHAEVDRYHTADEHRFFPQCLTESLLPPIQYPQVLNHCADSININYEGVECVLHTSSFHRLLYPEG

SEQ ID NO: 20189 - DNA, 685 bp, Zea mays
  misc_feature: Ceres CLONE 1388333-R
ccgattgggtaccgggccccccctcgaggtcgacggtatcgataagcttttttttttttttttttagtttacaattacttgcacatataatatataacaactattattttacaatacattcgaaattgcataatttcgtgaaaacgtattatccgtcttcggttctggaatatattttcctgcgaagcaaattccattattattcgaatacggtttgatatttgcaatttcattacaaatattcttgcgctccacggcggggtgcgtggagaccagccaaaagaaccaggagagcgccaccgaggagctgtcgcggccggcgaggatgaagttgagcgccacgtgctgcagcgcctcgtcggagtaggtccccttgcgcatgaagcgcgagaggaggtcgtcgtgcggcgtggccgagaggaggtccttcctcgtggcggcggcggcaaggaggcggagagctcgaggttgcgcgccttgatgacagccgagaggtagcggtcgacgtggcggacgctgcgcgccggcgtcgtctccatgccgaggcccagccacttcttgcagcgccagacgcactcggggaagatgaagcggttgagggtggcctccgtggcgcggtccaacgcggaggcgaaggcgttgtcggggaggcaccgggcgagcgtctcggggtccttcccgaagg

SEQ ID NO: 20190 - DNA, 691 bp, Zea mays
  misc_feature: Ceres CLONE 1388335-F
  misc_feature: Translation starting site: 276
agagctggagctccccgcggtggcggccgctctagaactagtggatcccccgggctgcaggaattcgcacgagaccattacctagaacatcctaatcgaaaaagttcagcacagcacatcttcctcgcagcgccggcgctccatcttccgctccctcccccaccttcgatcggcacgcaggctcggcgtcgtcgtcagcggttcctcctcccgcctctcgccagtagcctcgcgccctcgccgactggcgaccctgccttgaaggggctggcaagatgatcggcgtagggaaggcgaagcagtacgccaacgtccttgacaagcccctcagccgtggcaggcaggaggtcagtttgagtgcatttgcattcttggtctctgagttggttcagtacaaccagactcaagttgacaacatactgagctggaacggaggctggaggatgctggttatggctgtggtgcaagggtgcttgaactactctggcacagggagaagggaatagaccagagacccgacttctggggattttatcattccatccccaggactggtttggaaaagggttgtttggaaagggggcttgactcccttgaaaaggggaaccgaaccccgggggatgaatacctggttccggggaaaggggagttttcttggaaaccgggttactttttggggccaaaaaaaagg

SEQ ID NO: 20191 - DNA, 680 bp, Zea mays
  misc_feature: Ceres CLONE 1388338-F
  misc_feature: Encodes the peptide sequence at SEQ ID NO. 20192
  misc_feature (387)..(387): n is a, c, t, g, unknown, or other
aagctggagctccccgcggtggcggccgctctagaactagtggatcccccgggctgcaggaattcgcacgagaccattacctagaacatcctaatcgaaaagtcaaagcagagtctgcccctccccgcgccgttctttttggttccccagtccccgccgccgccgaaacccgcagatggaggtcgtcgtcgccgcgaagcagaaggcgaagaaacacatacacctcttctactgctcagaatgcgaggagctcgccctcaagatcgccgccagctccgacgccatcgagctccaatccatcaactggcggagcttcgacgacgggttcccgaacctgttcatcaacaaggcgcacgacatccgtgggcagcacgtggcgttcctggnctccttcagctcgccgtcggtcatattcgagcagatctccgtcatcttcgcgctgcccaagctattcatcgcctcattcacgctcgtgctgccattcttccccacgggctcattcgagcgcgttgaggaggagggcgatgtcgccaccgcggtcaccctcggggggattctctcgatgatccccaagtcgcggggcgggcctaccaggggtcgtcatctacgacatccacgcgctccagggagagggtttacttccgggacgatgtcctgccatgcttccaaacggggatccc

SEQ ID NO: 20192 - protein, 168 aa, Zea mays
  misc_feature: Ceres CLONE 1388338-F
  misc_feature: SWISSPROT Homolog: EC 2.7.6.1 Ribose-phosphate diphosphokinase
  misc_feature (71)..(71): Xaa is any aa, unknown, or other
MEVVVAAKQKAKKHIHLFYCSECEELALKIAASSDAIELQSINWRSFDDGFPNLFINKAHDIRGQHVAFLXSFSSPSVIFEQISVIFALPKLFIASFTLVLPFFPTGSFERVEEEGDVATAVTLGGILSMIPKSRGGPTRGRHLRHPRAPGRGFTSGTMSCHASKRGS

SEQ ID NO: 20193 - DNA, 628 bp, Zea mays
  misc_feature: Ceres CLONE 1388339-F
  misc_feature: Encodes the peptide sequence at SEQ ID NO. 20194
  misc_feature (527)..(527): n is a, c, t, g, unknown, or other
aagctggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcctcccattcaccaaactggntgaattaaactccgcggttaattttggaaaaaaataacctttcaggccgtttagttgttgccacccccccaaaatttttttcctttaccccaagggggggg

SEQ ID NO: 20194 - protein, 123 aa, Zea mays
  misc_feature: Ceres CLONE 1388339-F
MAAKIFCFLMLLGLSASAATATIFPQCSQAPIASFLPPYLSPAVSSVCENPILQPYRIQQAIAAGILPLSPLFLQQPSALLQQLPLVHLLAQNIKAQQLQQLVLGNLAAYSQQQQFPPIHQTG

SEQ ID NO: 20195 - DNA, 690 bp, Zea mays
  misc_feature: Ceres CLONE 1388341-F
  misc_feature: Encodes the peptide sequence at SEQ ID NO. 20196
  misc_feature (363)..(363): n is a, c, t, g, unknown, or other
  misc_feature (406)..(406): n is a, c, t, g, unknown, or other
  misc_feature (407)..(407): n is a, c, t, g, unknown, or other
  misc_feature (409)..(409): n is a, c, t, g, unknown, or other
  misc_feature (426)..(426): n is a, c, t, g, unknown, or other
agagctggagctccccgcggtggcggccgctctagaactagtggatcccccgggctgcaggaattcgcacgagaccattacctagaacatcctaatcgaaaagatgcgaccgccctcgctgctctccctcaccctcgacgccgcgctcctccgcatcgccaatatcgccgacctctcccacctcccagaccacctcctcatcgacctcttccgtagaaccctcagtgctggtaagctgacagagaaagttctcaagttgtttctagcaaccggctgtgaggatatcatattggctgttcggttgctcaaattaagcagccactcgtaccagtccttcccacgaggtgctctgagagattctanatctgctgccgccacgtcgttgtggatactgagaagatgcttnngnaactcaagaagggaggntgactagggatggggaactccaggccaactgagcattttcttaggggatggggaccattttcccccggttcacatcttggcggaaaagatcaaactggggaaagggtctccacccctggaggttttagccccagggttacccccagaaaaaattaagggggggttggggggccccccacccaaaaaattttgggggacccccgggggtatttttgggaattttgtcccccccgaagagaaggttgggttccgcgggggggcaac

SEQ ID NO: 20196 - protein, 109 aa, Zea mays
  misc_feature: Ceres CLONE 1388341-F
  misc_feature (87)..(87): Xaa is any aa, unknown, or other
  misc_feature (101)..(101): Xaa is any aa, unknown, or other
  misc_feature (102)..(102): Xaa is any aa, unknown, or other
  misc_feature (108)..(108): Xaa is any aa, unknown, or other
MRPPSLLSLTLDAALLRIANIADLSHLPDHLLIDLFRRTLSAGKLTEKVLKLFLATGCEDIILAVRLLKLSSHSYQSFPRGALRDSXSAAATSLWILRRCXXNSRREXD

SEQ ID NO: 20197 - DNA, 685 bp, Zea mays
  misc_feature: Ceres CLONE 1388343-F
  misc_feature (1)..(1): n is a, c, t, g, unknown, or other
  misc_feature (2)..(2): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (52)..(52): n is a, c, t, g, unknown, or other
  misc_feature (53)..(53): n is a, c, t, g, unknown, or other
nnttttccccccccccccnnnnanaccggggnannngggtnnntttttgggnnggggcaagctggagctccccgcggtggcggccgctctagaactagtggatcccccgggctgcaggaattcgcacgagaccattacctagaacatcctaatcgaaaagacgattccgatccactcccgtcccgtccatcccgtctcgtctcgcctcgccctccacgccggcgaccggagaaggggccgtgcagcggaggggacgcccacaacgaatccgtccccccgcgccggcttcgcccagccccgcggcgacgcaccaggattgaaggaggcatgagaaggtggacatcattgctatagcgatttgattactggagatggtgttggtggtaaagcagcaccgctgcacacactctgcgagctgcgtttgcatggggggggggtcagtgaggatgctctgttcctcgtcttcccgccacatgaactggaacccggagggtgattgctatcttggccgggggggggcaaggggggttgaccaaggttgcccaagaagggggtgggggaagggggtttctgggcatggaaggggctcccaaagaaggatgggggggattttgcgatttcgggggggggcagggccccatttttgttggagtgggggcacctggggaagaggcatttgtggggg

SEQ ID NO: 20198 - DNA, 678 bp, Zea mays
  misc_feature: Ceres CLONE 1388345-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (54)..(54): n is a, c, t, g, unknown, or other
  misc_feature (55)..(55): n is a, c, t, g, unknown, or other
  misc_feature (114)..(114): n is a, c, t, g, unknown, or other
nnnttttttcccccccccccccccccacccccccgcgccccccnnnnnnggggnnggggacagagctggagctccaccgcggtggcggccgctctagaactagtggatcccccngggctgcaggaattcgcacgagaccattacctagaacatcctaatcgaaaaaattccgcattcctctctgtcacctccgctgcgccgccagcccgccatcacataacttcgccttctatcccttcgtaaacccttctctcttcttcccgcggcctgctcgttcgatctgtccagcagacttgaaggttcccgagggggccgggaaaaccggggggggaaaaacggccgggggggggggggcccccggaaattgggggtttcggggggggggttgggaaaaaacgcaaaaaaaggggggccttgccgggggggggggcggccttattttggccgcggccggcccggaagaagagagaacagcgcggcgggggggggagggggggggggcgcgggggggagggggggggcgcggggggggcggagtggtggtggggggggcgccccccctcccccccccccccccccgcgggtgggggcggggggagccccctcccgcccccggggtggtcctctccgcgcgggcgcgcgcgcgcgcagaggacagggcgcaacccgcgcgggggg

SEQ ID NO: 20199 - DNA, 663 bp, Zea mays
  misc_feature: Ceres CLONE 1388348-F
  misc_feature: Encodes the peptide sequence at SEQ ID NO. 20200
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcgaaaacaagcatggacttgcaccttgcatggttgctcctactaagatcatagctggcttggggttgtcactggggattgatatccttgaagcacctggagcaactggagattaccgtactctcttaacttctaaagctaaagctatagccaaggcattatcttcccctatgggtacaccacctcgtgtttttgtgcctggagaggatgaatacaaagctggaaaagaaaatggatatgactttgggttcctgcacataaaggccattgatgatgctggtcatgatagggctgtcaagttaaaggtacggggtctagaagctgttgatcgagcttttggtcagcttgcaaggcttctttgggaagctgaagatgccggacactaccagtactttctgtgtgtcactggagaccattctactcctgttgaaatatggtgacatagcttcgaaccgggtccatttgcaatatgcagactgagaggatatgcaggaggcggtggggttgataatattataatacacagctggatgctttccccctgcgtccagnaaatgccggagagatt

SEQ ID NO: 20200 - protein, 136 aa, Zea mays
  misc_feature: Ceres CLONE 1388348-F
  misc_feature: SWISSPROT Homolog: EC 5.4.2.1 Phosphoglycerate mutase
MVAPTKIIAGLGLSLGIDILEAPGATGDYRTLLTSKAKAIAKALSSPMGTPPRVFVPGEDEYKAGKENGYDFGFLHIKAIDDAGHDRAVKLKVRGLEAVDRAFGQLARLLWEAEDAGHYQYFLCVTGDHSTPVEIW

SEQ ID NO: 20201 - DNA, 607 bp, Zea mays
  misc_feature: Ceres CLONE 1388352-F
  misc_feature: Encodes the peptide sequence at SEQ ID NO. 20202
  misc_feature (400)..(400): n is a, c, t, g, unknown, or other
  misc_feature (409)..(409): n is a, c, t, g, unknown, or other
aaagctggagctccccgcggtggcggccgctctagaactagtggatcccccgggctgcaggaattcgcacgagaccattacctagatcatcctaatcgaaaacccggcccgcgcctcgctctctcttgtctcgcccgctagctcccatcccagcctcccaccgcgcccgcctgccccaacatcccccctccccgctccgctccacgcacggctccagatctgctacggcggcggccggtggacgccgcgccgcgcgtgccgaaggcggtgacgtgagcggcggatcctgcccggccgtgccatcctggcgacgatgacagcgtaagcgggcgggggacgaccgcgcccccccgggccctactcccgaggtcattggggtgtggtccttggcagaaaatgnccatgatgntgaatccccccaatggcatgggcagtcaaggaaaacattactatactatgtggcagacactgtttgagatcgacaccaaggacgtgccgatcaagcccatcggaagaggagcttacggaatcgtttgctcatctgtaaaccgggagaccaatgaagaagtcgcgataaaaaagataacaaccgcttttacaaccgtgg

SEQ ID NO: 20202 - protein, 70 aa, Zea mays
  misc_feature: Ceres CLONE 1388352-F
  misc_feature: SWISSPROT Homolog: EC 2.7.11.24 Mitogen-activated protein kinase
  misc_feature (2)..(2): Xaa is any aa, unknown, or other
  misc_feature (5)..(5): Xaa is any aa, unknown, or other
MXMMXNPPNGMGSQGKHYYTMWQTLFEIDTKDVPIKPIGRGAYGIVCSSVNRETNEEVAIKKITTAFTTV

SEQ ID NO: 20203 - DNA, 678 bp, Zea mays
  misc_feature: Ceres CLONE 1388354-F
  misc_feature: Encodes the peptide sequence at SEQ ID NO. 20204
  misc_feature (397)..(397): n is a, c, t, g, unknown, or other
agagctggagctccccgcggtggcggccgctctagaactagtggatcccccgggctgcaggaattcgcacgagaccattacctagaacatcctaatcgaaaactctctgtgtcatcaccctcattccgacagttccgctagaaggaaaagaagaaaaaaaaactctctttctctctctttcccagccctctctctccctctccacccggccgccaccatgtcaggcctctacagccagggcttctcccctgcaagaaccctctcccccccgattaggagcaaccccgacgctgacagccagtacttggccgagcttctcgcggagcatcagaagctggggcccttcatgcaggtgctgccgatatgcagccgggtgggcggggagaaatcatgcggntatcaggcatggttcatgaccatggatttagtgatcttgacaggcgccgagttaaaagtcctagccctatgtcctcaccaattgcccgggctaatctacatggcaatggatttggtccttggaatgggatgcaccaagagagattgggctttcctcctcctggaacaagtatggactggcaaggagcaccaccaagccctggctcctatattgtcaagaagatcgttcggcttggagttcccgccgactcttaccctaatttcaactttggggagcggaat

SEQ ID NO: 20204 - protein, 105 aa, Zea mays
  misc_feature: Ceres CLONE 1388354-F
  misc_feature (12)..(12): Xaa is any aa, unknown, or other
MQPGGRGEIMRXSGMVHDHGFSDLDRRRVKSPSPMSSPIARANLHGNGFGPWNGMHQERLGFPPPGTSMDWQGAPPSPGSYIVKKIVRLGVPADSYPNFNFGERN

SEQ ID NO: 20205 - DNA, 710 bp, Zea mays
  misc_feature: Ceres CLONE 1388355-F
  misc_feature: Encodes the peptide sequence at SEQ ID NO. 20206
  misc_feature (1)..(1): n is a, c, t, g, unknown, or other
  misc_feature (2)..(2): n is a, c, t, g, unknown, or other
  misc_feature (11)..(11): n is a, c, t, g, unknown, or other
  misc_feature (12)..(12): n is a, c, t, g, unknown, or other
nnatttatttnnccccccccccccccccccccccccctcccccaagggaagcggggcaagctggagctccaccgcggtggggggcgctctagaataggggatcccccgggctgcaggaattcgcacgagaccattacctagaacatcctaatcgaaaattattgagaccaacaagcaacatagaagggggaatccagtagtaacaatagaggaacaatggggagcaggatattttccctccttatggtgctgtgctctttctacatgggggtgctaacgcggacaattttcccctcaatggtcgcgaggtcgtataggttccccttctgccccgataccttccatcaaattgataggttccggagggggaagggcggggtctgcaagcaatataggggggcaagcaggggaggggcagggagagaaacataccctttgttcgggcgggggggggggttgagacaaagggcgcagggccctaggctttgggcggggagggcggtgtgggaccgaagggcgttcgcgggggagaaaatggggtggggggccaacctgtcagggggagaccccgggggggcgggagcaaaggcagcccttctgggcaaaaaacgtcttttcttccgccaaaaaccgtgaaagaaaaaagaaggaaaaggggggggggggcggcagttggtgacaccgcagaagtgggtggggaaaaaagcgag

SEQ ID NO: 20206 - protein, 139 aa, Zea mays
  misc_feature: Ceres CLONE 1388355-F
MGSRIFSLLMVLCSFYMGVLTRTIFPSMVARSYRFPFCPDTFHQIDRFRRGKGGVCKQYRGASRGGAGRETYPLFGRGGGLRQRAQGPRLWAGRAVWDRRAFAGEKMGWGANLSGGDPGGAGAKAALLGKKRLFFRQKP

SEQ ID NO: 20207 - DNA, 672 bp, Zea mays
  misc_feature: Ceres CLONE 1388356-F
  misc_feature: Encodes the peptide sequence at SEQ ID NO. 20208
  misc_feature (154)..(154): n is a, c, t, g, unknown, or other
agagctggagctccccgcggtggcggccgctctagaactagtggatcccccgggctgcaggaattcgcacgagaccattacctagaacatcctaatcgaaaactccatcctaaaccctcctagtcctctccatccccatcccctccaatggcgngcgactgccacgtccttcgccactctcgccgtcgcgcgctcgggggggcagcggtccctccttgcctccaaggccgccccctcgccgctcctctccctccgcggggcccgcctcccctcgcagggcgtctccttatctgggggcctcgcggggtcgccctctcatagccgcgcgcgcttcgccacatcagccagcgccgagcccaaggaaccacaccttcagggggggggggagaaacaaggtgtactttcacataagcattgggaaccctgtgggcaagaatgttgggaggatcgtcatcggcttgtaccggggatgatgttccacagacaacagaagaacttccgggggtctttgcactgggagaagaaagggttttgggaaaacaagaggaaaccagggttcccatcggggggcatcaagggaacttttaatgaattcgggggcgggaaaatttttggacaaaggggcaaatgggcaacccggggggggaaaaaacataaatatagggacccccc

SEQ ID NO: 20208 - protein, 28 aa, Zea mays
  misc_feature: Ceres CLONE 1388356-F
MNSGAGKFLDKGANGQPGGGKNINIGTP

SEQ ID NO: 20209 - DNA, 573 bp, Zea mays
  misc_feature: Ceres CLONE 1388357-F
  misc_feature: SWISSPROT Homolog: EC 2.7.2.3 Phosphoglycerate kinase
aagctggagtccccgcggtggcggccgctctagaatagtggtcccccgggctgcaggattcgcacgagaccattacctagaacatcctaatcgaaaaacccgaagcacatcccgtcgcatcccatcccactaccacccatctcgtcgtccgccgattcgatccggttcttccaacccaggggcagtgatggcgacgaagaggagcgtgggaccctcggcgaggcggatctgaaggggaagaaggtgttcgtgcgcgccgacctcacgtcccgctcgacgatgcccagaaagatcacgacgacacccgcatccgcgcctccgtccccacatcaagttcctcctcgagaaggggcgccaggtcatccctcgcaggcagcgtgggtcgtcccaaagggtgtcaccccaaagtacagcttggaggcctctttgttcacgcttgggcggagctccttggaggtgaagtcgggatggccaaggattgcattgggggaaaaaaattaaaaatttgcttgcccgctttgccaaaaagggggggttccggtccctaaggaagtgttaaattctcaggggggg

SEQ ID NO: 20210 - DNA, 768 bp, Zea mays
  misc_feature: Ceres CLONE 1388358-F
  misc_feature: Encodes the peptide sequence at SEQ ID NO. 20211
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
nnncccccccccccccnnnnncccccccgcgccggnnnnttaggaggggggcaaggctggagctccccgcgggggcggccgctctagagtaggtggatcccccgggctgcaggaattcgcacgagaccattacctagaacatcctaatcgaaaaaagtgcagatcacactagcctacacacgccacgctccggctaaagctgacagcaggtcagcagcctagcgaagccaagacgtccgccgatctcagatggccgggagaagggtgcgcggcaacagtgccgtggccgtggccgtggctatggtgggcgtcgcgctgctggcgctgctcttcgcggggggcgagggccgacggggacgtgcaacgtcaaccggggcacggtgctgaggcagggggcgtcctgctcgagcgggcgcgccgaggccagggggggggctggggacggcgctgaggaagcgccgactttcggctgcctcgtgcgggagctactgggaaagaagcttcaagaaacgcggccctaaccgcggcggggccccggggccagtccctttccgcggggggaaccctccccgaaggccccgggtcgcccttaggaggggagagctgggaaggggccgggccccgcgagggggagacgggggggggttgggcccaagaggggaaaaaaggccgcttcggggcccggagcccgcgccccgggagggggcgtggggcccggtcataggggcccgggtctcctccccccgcgggggggggggcacggcctcg

SEQ ID NO: 20211 - protein, 45 aa, Zea mays
  misc_feature: Ceres CLONE 1388358-F
MAGRRVRGNSAVAVAVAMVGVALLALLFAGGEGRRGRATSTGARC

SEQ ID NO: 20212 - DNA, 626 bp, Zea mays
  misc_feature: Ceres CLONE 1388360-F
  misc_feature: Encodes the peptide sequence at SEQ ID NO. 20213
  misc_feature (438)..(438): n is a, c, t, g, unknown, or other
  misc_feature (480)..(480): n is a, c, t, g, unknown, or other
  misc_feature (575)..(575): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcgtaggacggagtgctcaaacgggaccgcaaggaggacctgcggtgctgcaagcaggcgtgccagtgtcaatacggacaggacaccccgcgaagagggaatgctagagcgagtgcctcgagcggcaccagcaagctgacgcggncgaggacggcgacagcggggtggacgcctacgtcttccgctncggaggtgcgagtgccggctccagtgcttgcgccggcacgaggggccagccgtgggagacccaggagtgcatggaggcggtgccgccgccggagnactggcccgtccacatggaccaaggattacggtccgaggaagcgaaaaggg

SEQ ID NO: 20213 - protein, 29 aa, Zea mays
  misc_feature: Ceres CLONE 1388360-F
MGKGSVGASWWAFLLLAGVLLVVAATAGA

SEQ ID NO: 20214 - DNA, 715 bp, Zea mays
  misc_feature: Ceres CLONE 1388362-F
  misc_feature: Encodes the peptide sequence at SEQ ID NO. 20215
  misc_feature (300)..(300): n is a, c, t, g, unknown, or other
  misc_feature (356)..(356): n is a, c, t, g, unknown, or other
aagctggagctccccgcggtggcggccgctctagaactagtggatcccccgggctgcaggaattcgcacgagaccattacctagaaaatcctaatcgaaaaggagcatcaccgttcactggataattcgctcgctccgctcgatgcccgcttgtttgcggtgaagcctccggcgaacagccgtagcggaaacgccgcccgagatgtctgctccctccgccccaccccgcacggtgatctgtgtgggcgacgtccacggctacatcacgaagctggagagcctctggtccaacctccaggncgcactccccgccgacgcctttcgcaccgcgctggtcatcttcctcggcgactacnacgacccgcgcccgcacacccgcagggtcctcgactttctccctcgggctccgaagcggtaccccgcgcagggcacgtcttcctctggcgaaacacgacctcggcttcccggggttccttcgggcgcttgccccccccccccaagttcccccgtttctggcacctgggacggtgaactccccaacagggaacccgggggggggttcccccggccccggtttcaagggcttttccctcaaaggaaggcgggtggcccggggccctccgagaaggggggacccccaaaaagggccccccccaaaaaagggtcccttttaaaagggggggcccccctttaaaaatcttgggggggccccccg

SEQ ID NO: 20215 - protein, 163 aa, Zea mays
  misc_feature: Ceres CLONE 1388362-F
  misc_feature (33)..(33): Xaa is any aa, unknown, or other
  misc_feature (52)..(52): Xaa is any aa, unknown, or other
MSAPSAPPRTVICVGDVHGYITKLESLWSNLQXALPADAFRTALVIFLGDYXDPRPHTRRVLDFLPRAPKRYPAQGTSSSGETRPRLPGVPSGACPPPPSSPVSGTWDGELPNREPGGGFPRPRFQGLFPQRKAGGPGPSEKGGPPKRAPPKKGSLLKGGAPL

SEQ ID NO: 20216 - DNA, 706 bp, Zea mays
  misc_feature: Ceres CLONE 1388367-F
  misc_feature: Translation starting site: 107
  misc_feature: SWISSPROT Homolog: EC 1.1.1.1 Alcohol dehydrogenase
  misc_feature: SWISSPROT Homolog: EC 1.1.1.284 S-(hydroxymethyl)glutathione dehydrogenase
ggagctccccgcggtggcggccgctctagaactagtggatcccccgggctgcaggaattcgcacgagaccattacctagaacatcctaatcgaaaaggtctaggccatgggcatgtccgcttcctcctcctcgggcgccctcctccgccggatcggcggcgcgctcctccgccgctccttctcctcctcatccgccgccgccgccgcagggtaccacgtcgcgggcgggcccagctacatgcgcggcgccgtcttctgggagcccggccgcccgctcacgctcgaggagttccgcgtgccgcgccccaagggcggcgagctcctcatcaagaccagaggcctgcggggtctgccactccgatctccatgtcctcggggggcgagctccctttctccgcgccctgtgtcgtgggccgtgagatcactgggagagggggttgaccatggcacgcacacctcctgctgagatcatcagcagggtcccagtcggaaggtcacgtcgtcggcggcttcataatgccgtgtgggaactgcttctactgcgttaaggggcaggaagatctgtgcgagtctttcttccgcgataatcgtggcaaggggacactctatgatggggagacccggctgtttctaagagcatggggaaaccgggtacttgaataggaggggagggcttgggaggaaattgggtggcccggcaatgggc

SEQ ID NO: 20217 - DNA, 810 bp, Zea mays
  misc_feature: Ceres CLONE 1388374-F
  misc_feature: Encodes the peptide sequence at SEQ ID NO. 20218
  misc_feature (1)..(1): n is a, c, t, g, unknown, or other
  misc_feature (29)..(29): n is a, c, t, g, unknown, or other
  misc_feature (36)..(36): n is a, c, t, g, unknown, or other
ngccccaagggcacgtacaaccgccttgnggggggngttatggtgtgtcatagttgggctccccttagtggcggccgctctatacatagtggatcccccgggctgcaggaatacccacgagaccattacctagaacatcttaatcgaaaaaacaccgccctcttgtgctctccctgtccctgccctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcaccgtgacgaagaaggccaccacgcccttcgacggccagaagcccggcacctcccggctccgcaagaaggttactgtattccagcagcccccattatctgcagaactttgtccaatcaacattcaaatgcccttcctgtggatcaagtaagaggggcaacaattgtttgtctctgggggatggccgcctatttctcaaaagatggtggttcaaatcataacaaaaatgccctgctggcaattggagtaacaacctgtttggggttggaacaaaacaggtctccatggcctacttcctgggtggaatctggctcgccatcccgcggaaaaaaagttggccgcataatggaaccaaaaggcctaactaggtggcctttcctctttggaagcgccgaggccctaaacccccagggggggcgcctaaagcggaatgcacatttctggggact

SEQ ID NO: 20218 - protein, 53 aa, Zea mays
  misc_feature: Ceres CLONE 1388374-F
  misc_feature: SWISSPROT Homolog: EC 5.4.2.2 Phosphoglucomutase
MGLFTVTKKATTPFDGQKPGTSRLRKKVTVFQQPPLSAELCPINIQMPFLWIK

SEQ ID NO: 20219 - DNA, 733 bp, Zea mays
  misc_feature: Ceres CLONE 1388375-F
  misc_feature: Translation starting site: 275
ctggagctccccgcggtggcggccgctctagaactagtggatcccccgggctgcaggaattcgcacgagaccattacctagaacatcctaatcgaaaaattagttcagcacagcacatcttcctcgcagcgccggcgctccatcttccgctccctcccccaccttcgatcggcacgcaggctcggcgtcgtcgtcagcggttcctcctcccgcctctcgccagtagcctcgcgccctcgccgactggcgaccctgccttgaaggggctggcaagatgatcggcgtagggaaggcgaagcagtacgccaacgtccttgacaagcccctcagccgtggcaggcaggaggtcagtttgagtgcatttgcattcttgttctctgagttggttcagtacaaccagactcaagttgacaacattactgagctggaacggaggctggaggatgctggttatgctgttggtgcaagggtgcttgaactactctgtcacagggagaagggaaatagacgagagacacgacttctgggcattttatcattcatccacagtactggtttggaaaaagtgtgtttggaaaggtggctgactcacttgaaaaggggacagaacacgaggatgaatacatgatcagtgaaaaggagcttctttgtaaccgtttcatttctgtgccaaaagacatggagcatttcactgtggagcttttggttgcggcattggaagggtgtattaaaa

SEQ ID NO: 20220 - DNA, 424 bp, Zea mays
  misc_feature: Ceres CLONE 1388376-F
  misc_feature (95)..(95): n is a, c, t, g, unknown, or other
  misc_feature (173)..(173): n is a, c, t, g, unknown, or other
  misc_feature (228)..(228): n is a, c, t, g, unknown, or other
  misc_feature (297)..(297): n is a, c, t, g, unknown, or other
  misc_feature (313)..(313): n is a, c, t, g, unknown, or other
  misc_feature (314)..(314): n is a, c, t, g, unknown, or other
ggagctccccgcggtggcggccgctctagaatagtggatcccccgggctgcaggaattcgcacgagaccatttacctagaacatcctaatcgaanaatctatcgcactcgtagtcgtagctcaagcatcagcggcaggagctctgggcagcgtgcgcacgtggggtacctagnctcgctctgctagccaacatggctgatcaccacggggtgcgacggaaggtgcggngctacgcgactccacgcgggcggatgcacgcagcgcacacacaagcagcgcctgatacgggtcaagcgnagccggaactcggggnnaaatttggttcccggttatctggccgaaccggattcccctcggggcccccccggttggttttcccgggtgttgggcgccgcccccttcttgggttttggggggggggttc

SEQ ID NO: 20221 - DNA, 725 bp, Zea mays
  misc_feature: Ceres CLONE 1388377-F
  misc_feature: Encodes the peptide sequence at SEQ ID NO. 20222
  misc_feature (273)..(273): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (429)..(429): n is a, c, t, g, unknown, or other
  misc_feature (430)..(430): n is a, c, t, g, unknown, or other
tggagctccccgcggtggcggccgctctagaactagtggatcccccgggctgcaggaattcgcacgagaccattacctagaacatcctaatcgaaaaatctacctcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcancagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgactcgcgnnnnnttnngggggggggcgccccccattcgggtggggtcattgggggggccgggttcggccccctccgggggcctccggggtcgctgggcttggccgggttctcctggaaggacaagtaacgtgagggggaagcaccgcgcggggggccgaccagctggaccacgccaaggcggagggtgggggtccaagggccggggacatccagggaggaggcacagaaccgaatcgaccaggggggaggggtttttgaaaaaaaaaccacattcgaggggaacgggggggggggcctccttggaaccacg

SEQ ID NO: 20222 - protein, 179 aa, Zea mays
  misc_feature: Ceres CLONE 1388377-F
  misc_feature (29)..(29): Xaa is any aa, unknown, or other
  misc_feature (79)..(79): Xaa is any aa, unknown, or other
  misc_feature (80)..(80): Xaa is any aa, unknown, or other
  misc_feature (81)..(81): Xaa is any aa, unknown, or other
  misc_feature (82)..(82): Xaa is any aa, unknown, or other
MADHHRGATGGGGGYGDLQRGGGMHGEAXQQQKQGAMMTALKAATAATFGGSMLVLSGLILAGTVIALTVATPVLVTRXXXXGGAPPIRVGSLGGPGSAPSGGLRGRWAWPGSPGRTSNVRGKHRAGGRPAGPRQGGGWGSKGRGHPGRRHRTESTRGEGFLKKKPHSRGTGGGASLEP

SEQ ID NO: 20223 - DNA, 736 bp, Zea mays
  misc_feature: Ceres CLONE 1388379-F
  misc_feature: Encodes the peptide sequence at SEQ ID NO. 20224
tggagctccccgcggtggcggccgctctagaactagtggatcccccgggctgcaggaattcgcacgagaccattacctagaacatcctaatcgaaaagcacaagtcacaacagaacaacctacccccacaagcagaaggatccgggcggccaccgagagtcactggaagaagctcgtccggcgccccgcgacgagacgacggcctcctcctccgctccgctgaagaacgacctccccgctgacagcgttggcgggccttgtagcgaggagggggtgcggaggcgccgcgactgttcgcgggatgagcttcggcggcagcagctccctcgcatcaggtgcgaagaggccgttcgagtacgggagaacgcatgtggtgaggcccaagggcacgcacaaggccaccattgtctggctccatggacttggggacaatggagccagctggtctcaactactggaaactcttccccttcctaatataaaatggatatgccccactgcaccttcaagacccgtgtcagtgttttggcgggttccctccacagcaatggtttgatgttgctgatctttctgaggatgctcctgatgacattggagggatcgatgcctcagcagacatgttgcgaaatttgtgtcactgaacctgtgacatccaacttggtgttgcgctttttaggatggtgctgctactgctctgtactcggcactttgcttgccatggaaaaaaatgggaatg

SEQ ID NO: 20224 - protein, 84 aa, Zea mays
  misc_feature: Ceres CLONE 1388379-F
  misc_feature: SWISSPROT Homolog: EC 3.1.1.1 Carboxylesterase
MSFGGSSSLASGAKRPFEYGRTHVVRPKGTHKATIVWLHGLGDNGASWSQLLETLPLPNIKWICPTAPSRPVSVFWRVPSTAMV

SEQ ID NO: 20225 - DNA, 738 bp, Zea mays
  misc_feature: Ceres CLONE 1388382-F
  misc_feature: Encodes the peptide sequence at SEQ ID NO. 20226
  misc_feature (563)..(563): n is a, c, t, g, unknown, or other
  misc_feature (564)..(564): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
aaagctggagctccccgcggtggcggccgctctagaactagtggatcccccgggctgcaggatttcgcacgagaccatttacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccggaaaagggcgagtgccggcgccagtgcctgcgccgccacgagggccagccgtgggagacccaggaatgcatganngcgtgccgccgccgcggactgggcgtcgactggagcaagagtacggtcgcggcagcgagagcgcgggcagtggcccgggagaagtgcgagcgccacaccgcggggacttgggtggaagagcacgctgctatgttnnnannnnnnnnnnnnngggnnnagaaaaaagagcccacc

SEQ ID NO: 20226 - protein, 174 aa, Zea mays
  misc_feature: Ceres CLONE 1388382-F
  misc_feature (116)..(116): Xaa is any aa, unknown, or other
  misc_feature (117)..(117): Xaa is any aa, unknown, or other
  misc_feature (162)..(162): Xaa is any aa, unknown, or other
  misc_feature (163)..(163): Xaa is any aa, unknown, or other
  misc_feature (164)..(164): Xaa is any aa, unknown, or other
  misc_feature (165)..(165): Xaa is any aa, unknown, or other
  misc_feature (166)..(166): Xaa is any aa, unknown, or other
  misc_feature (167)..(167): Xaa is any aa, unknown, or other
  misc_feature (169)..(169): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGKGRVPAPVPAPPRGPAVGDPGMHXXVPPPRTGRRLEQEYGRGSESAGSGPGEVRAPHRGDLGGRARCYVXXXXXXGXEKRAH

SEQ ID NO: 20227 - DNA, 666 bp, Zea mays
  misc_feature: Ceres CLONE 1388388-F
aaagctggagctccccgcggtggcggccgctctagaactagtggatcccccgggctgcaggaattcgcacgagaccattacctagaacatcctaatcgaaaaattcgcaccaccgccgcgccgcccaaatcacagccaccgccgccatggccgcctccagccgccctctcgtctccgtgaaggccctggagggcgacatggtcacggacgcccccggcatcgccttgccgcccgtcttcggtgcgccgatccgcccggacgtggtccgcttcacccacaagctgctgtcctgcaacaagcgccagccttacgcagtctcccgccgcgctggccaccagacgtcggccgagtcctggggtacgggccgcgctgtggcgcgggatcccccgcgtccccgggcggcggcacccaccgcgccggccagggagcattcggcaacatgtgccgcggcggacgcatgttcgcgcccaccaagatctggcgcaagtggcaccgccgcgtcaacgtcaacctccgccggcgtccccgtcgcctcgggggctcgccgccaccgccggcccggccctcgtccaggggcgcggccaccgcatccagaccgtcccagagatgccccctggtcatctctgaactcggggaagcccatcgagaagaacctccccagggggc

SEQ ID NO: 20228 - DNA, 740 bp, Zea mays
  misc_feature: Ceres CLONE 1388392-F
  misc_feature: Encodes the peptide sequence at SEQ ID NO. 20229
  misc_feature (553)..(553): n is a, c, t, g, unknown, or other
  misc_feature (568)..(568): n is a, c, t, g, unknown, or other
  misc_feature (740)..(740): n is a, c, t, g, unknown, or other
aagctggagctccccgcggtggcggccgctctagaactagtggatcccccgggctgcaggaattcgcacgagaccattacctagaacatcctaaaaaaaaatagctgaaatctctccacggatcgactctcctccctgccgcgcatgcgcgtcaatggcgccgccagtcgccggcgtcgtgcgtcttgccgcggcctcccgcgtattagttctgtccctctacctgctcgcccgcctcctcttgcgcccctacgacacctccgctactctccacccaccctgcctctcctctttctcctcttccccggatcccaacacgcccgtctccgccgctatctcgtcgctggccgtgtgggacggtgtccacttcgcccgccccgctgagtgcggctacgagtacgagcagtccttcgccttcctcccactcctccccgcctccctcgtgctcctcgcacgatcgttgttcgcgccgctagtaccgatactagggtacagggccgtgctcgtgctctccggctatgtccctcacaacgtcgcattcgttgctgctgcnggctacttctacagnatgtctgtgctgattttgaaagacagaaagctgcttaccgagctttctgtctgttttgtttcaccctgcttctgtattctactcatcattggattcagaaagtctttatgcacttttttctcttgggggcatcttctacgtggtttccgccttgctacagcatatgatgctn

SEQ ID NO: 20229 - protein, 195 aa, Zea mays
  misc_feature: Ceres CLONE 1388392-F
  misc_feature (138)..(138): Xaa is any aa, unknown, or other
MAPPVAGVVRLAAASRVLVLSLYLLARLLLRPYDTSATLHPPCLSSFSSSPDPNTPVSAAISSLAVWDGVHFARPAECGYEYEQSFAFLPLLPASLVLLARSLFAPLVPILGYRAVLVLSGYVPHNVAFVAAAGYFYXMSVLILKDRKLLTELSVCFVSPCFCILLIIGFRKSLCTFFSWGHLLRGFRLATAYDA

SEQ ID NO: 20230 - DNA, 676 bp, Zea mays
  misc_feature: Ceres CLONE 1388394-F
  misc_feature: Encodes the peptide sequence at SEQ ID NO. 20231
  misc_feature (355)..(355): n is a, c, t, g, unknown, or other
  misc_feature (367)..(367): n is a, c, t, g, unknown, or other
  misc_feature (368)..(368): n is a, c, t, g, unknown, or other
  misc_feature (579)..(579): n is a, c, t, g, unknown, or other
  misc_feature (583)..(583): n is a, c, t, g, unknown, or other
  misc_feature (591)..(591): n is a, c, t, g, unknown, or other
aagctggagctccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccggntcaaggacgagnnaagcatgccggcgttcgcgctcgtcaacaaggccacggggctcgcaatcaagcactccctcggccagtcccacccggtcaagctcgcgcctttcagcccggaccaggaggacgcgtcggtgcttgtgaacgagagcaaggacgtgggcaagggctcccgctgcatccgcatggtcaacaacacccgccctcacttcgacgccttccacggngacnaggaccancggcggcgtgcacgacggcaccggcgtcgtggctctgggagtggtgcaggggcgagaaccagagctgaaagatcctggcgggggg

SEQ ID NO: 20231 - protein, 172 aa, Zea mays
  misc_feature: Ceres CLONE 1388394-F
  misc_feature (66)..(66): Xaa is any aa, unknown, or other
  misc_feature (70)..(70): Xaa is any aa, unknown, or other
  misc_feature (142)..(142): Xaa is any aa, unknown, or other
  misc_feature (144)..(144): Xaa is any aa, unknown, or other
MSWFGHHHHNQPAPPASGPNQVFKIFCRANENYCLAVRDGAVVLAPVNPKDDHQHWYKDMRFSTRXKDEXSMPAFALVNKATGLAIKHSLGQSHPVKLAPFSPDQEDASVLVNESKDVGKGSRCIRMVNNTRPHFDAFHGDXDXRRRARRHRRRGSGSGAGARTRAERSWRG

SEQ ID NO: 20232 - DNA, 674 bp, Zea mays
  misc_feature: Ceres CLONE 1388395-F
  misc_feature: Encodes the peptide sequence at SEQ ID NO. 20233
aagctggagctccccgcggtggcggccgctctagaactagtggatcccccgggctgcaggaattcgcacgagaccattacctagaacatcctaatctaaaagcaattgtttccaggtaatctcgcatcagcaaacagcaccgggctccgttcaccgccttgccttctcttctccggttcctcccccgcgcgttcgctcgctctcgtggcgcaactcgtagaccgccgccgcctccgctctacgccaggtgcctaggtctagcttcgtcggtcccttcgccaacgacgagcacccacccgatctgacgccagaagttcagctaggagtgcatcttgtttacctgttgcttaatcatggacaactctcaaaatcaaccagccaccacctggtgttggaacatggccgcaggcacctcctagtcacccgccacaatgccatgctgatccacagtcttatcatccacaatttgctgctagacctgacaatgctagtgccaataatagtggtagttcagcaaacattgagtcagctgtccaggaggctgttcttcacgcgcaggacattgagactcagcaagtcatacagaatcaaagacatgcaaacacaacaagtgaacctacaaaatatgggggaagacttacttttcgagcggcgtgaccgtaatgcattggagg

SEQ ID NO: 20233 - protein, 79 aa, Zea mays
  misc_feature: Ceres CLONE 1388395-F
MLIHSLIIHNLLLDLTMLVPIIVVVQQTLSQLSRRLFFTRRTLRLSKSYRIKDMQTQQVNLQNMGEDLLFERRDRNALE

SEQ ID NO: 20234 - DNA, 747 bp, Zea mays
  misc_feature: Ceres CLONE 1388397-F
  misc_feature: Encodes the peptide sequence at SEQ ID NO. 20235
  misc_feature (434)..(434): n is a, c, t, g, unknown, or other
  misc_feature (438)..(438): n is a, c, t, g, unknown, or other
  misc_feature (439)..(439): n is a, c, t, g, unknown, or other
  misc_feature (451)..(451): n is a, c, t, g, unknown, or other
  misc_feature (498)..(498): n is a, c, t, g, unknown, or other
  misc_feature (556)..(556): n is a, c, t, g, unknown, or other
  misc_feature (607)..(607): n is a, c, t, g, unknown, or other
  misc_feature (621)..(621): n is a, c, t, g, unknown, or other
  misc_feature (625)..(625): n is a, c, t, g, unknown, or other
  misc_feature (645)..(645): n is a, c, t, g, unknown, or other
  misc_feature (719)..(719): n is a, c, t, g, unknown, or other
aaagctggagctccccgcggtggcggccgctctagaactagtggatcccccgggctgcaggaattcgcacgagaccattacctagaacatcctaatcgaaaaaaaaccccctcaaaatcctccgaaccccgccgccgacgagcgagctatggcgctggcgcggcggctgctccgccttactccctacctcggcacgctctcgctcccaccccccaactcgcatctcctccggaatcgcacctatatctctgacatgcgccgctctgccttcgtcgaccgcttgctccgttccgtacgctccgagatctccttcctcgataactccgccccgccaccgccaccaccgcctcctaagccattcaccattgaggaccgcccgggcgagcagtgggcccgcctgcgccgcgtgttctgcgggcccggaggggggaagnaaannagaggtcagggntggacgccacgttggtcgacggcgcgctccctccctcccgctcgggngcggacacgggcggcccgcccagaatgcatatcagtgttaaggttgaggtctccaggnccgcgcggcctggagtggcgctcaccttcgagtgctccgcgtggcctgacnagatggaggtgcgnaggntctttccccgtcgccgcgangggcctgccccagtgcagcagtacgtcggccgccaattcagtgaggtggatggagaaatgccaagtgccgtacnagactacctggagaaaattggagtggat

SEQ ID NO: 20235 - protein, 75 aa, Zea mays
  misc_feature: Ceres CLONE 1388397-F
  misc_feature (12)..(12): Xaa is any aa, unknown, or other
  misc_feature (29)..(29): Xaa is any aa, unknown, or other
  misc_feature (35)..(35): Xaa is any aa, unknown, or other
  misc_feature (41)..(41): Xaa is any aa, unknown, or other
  misc_feature (66)..(66): Xaa is any aa, unknown, or other
MHISVKVEVSRXARPGVALTFECSAWPDXMEVRRXFPRRRXGPAPVQQYVGRQFSEVDGEMPSAVXDYLEKIGVD

SEQ ID NO: 20236 - DNA, 780 bp, Zea mays
  misc_feature: Ceres CLONE 1388398-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (20)..(20): n is a, c, t, g, unknown, or other
  misc_feature (32)..(32): n is a, c, t, g, unknown, or other
  misc_feature (43)..(43): n is a, c, t, g, unknown, or other
  misc_feature (44)..(44): n is a, c, t, g, unknown, or other
  misc_feature (50)..(50): n is a, c, t, g, unknown, or other
  misc_feature (51)..(51): n is a, c, t, g, unknown, or other
nnnnnccccccccccccccnccctcccccccncggcggggggnncaggannccaaagctggggctccccgcggtggcggccgctctagaactagtggatcccccgggctgcaggaattcgcacgagaccattacctagaacatcctaatcgaaaagaggcctcccgtcgcggtggtcgctttcggccctggaccccgctgccggaatcgaatctcctcccctcctttctcctccgacctcccccttccccccctccgcgggtccgccccgacccgggacgccgcgcttcgcacccctctcgcatctccgccgcatctccgccgcgatcctcccgactagccgcgactgcctcccctccagcgggcagggagaggatggacgggggcaggcaagggatggcaaccccgttgagggaattatcggatttggcaaggactctcggaaattgggttcattcccggaaggtggaaaattaacggggggatatgcagccactgggaaccccaggggggggaaatccaggaatttctccaggccggccgggaaaaattcagaagcgcatgggggggatggggaaaaagaaaaggtttgaagggagagggtgagagaattgttgggggggggtattttagggcggtgccgccgtagtgagtcccggccccgctgttggagggttagtagaacccccccgggccggaaatatttaattggttgcttaacggaaggaagggtgtaggggggggggggggaattattttggagttgacgttggggtggggg

SEQ ID NO: 20237 - DNA, 620 bp, Zea mays
  misc_feature: Ceres CLONE 1388399-R
ccgattgggtaccgggccccccctcgaggtcgacggtatcgataagcttttttttttttttttttatcaaagatatttgtcacgcattggaagtggtggcaatgaacatttttacaatacatggatggcgatgcaatgctaggattgaggcctcttagtttcttattattgttcatgagaaccatgtgcttcattgctacttgttgctgcttttgtcaggttgaatatgctatgaagccatatgcatccttgatatgatgcaaaaggctggaacatgtttcttccattatcaaaaaaaaaaagctcccgccattgcatcgcacctccacaccaagcatgctcctttttccgtagacaatggatccatggcagcaagatgttcattcattccagtctgtgctgtccacaactctggtttcaaaccatccccgtgcacaactccaggaagcagcatagcatgcaaatgcatctgtggatgggggaagccttgcattgcacttgcactgccttcgttgggattccttggcaaacgatttccggattcgaacccccccccaaatctcaattttggaatcccattagggtttttcttcccctttaaaaaaaaatttccggttaga

SEQ ID NO: 20238 - DNA, 752 bp, Zea mays
  misc_feature: Ceres CLONE 1388399-F
  misc_feature: Translation starting site: 194
  misc_feature (694)..(694): n is a, c, t, g, unknown, or other
  misc_feature (718)..(718): n is a, c, t, g, unknown, or other
caaagctggagctcaccgcggtggcggccgctctagaactagtggatcccccgggcttgcaggaattcgcacgagaccattaccttgaacatcctaatcgaaaagaggacagagcagaggaccaccaccggaccgggctggagctggaggcgtggcggcgccggcgcgtccatcaggaggagaaggggcagggatggtgctgggcggcggcatggcggcagcggccgtaggcggggacgacgccgtcgtcatgcagctgggcggcgccgagggcgaggagaccgtcgtcaccgtcaactgccccgaccagacaggcctgggctgcgacctctgccgcaccatcctcgagttcggcctccgcatcacccgcgccgatgtgacgcacatactatcggatctggagctcataatccacagggtgaaggtgtcgaccacaccggacgggaagagttgtggacctcttctttatcactgatggcatggaactgctgcacagaaaggagaggcaagaggagacctgctcggcgctaactgcaaccctgggcccttcatccagctgcgaggtcgaccagcagagggttccccagcaggggttctcttcctccccgccggagatcgccgagggactgggtcagggcggagctagctgaccttggaacggcgaggtgtgctcgagcccgctcagcgcgaaaanttggaggaaagttccggacgacgnccactgtcaacttcgacactccctgagccggggg

SEQ ID NO: 20239 - DNA, 677 bp, Zea mays
  misc_feature: Ceres CLONE 1388400-F
  misc_feature: Translation starting site: 201
  misc_feature (581)..(581): n is a, c, t, g, unknown, or other
  misc_feature (607)..(607): n is a, c, t, g, unknown, or other
  misc_feature (615)..(615): n is a, c, t, g, unknown, or other
  misc_feature (616)..(616): n is a, c, t, g, unknown, or other
aaagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcgggcggcggtggcgcacgcgttcgcgctgttcgtggcggtgtctgtgggcgcgaacatctccggcgggcacgtgaaccctgccgtgaccttcggcgccttcgtgggcggcacatcaccctgttcccggggctcctgtactgggtggcgcagctgctggggtccaacgtgggcgtgctcctgctccggctctcgacgggcggncagccacgggcacttcggctgagggncgggcccnngtgggaagggctgggcccttggaatcgtgatgaccttccggctggggaaacgtgacccccc

SEQ ID NO: 20240 - DNA, 743 bp, Zea mays
  misc_feature: Ceres CLONE 1388403-F
  misc_feature: Encodes the peptide sequence at SEQ ID NO. 20241
  misc_feature (641)..(641): n is a, c, t, g, unknown, or other
  misc_feature (642)..(642): n is a, c, t, g, unknown, or other
caaagctggagctcaccgcggtggcggccgctctagaacaagtggatcccccgggctgcaggaattcgcacgagaccattacccagaacatcctaatcgaaaacactgaaacgaaattaccctatagggatgagatttaaaatgaggtttgaaggtgaagaggctccagaacaaaggttcactgggaccattgttggaaatgtggatcctgatcaagctggatgggctgaatctaaatggcgttacctcaaggtgaggtgggatgaagcttcctccattccacgtcctgaaagggtttctccctggcaaatagaacctgcagtcagccctccccctatcaacccgcttccagtgcacagacccaagagaccgcgctctaatgctgtagcttctctgcccgagtcttcagctccaacaaaagaagctgctccaaaggtcacattagagactcaacaacatgccctgcaaaggcccttgcagacccaggataatgtggccccgaaaagtgtttttggtgataacagtgaattggactctgctcataagtcctccctgcgaccgtcaggttttgatctggacaagagcaccattggcatgcagaaggaagctgggttcagatatttggatgcgaatgaacaggnnctgatggtacagtgaaatgttatcgggatatcaccccacctatgagatgtcggaatttcccccagggtttctggtctttacctgatcaagattgcggctgg

SEQ ID NO: 20241 - protein, 175 aa, Zea mays
  misc_feature: Ceres CLONE 1388403-F
  misc_feature (1)..(41): Pfam Name: Auxin_resp Pfam Description: Auxin response factor
  misc_feature (171)..(171): Xaa is any aa, unknown, or other
MRFKMRFEGEEAPEQRFTGTIVGNVDPDQAGWAESKWRYLKVRWDEASSIPRPERVSPWQIEPAVSPPPINPLPVHRPKRPRSNAVASLPESSAPTKEAAPKVTLETQQHALQRPLQTQDNVAPKSVFGDNSELDSAHKSSLRPSGFDLDKSTIGMQKEAGFRYLDANEQXLMVQ

SEQ ID NO: 20242 - DNA, 763 bp, Zea mays
  misc_feature: Ceres CLONE 1388404-F
  misc_feature: Encodes the peptide sequence at SEQ ID NO. 20243
  misc_feature (346)..(346): n is a, c, t, g, unknown, or other
  misc_feature (364)..(364): n is a, c, t, g, unknown, or other
  misc_feature (373)..(373): n is a, c, t, g, unknown, or other
  misc_feature (374)..(374): n is a, c, t, g, unknown, or other
  misc_feature (400)..(400): n is a, c, t, g, unknown, or other
  misc_feature (522)..(522): n is a, c, t, g, unknown, or other
aaagctggagctccccgcggtggcggccgctctagaactagtggatcccccgggctgcaggaattcgcacgagaccattacctaagaacatcctaatcgaaaaacgcacctcccgacttctccggttctcccttcttcatagcagccacccacgcatctcagcgccgaggcgagcgaggacctcgtggttcgtgccctgctcacctcgtgaggatgtggatcgcgaggcggctcttcctcgcggcggcggcgctgctgatggctgtgcttctgctcgtcgcggggccggtggcggcgcaggacgcggcggtggagggcgtggccccgcctggcgaggagatcgcgncgaacgcgagggccaggnagggcgcgnntctggcccgcgagctagtgcagctcnaggcgaagatctccgcgttagagtctcgcattgcagagcagaacctggagtttcagaccaggatgatggcatcgaaacctggatatgattgtccaggaaagtcaccgaaaatgctacattcnaaaggagttacttccctcgggccaaagggtctttaactggaagggaccaggaaagaaaggcaaggccctgggttttggggtccaaaaaccaaccggaagtttcgaaggggttttccaaaaaaaaaatttaaggcccctttaggggttaggtttgaatttttataaaagaggggaaaaataaatttaatgtggaaaacccccaagaaaagtggttataaggcgggtttattaaattggatgt

SEQ ID NO: 20243 - protein, 114 aa, Zea mays
  misc_feature: Ceres CLONE 1388404-F
  misc_feature (45)..(45): Xaa is any aa, unknown, or other
  misc_feature (51)..(51): Xaa is any aa, unknown, or other
  misc_feature (54)..(54): Xaa is any aa, unknown, or other
  misc_feature (63)..(63): Xaa is any aa, unknown, or other
MWIARRLFLAAAALLMAVLLLVAGPVAAQDAAVEGVAPPGEEIAXNARARXGAXLARELVQLXAKISALESRIAEQNLEFQTRMMASKPGYDCPGKSPKMLHSKGVTSLGPKGL

SEQ ID NO: 20244 - DNA, 748 bp, Zea mays
  misc_feature: Ceres CLONE 1388409-F
  misc_feature: Encodes the peptide sequence at SEQ ID NO. 20245
  misc_feature (400)..(400): n is a, c, t, g, unknown, or other
  misc_feature (401)..(401): n is a, c, t, g, unknown, or other
  misc_feature (484)..(484): n is a, c, t, g, unknown, or other
  misc_feature (490)..(490): n is a, c, t, g, unknown, or other
  misc_feature (491)..(491): n is a, c, t, g, unknown, or other
  misc_feature (587)..(587): n is a, c, t, g, unknown, or other
  misc_feature (716)..(716): n is a, c, t, g, unknown, or other
  misc_feature (717)..(717): n is a, c, t, g, unknown, or other
  misc_feature (721)..(721): n is a, c, t, g, unknown, or other
  misc_feature (735)..(735): n is a, c, t, g, unknown, or other
aagctggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaagcnnagagcgagtgccgcgagcggcaccagcaagctgacgcggggcgaggacggcgacaggcggcgtgggacgcctacgtctcccgnctcggnnaagaggggcggagtgcccggcgccagtggcctgcgcccgccacgaagggccaggccgtgggaggacccaggagtggcatggagggcggtgccgccngccgcgggactggccgtcgacatggaggcaagagtacggtcgcggcagcgagagcgcgggcaggggccgggagaggtgcgagcgccacaccgcggggacttggtgggagaggcaggctgctgagatggnnaaanccccgggagggggnaagaggaaggcgc

SEQ ID NO: 20245 - protein, 179 aa, Zea mays
  misc_feature: Ceres CLONE 1388409-F
  misc_feature (64)..(64): Xaa is any aa, unknown, or other
  misc_feature (94)..(94): Xaa is any aa, unknown, or other
  misc_feature (126)..(126): Xaa is any aa, unknown, or other
  misc_feature (169)..(169): Xaa is any aa, unknown, or other
  misc_feature (170)..(170): Xaa is any aa, unknown, or other
  misc_feature (175)..(175): Xaa is any aa, unknown, or other
MGKGSVGASWWAFLLLAGVLLVVAATAGAEDGVVERDRKEDLRWCKQACEWQYGKDTPRKREAXSECRERHQQADAGRGRRQAAWDAYVSRLGXEGRSARRQWPAPATKGQAVGGPRSGMEGGAAXRGTGRRHGGKSTVAAARARAGAGRGASATPRGLGGRGRLLRWXXPREGXRGRR

SEQ ID NO: 20246 - DNA, 745 bp, Zea mays
  misc_feature: Ceres CLONE 1388410-F
  misc_feature: Encodes the peptide sequence at SEQ ID NO. 20247
  misc_feature (318)..(318): n is a, c, t, g, unknown, or other
  misc_feature (378)..(378): n is a, c, t, g, unknown, or other
  misc_feature (386)..(386): n is a, c, t, g, unknown, or other
  misc_feature (405)..(405): n is a, c, t, g, unknown, or other
  misc_feature (568)..(568): n is a, c, t, g, unknown, or other
  misc_feature (583)..(583): n is a, c, t, g, unknown, or other
aagctggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcgncagctgcggaggcggcgcccaagggcggtgagggggaaatcgggaaagggagagtgaggnagtatganagcgacatgaggaagctgnaggagctgctttctaagctgaacccctcggcggaggagttcgtgccgcaatccccgccgccgcgtggacgggggcgcttcccggctttcgggcgacggcgccgggttcgtgtccccggggattaattactagggggggccacaccagttcccggcggcggagnttttggaaaaaaaanaacccaatgcacgtggttgaattttggggggggcgccccccgggttttgccttgggtggggcgccgggggtatggaactccgaaagggggggttccccccttggggcccccgaatccccggggaaaagaacggttttcttcccgggggggagaaaagggtgt

SEQ ID NO: 20247 - protein, 96 aa, Zea mays
  misc_feature: Ceres CLONE 1388410-F
  misc_feature (57)..(74): Pfam Name: PAM2 Pfam Description: Ataxin-2 C-terminal region
  misc_feature (27)..(27): Xaa is any aa, unknown, or other
  misc_feature (47)..(47): Xaa is any aa, unknown, or other
  misc_feature (49)..(49): Xaa is any aa, unknown, or other
  misc_feature (56)..(56): Xaa is any aa, unknown, or other
MVAVAVDGLIRGADAVPAAEREAVRAXAAEAAPKGGEGEIGKGRVRXYXSDMRKLXELLSKLNPSAEEFVPQSPPPRGRGRFPAFGRRRRVRVPGD

SEQ ID NO: 20248 - DNA, 762 bp, Zea mays
  misc_feature: Ceres CLONE 1388415-F
  misc_feature: Translation starting site: 184
  misc_feature: SWISSPROT Homolog: EC 6.3.2.19 Ubiquitin--protein ligase
  misc_feature (448)..(448): n is a, c, t, g, unknown, or other
aaagctggagctccccgcggtggcggccgctctagaactagtggatcccccgggctgcaggaattcgcacgagaccattacctagaacatcctaatcgaaaaatcaattcgtgtcaccgcgtcccgagagcgcaaatcattccgcgcgacgcaaaaaccctagcccagccaccgatccctctcatggcaaccaccaccacccaggcgagcctcctcctccagaagcagctaagagatctcgcgaagcacccggtggatgggttctctgctgggctggtcgacgacagcaatgtcttcgagtggcaggtcaccatcatcggaccgcctgacactctatatgatggaggttacttcaatgcaataatgagcttcccacaaaattacccaaacagcccgccatcagtcagatttacctctgaaatgtggcatccaaatgtctatcctgatngggcgggtttgtatctctattcttcatccacctggtgaagatcccaacggttatgagctcgcaagtgagcgatggacacctgtgcacacagtaaaaagcatagttctgagcattatatcaatgctctctagtccaaatgatgagtctcccagcaacattgaggcagctaaggaatggagggaacagagggaggattcaagaaaaaggtaaggccgcatcgtgcggaatcacaggaaatggtctgagggaaatgggagtcctgggtgaagtaaccaatgccatgtcaggctggaggattttgctgccaatctcaa

SEQ ID NO: 20249 - DNA, 739 bp, Zea mays
  misc_feature: Ceres CLONE 1388416-F
  misc_feature (388)..(388): n is a, c, t, g, unknown, or other
  misc_feature (470)..(470): n is a, c, t, g, unknown, or other
  misc_feature (530)..(530): n is a, c, t, g, unknown, or other
  misc_feature (533)..(533): n is a, c, t, g, unknown, or other
  misc_feature (638)..(638): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaacattctcttcatctcctccacaattgattgaagtgataatatttgatgaaagctaatctgtttttcttgcaaacaagacatgagagttcttggttatgtatttatatatatctgaatctgctatctttctcgcacatgctaattcatcatgcataccacatctaatttgttatttgtagtttcaagcctcaatattatgcgaagtctatgagacaggataaattttattgaatagctttctaaatttacagtatcgacaatatcaatttagtgctatgcttataanagcaaagatgtcgttgttatgacttatatctgtatgatgcctaggttttgtttggaaaataatgtcagaaaagtgcattgtnggtctctttgtctgctgcccttgtttccaccttggtaaatatttttcctggtctcaaagntgncatcagtttttcagttttcttatgcactgctaacacttctcttcagtctatttgacttggcgtgtcagttgttatactatcagcttttgcgtttcatgttggcangacaagttagggccttcattgaaagtactgntgacagcgacgtgcttgtgctgaatgtcccagacccgttccagagctgcttcttgcacggtgttgtgatt

SEQ ID NO: 20250 - DNA, 638 bp, Zea mays
  misc_feature: Ceres CLONE 1388422-F
  misc_feature: Encodes the peptide sequence at SEQ ID NO. 20251
  misc_feature (560)..(560): n is a, c, t, g, unknown, or other
aaagctggagctccccgcggtggcggccgctctagaactagtggatcccccgggctgcaggaattcgcacgagaccattacctagaacatcctaatcgaaaaacatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgcggccgggacggtgggcttcttctggctggtgaaccacggcgtggcggaggagctgatgggcggcatgctccgcggggtgcgccagttcacaggggcccccgtggaaggcgaagcaggcgctctactccagggactggnctcgcaacctgcgctttcggctcccacttcgaccctcttcagggccgctggcggccgactggcgcgaccgtccttttt

SEQ ID NO: 20251 - protein, 163 aa, Zea mays
  misc_feature: Ceres CLONE 1388422-F
  misc_feature: SWISSPROT Homolog: EC 1.14.11.20 Desacetoxyvindoline 4-hydroxylase
  misc_feature (138)..(138): Xaa is any aa, unknown, or other
MAPTTATKDDSGYGDERRRELQAFDDTKLGVKGLVDSGVKSIPSIFHHPPEALSDIISPAPLPSSPPSGAAIPVVDLSVTRREDLVEQVRHAAGTVGFFWLVNHGVAEELMGGMLRGVRQFTGAPVEGEAGALLQGLXSQPALSAPTSTLFRAAGGRLARPSF

SEQ ID NO: 20252 - DNA, 730 bp, Zea mays
  misc_feature: Ceres CLONE 1388425-F
  misc_feature: Encodes the peptide sequence at SEQ ID NO. 20253
  misc_feature (565)..(565): n is a, c, t, g, unknown, or other
  misc_feature (659)..(659): n is a, c, t, g, unknown, or other
  misc_feature (730)..(730): n is a, c, t, g, unknown, or other
agagctggagctccccgcggtggcggccgctctagaactagtggatcccccgggctgcaggatttcgcacgagaccattacctagaacatcctaatcgaaaaatgacaccgcgtgccccgcagcttcggcatcacccgccgcacctcctcctcgccgaggctgtcgcctcctggcaccccttccacaagaagccctgtctcacggaccgctccacggctcccccctcctcggcccgcctccctgatgcggagactccgacgcctgccctctcggggggcggtagcggcggatccttccggtggttcgggctccgcaagcggcgccgccgcggtccgggctcgcggtccgtgtccggccgcagcagcgaccgccggagatccggcacgtgctccgacttccatttcacgtgcggcgccggtggtggtggcggcggcggcgccactgactccagcggggagatgtgggcgtcggatgtcggggaggtgcggatgagggacgtgccgatggcgacggagttcggcccgtcgcctgttggtggggttggtgtctggagtggtggggtcngcgctgcagcggaggcagcagtcaccgattctgaatatgggagcggaccctgggtaccgtggcgacgtggagctgggatatggagatgaaatcnaccaaaagggaggaggatggggagcagcacctgttctggggcggggtgattggagaaaggacaaaatgaan

SEQ ID NO: 20253 - protein, 183 aa, Zea mays
  misc_feature: Ceres CLONE 1388425-F
  misc_feature (155)..(155): Xaa is any aa, unknown, or other
MTPRAPQLRHHPPHLLLAEAVASWHPFHKKPCLTDRSTAPPSSARLPDAETPTPALSGGGSGGSFRWFGLRKRRRRGPGSRSVSGRSSDRRRSGTCSDFHFTCGAGGGGGGGATDSSGEMWASDVGEVRMRDVPMATEFGPSPVGGVGVWSGGVXAAAEAAVTDSEYGSGPWVPWRRGAGIWR

SEQ ID NO: 20254 - DNA, 739 bp, Zea mays
  misc_feature: Ceres CLONE 1388426-F
  misc_feature: Encodes the peptide sequence at SEQ ID NO. 20255
  misc_feature (399)..(399): n is a, c, t, g, unknown, or other
  misc_feature (414)..(414): n is a, c, t, g, unknown, or other
aaagctggagctccccgcggtggcggccgctctagaactagtggatcccccgggctgcaggaattcgcacgagaccattacctagaacatcctaatcgaaaagctggccgctgcttaacaaaccgccgccacaggacaagacaaacttattacagctccacctcagtgctgcagagactgagggccagccaaaccgctcaccgcacacgcggaattcaagcagcatgtacgccgacgccgggttcgccttcgccttcgccgccgcctactcccccaccctcacttcctcgcagccccagccgccgccgccgccgttcgactacgccttctcctccgagccacccctcctctccatgcccgccatggaccacgacgcctacctggggaacttggtacagncatccatggtatcanaatatgaccctgggaggagagggggacctggtcaaagctccggaagcatcatcgagggaacgctgctcagcctcgatcctgtcgcagctgccttttcaatgagggctggcaagggaagggttggcatggatcaaactataaggacccgggccccgggcccattcaaatggccccccccggagggaggggcttaccaggggcaaaaagaaccctggggaaaacccccatccaaggaacaattcgaaactttgggggggaaaatcccagcggcggggggaaaaaaccccaggcagggtgaggggtgttataaagaacacgggccccg

SEQ ID NO: 20255 - protein, 171 aa, Zea mays
  misc_feature: Ceres CLONE 1388426-F
  misc_feature (59)..(59): Xaa is any aa, unknown, or other
  misc_feature (64)..(64): Xaa is any aa, unknown, or other
MYADAGFAFAFAAAYSPTLTSSQPQPPPPPFDYAFSSEPPLLSMPAMDHDAYLGNLVQXSMVSXYDPGRRGGPGQSSGSIIEGTLLSLDPVAAAFSMRAGKGRVGMDQTIRTRAPGPFKWPPPEGGAYQGQKEPWGKPPSKEQFETLGGKIPAAGGKNPRQGEGCYKEHGP

SEQ ID NO: 20256 - DNA, 719 bp, Zea mays
  misc_feature: Ceres CLONE 1388427-F
  misc_feature: Encodes the peptide sequence at SEQ ID NO. 20257
  misc_feature (345)..(345): n is a, c, t, g, unknown, or other
  misc_feature (367)..(367): n is a, c, t, g, unknown, or other
  misc_feature (403)..(403): n is a, c, t, g, unknown, or other
  misc_feature (421)..(421): n is a, c, t, g, unknown, or other
  misc_feature (459)..(459): n is a, c, t, g, unknown, or other
  misc_feature (487)..(487): n is a, c, t, g, unknown, or other
  misc_feature (489)..(489): n is a, c, t, g, unknown, or other
  misc_feature (606)..(606): n is a, c, t, g, unknown, or other
  misc_feature (613)..(613): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtgntgcaagcaggcgtgcgagtggncagtacgaaaggacaccccgcggaagagggaatgcnagagcgagtgccgcgagncgcaccagcaagctgacgcgggcgaggacggcgacagncgcgtggacgcctacgtctcccgctccngnaggggcgagtgccccgcgcagtgcctgcgccgccacgaggggcagccgtgggagacccaggagtgcatggagcggtgccgccggcgcggactggccgtcgacatgagcaagagtacngtcgcgncagcgagagcgcggccagtgcccggagaggtgcagcgccacacccgcgggactggtgggaaagcacgcgctggtgaaaaaaaaagggggggggggggggggaaaaa

SEQ ID NO: 20257 - protein, 168 aa, Zea mays
  misc_feature: Ceres CLONE 1388427-F
  misc_feature (44)..(44): Xaa is any aa, unknown, or other
  misc_feature (52)..(52): Xaa is any aa, unknown, or other
  misc_feature (64)..(64): Xaa is any aa, unknown, or other
  misc_feature (70)..(70): Xaa is any aa, unknown, or other
  misc_feature (82)..(82): Xaa is any aa, unknown, or other
  misc_feature (92)..(92): Xaa is any aa, unknown, or other
  misc_feature (134)..(134): Xaa is any aa, unknown, or other
MGKGSVGASWWAFLLLAGVLLVVAATAGAEDGVVERDRKEDLRXCKQACEWXVRKDTPRKRECXSECREXHQQADAGEDGDXRVDAYVSRSXRGECPAQCLRRHEGQPWETQECMERCRRRGLAVDMSKSTVAXARARPVPGEVQRHTRGTGGKARAGEKKRGGGGGK

SEQ ID NO: 20258 - DNA, 668 bp, Zea mays
  misc_feature: Ceres CLONE 1388429-F
  misc_feature: Translation starting site: 180
  misc_feature: SWISSPROT Homolog: EC 1.11.1.11 L-ascorbate peroxidase
aaagctggagctccccgcggtggcggccgctctagaactagtggatcccccgggctgcaggaattcgcacgagaccattacctagaacatcctaatcgaaaaaccgaattcattccacccccgtctcctccgatcggaccaccgggccagcagcggggtggatcgtgacgtcagcagccatggtgaaggcctaccccacggtgaacgaggactacctcaaggcgctcgacaaggccaagagcaagctccgcggactcatcgacgagtagaattgcgccccgctcatgctccgcctcgcatgtcactccgcgtgcaccttcgatgtgggcaccaaaacggggggcccactcgggatcatgatgaaccccgccgagcaggcgcacgtattccacgccggactcgtaaatggccatcaggctgctagaggccatcaagggagcaggtcccccatctagtctaagctgaattctaccaggttggtggaggcaggctagttaaggaaacccggggacctgatgtcccccttcacccccggaaggggggaaaggcctgagcctcccccggaggggcgccttcttggggccccccagggttttgtttccctcagggcgggtttcctcccaacggagggggtttggggggccccgtacttttttgggtttttgggg

SEQ ID NO: 20259 - DNA, 800 bp, Zea mays
  misc_feature: Ceres CLONE 1388433-F
  misc_feature: Encodes the peptide sequence at SEQ ID NO. 20260
  misc_feature (1)..(1): n is a, c, t, g, unknown, or other
  misc_feature (14)..(14): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
naaaaaaaacaccnacaaaaaacaaacccgcccccnnnnnttaannngggccatagctggagctccaccgcggtggcggccgctctagaactagtggatcccccgggctgcaggaattcgcacgagaccattacctagaacatcctaatcgaaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggaggtgggggggcactacctctgcgcgcgcgccgcggggcggcgcccgccggtggtcatcattcgccgaggtcgaactggtaccgccttccacccccgggaacctgccgggggggcggccctctttcgggcgggcgggagggggtaacttccttcccgcccggggggaaccccaaaggacccccaaaggggttccccggcccaaaacggggcccggcggggtggggggtaagtgggaagggccccgggcgggcggaaaaacccccggggaaaacacgggggggcccggaacggcggtgggaaaaaaaaaaaggggccccggggtctcaacacaaggggagagcccgcgcgcgggcggggggaaaaaaagaaagagggggtttttgttcgggagaaacccgccccgccccgggg

SEQ ID NO: 20260 - protein, 80 aa, Zea mays
  misc_feature: Ceres CLONE 1388433-F
MAAVQQQQQQQRRDAEAELNLPPGFRFHPTDEEVGGHYLCARAAGRRPPVVIIRRGRTGTAFHPREPAGGAALFRAGGRG

SEQ ID NO: 20261 - DNA, 696 bp, Zea mays
  misc_feature: Ceres CLONE 1388436-F
  misc_feature: Encodes the peptide sequence at SEQ ID NO. 20262
  misc_feature (374)..(374): n is a, c, t, g, unknown, or other
cagagctggagctccccgcggtggcggccgctctagaactagtggatcccccgggctgcaggaattcgcacgagaccattacccagaacatcctaatcgaaaacacgatcacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgatcgccgaggcgaggaacatcaagaccacgacgacgganaagaaggacgacgcggtggtgcagccgcagaccttcccgcccttcgaccgcctcggcggcggcgcggtcccccggcgttcggcggcctccccggcggcagcattcctggcagcagcatttcccgggttcagcatgcccggcagcggagcagcccctaccggggttcagcttgcccggcagcggagatggcccctcttttcggcggcggctcccgggctcgagggggtttttggggggtagggccccggtccccccacggggcgggttccgttccccgagcacgccaacgagcccctgacggccaccgagggggggaaaatag

SEQ ID NO: 20262 - protein, 113 aa, Zea mays
  misc_feature: Ceres CLONE 1388436-F
  misc_feature (34)..(34): Xaa is any aa, unknown, or other
MARSSKMMVAAALLALALAVSIAEARNIKTTTTXKKDDAVVQPQTFPPFDRLGGGAVPRRSAASPAAAFLAAAFPGFSMPGSGAAPTGVQLARQRRWPLFSAAAPGLEGVFGG

SEQ ID NO: 20263 - DNA, 689 bp, Zea mays
  misc_feature: Ceres CLONE 1388440-F
  misc_feature (94)..(94): n is a, c, t, g, unknown, or other
  misc_feature (341)..(341): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (418)..(418): n is a, c, t, g, unknown, or other
aaagctggagctccccgcggtggcggccgctctagaactagtggatcccccgggctgcaggaattcgcacgagaccattacctagaacatcctnaatcgaaaaatcaaccatattattgagaccaacaagcaacatagaaagtggaatccagtagcaacaatagagcaacaatggcgaccaagatattttccctccttatgctccttgctctttctacatgtgttgctaactcgacaattttccctcaatgctcacaagctcctatagcttcccttcttcccccataccttccatcaaatatagcttcagtatgtgaaaaacccagctctttcaccatatnagcttcannncagcatcgcagcaagcaacatacctttatcgcccttgtnnngttcacatcggcagccctatcttggntgcagtcattgtacaaaccatcagggaacacagctgcagcaactcgtgctacctttgaacaaccaagaagtctgggaaaacttttccccttatttcaaaaaaaaattttcttcctttaaccaattggttaacttgaacgtggggtttattttggaaaaaaaataaccttttacccggttggtttggggtaatctttaaaaaaaaaatttttttttttaaaacaatgggcgccctaaacaccctttttttttttgcggagaaaaaaacacca

SEQ ID NO: 20264 - DNA, 695 bp, Zea mays
  misc_feature: Ceres CLONE 1388441-F
  misc_feature: Encodes the peptide sequence at SEQ ID NO. 20265
  misc_feature (305)..(305): n is a, c, t, g, unknown, or other
  misc_feature (347)..(347): n is a, c, t, g, unknown, or other
aagctggagctccccgcggtggcggccgctctagaactagtggatcccccgggctgcaggaattcgcacgagaccattacctagaacatcctaatcgaaaaaacaaaaaccaacgctccccctgcccccctctttcctccccagacccgcgctcccctccgtggcgtgcaacgcgttcctcggctcctgcaggcggcgacctcggaaaggcgggggcgtctcgtcgcgaggcatttgaggccaggattttttggtgctctcattgttagctgactggtgagggtctggatctagcaatggcgganaacacccacggtagtggtcgccacgtgcttggggacttgacnaatgttattttgcagcgagcagccacatcagatctggagaagagtacaggggggataaggatcagacggattgaaaagactgggactagggagggagaccatgcaatggcaaagctaccattatggggaaagaaatggatttggccttttggttgaggagtttgccaaaaaaaatttaaaggcattctttctttaaaaaggaggggtcaaacaataattcccaaaaggttgggcctttatccggggacccatggtttcaaaaaacccattgggccagggggccttaaaatccccgggggaggggggaggtttttctttttgctttgaagaccctttttgggtgaaaaa

SEQ ID NO: 20265 - protein, 68 aa, Zea mays
  misc_feature: Ceres CLONE 1388441-F
  misc_feature (3)..(3): Xaa is any aa, unknown, or other
MAXNTHGSGRHVLGDLTNVILQRAATSDLEKSTGGIRIRRIEKTGTREGDHAMAKLPLWGKKWIWPFG

SEQ ID NO: 20266 - DNA, 685 bp, Zea mays
  misc_feature: Ceres CLONE 1388442-F
  misc_feature: Translation starting site: 336
  misc_feature (468)..(468): n is a, c, t, g, unknown, or other
  misc_feature (685)..(685): n is a, c, t, g, unknown, or other
aaagctggagctccccgcggtggcggccgctctagaactagtggatcccccgggctgcaggaattcgcacgagaccattacctagaacatcctaatcgaaaaacgtcaagctgtcactgtcctcctcatcgccgacgtactcgtcaccacatctcatacgatgttgccactccttccagaaccacctcctcgccaccgtggctgactgccctgcccgctataagactctgcgctccgcgttgtgacgcacgcctcatcaatgatcacagcaatgatgtagcttcttctagctctagctaggctcgactagctgaaagaaggaaacagaccacagcatggacctgaaggaggaggacgaccgcctggacggcaacaagttctcggagcgccagcccatcaggcacatgcgagaacgagtagccgacgacaaggactacaaggagacgccgccggagacgctcttcgagnccggggagctcaagtcctgccccttctaccgcgcgagtagtcgccgagatcgtctgcaccttcatcttcctctacatctccatcctcaccgacatgtgagtctccgactccacctccaagtgcgccaccgacggcatccaagagatcgcctgcgccttcagagcgatgatcttcgcccctcactactgcaacgccgacatctgcgggaatgacatcn

SEQ ID NO: 20267 - DNA, 680 bp, Zea mays
  misc_feature: Ceres CLONE 1388451-F
  misc_feature: Encodes the peptide sequence at SEQ ID NO. 20268
  misc_feature (466)..(466): n is a, c, t, g, unknown, or other
  misc_feature (606)..(606): n is a, c, t, g, unknown, or other
  misc_feature (643)..(643): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgtgcggcgcgcctccagtcttttttcgcctccgtgctctccgggctcttcggncaggccgaggccgaggacgaggacgaggacgatgagatgcccacgcgcaaccacaacgctgccgcggctgccgctccgcagcatcaccatcacaaccgaggtgatgctcctgctcttggaaggagcaagggccgtgcccnggcgagctgatgccatgaaccggcaagcccccctcgncgatattggcaccntcgtcagcgtccgaccagcccaa

SEQ ID NO: 20268 - protein, 61 aa, Zea mays
  misc_feature: Ceres CLONE 1388451-F
  misc_feature (37)..(37): Xaa is any aa, unknown, or other
  misc_feature (49)..(49): Xaa is any aa, unknown, or other
  misc_feature (54)..(54): Xaa is any aa, unknown, or other
MRCPRATTTLPRLPLRSITITTEVMLLLLEGARAVPXRADAMNRQAPLXDIGTXVSVRPAQ

SEQ ID NO: 20269 - DNA, 719 bp, Zea mays
  misc_feature: Ceres CLONE 1388452-F
  misc_feature (244)..(244): n is a, c, t, g, unknown, or other
  misc_feature (405)..(405): n is a, c, t, g, unknown, or other
aaagctggagctccccgcggtggcggccgctctagaactagtggatcccccgggctgcaggaattcgcacgagaccattacctagaacatcctaatcgaaaaaatcgacccagccatctcctcaccctcgttcaccacacagtccgccactcctttagtagcttgtgatttgtacgtcgacgagatcactggtcgggtggcggacgacgacacatggggaagggtagtgtgggtggcatcatgntggggcgttcctcctgctcgccggcgtgctgctggtcgtagcagccacggccggggcggaggacggagtggtccaacgggaccgcaaggaggacctgcggtggtgcaagcaggcgtgccagtggcaggagggagaggacaccccgcggaaaagggaatgcnagagcgagtgcccctagcggcaccagcaagctgacgcgggcgaagacggcgacagcggggtggaacccctacgtctcccgcttcggggaggggcgagtggccgccgccagtgccctgcgcccccacgagggccgagccggtggaagaacccaggaattggcatggagggggtggccccccgccgcgggaacttggccgtcgaaattgggagaaaaaattaccggccggcggaaggcgaaaagggcgggggaaaggtccccgggagaaaaggtggcagagcgcccccacccgccggggggattggtggtggaaaa

SEQ ID NO: 20270 - DNA, 672 bp, Zea mays
  misc_feature: Ceres CLONE 1388453-F
  misc_feature (499)..(499): n is a, c, t, g, unknown, or other
gctctagaactagtggatcccccgggctgcaggaattcgcacgagaccatacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagggacggagtgttcgaacgggaccgcaaggaggaacctgccgtggtgcaagcagggcgtgcgagtggcagtacgggagaggacacccccgcggaagagggaatgcaagagcgagtggcgcggagcggcaccagcaagctggacgcgggcgaggacggcgacaggcggcgtggacgcctacgtctcccgctcccgggaggggcgagtgccgggcgccagtgcctgcgnccgccacaagggccagccgggggagaccgcaggagggcatgaggcggtgcccgccgcccgcggactgggccgtcaacatgggagcaagagtacggtccgcggcagcgagaaggggggccaatggccgggaagagggggaagcgcacccaccgggtgactgggggggagaggac

SEQ ID NO: 20271 - DNA, 683 bp, Zea mays
  misc_feature: Ceres CLONE 1388454-F
  misc_feature: Encodes the peptide sequence at SEQ ID NO. 20272
  misc_feature (139)..(139): n is a, c, t, g, unknown, or other
  misc_feature (345)..(345): n is a, c, t, g, unknown, or other
  misc_feature (683)..(683): n is a, c, t, g, unknown, or other
aaagctggagctccccgcggtggcggccgctctagaactagtggatcccccgggctgcaggaattcgcacgagaccattacctagaacatcctaatcgaaaaatcctccgcgcaggcaagagcagccagccgcttcggnatcgggacgcggagaggggaaaggcgagtcgtcgactcgtcgtccgggcagcttccctccctctcctctccgcccccgcttacctaggccggccccgcctacgcccccctcccgccgccgcacgatgagcacttctcccgccgccgccgacgtttcgcctttgccgcctactgctgccgccgacgaggccgcgcgggcgacagagnacggtggtggtcgatgagagggtcgcctcacacgtggacccgttcctcgtcgagacgctcgacaaccctcgccaccgtctcatggttctacggatggaactggatatacaaaactttatgcagaaccctcagctgcaggagtttgaattccagaactttccgacttcttaacctccgctgtgctggctcatcgtgttgcacaagcattatggcttagagactatagtaggcagatagttttagtagaaggctcagttaagcagggattgttgcaagaaaaacagcagaaagcaggtatcctgcatttttttttatcagaagttcctaggcatcaagcn

SEQ ID NO: 20272 - protein, 29 aa, Zea mays
  misc_feature: Ceres CLONE 1388454-F
MVLRMELDIQNFMQNPQLQEFEFQNFPTS

SEQ ID NO: 20273 - DNA, 686 bp, Zea mays
  misc_feature: Ceres CLONE 1388455-F
  misc_feature: Encodes the peptide sequence at SEQ ID NO. 20274
  misc_feature (256)..(256): n is a, c, t, g, unknown, or other
aaagctggagctccccgcggtggcggccgctctagaactagtggatcccccgggctgcaggaattcgcacgagaccattacctagaacatcctaatcgaaaaattgattttttttccgcgcagccgatttcttttcgtctctctcgctctcgccttctcggcgcagcgcagtactacgagctagcagcaccaggaacctcttcccacacttccgcgctcctccctctgtctcgagactcgagaatggttgtgagcngcgggcgcaggaggcagggaggcgagagggggagctagggtttttcgccgccgccttctgttatcctcaggctctgaaccccctcctgtccggtgcgcggcggattacactccgatggggaagtctccggcgaagtggatcaagtccgtgctcttcgggaagaagtcgtcgtccaggtccggctccaccaaggccaaagatttatcgaaaggtgcgagtaacagaggagctgctgctgcggggaaggagcccgtgttctctgagagctccccagggatctcggaggcctgtacttgttagcgcccacaacaatgagaccgtgcgggagggggcgaaggggggagaattccagcgggcaagagttgcccgtggaccgatgtccggccaagccttggaaaaagcagggcaccggtggggtctggataccgtc

SEQ ID NO: 20274 - protein, 61 aa, Zea mays
  misc_feature: Ceres CLONE 1388455-F
MGKSPAKWIKSVLFGKKSSSRSGSTKAKDLSKGASNRGAAAAGKEPVFSESSPGISEACTC

SEQ ID NO: 20275 - DNA, 700 bp, Zea mays
  misc_feature: Ceres CLONE 1388457-F
  misc_feature: Encodes the peptide sequence at SEQ ID NO. 20276
  misc_feature (528)..(528): n is a, c, t, g, unknown, or other
  misc_feature (574)..(574): n is a, c, t, g, unknown, or other
  misc_feature (636)..(636): n is a, c, t, g, unknown, or other
  misc_feature (638)..(638): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccggggtggggctgggcgtggccacgccggtgttcctgatcttcagccccgtgctcgtccccgccgcgctgctcatcgggacggccgtcatgggtcccctcacgtcggncgcgctggggggtctcgggggcctgtctctcgctcacgtgcctcgncacacgggggcgggaggcgttccagcgcccccgggactatagtgggaagaggcgcaccgcangnaatggcgggaggcccgcgncgcacgcgggccacaaagaccgcgcagggcgggcaggccatcc

SEQ ID NO: 20276 - protein, 136 aa, Zea mays
  misc_feature: Ceres CLONE 1388457-F
  misc_feature (44)..(137): Pfam Name: Oleosin Pfam Description: Oleosin
  misc_feature (108)..(108): Xaa is any aa, unknown, or other
MADRDRSGIYGGAHATYGQQQQQGGGGRPMGEQVKGMLHDKGPTASQALTVVTLFPLGGLLLVLSGLALTASGVGLGVATPVFLIFSPVLVPAALLIGTAVMGPLTSXALGGLGGLSLAHVPRHTGAGGVPAPPGL

SEQ ID NO: 20277 - DNA, 747 bp, Zea mays
  misc_feature: Ceres CLONE 1388460-F
  misc_feature: Encodes the peptide sequence at SEQ ID NO. 20278
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (36)..(36): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nnnttttttnnnncctttnnntaacccccatggacntntatgtttnnnnaatagctggagctccaccgcggtggcggccgctctagactagtggatcccccgggctgcaggaattcgcacgagaccattacctagaacatcctaatcgaaaaaactcccccggccgtcctgctcgccggcttctggctggcccctgcatccgcccagtgtgtgtgacctcagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcgggggcggcatcaccgtcttcgtgcccaagggactcggggttcgcggcgctgaagcagaccaccgttccccaacctcaacccaggacccagctcaggtccgctggctgctggggccacgcgctggcccaaggacctactcggctggcccgaagttccgaccgggttgaaccgcgctccggccccggtgggccaacccctcgcccgggttcggaa

SEQ ID NO: 20278 - protein, 106 aa, Zea mays
  misc_feature: Ceres CLONE 1388460-F
MEFKAGVFTVAMLAIVVLSTPAAPQKPKSPPAPRSPVVLAPAPAPAPAAPHHVDLADLLSVAGPFHTFLDYLQKTGVIETFQSQANDTKRGRHHRLRAQGTRGSRR

SEQ ID NO: 20279 - DNA, 670 bp, Zea mays
  misc_feature: Ceres CLONE 1388461-F
  misc_feature: Encodes the peptide sequence at SEQ ID NO. 20280
  misc_feature (223)..(223): n is a, c, t, g, unknown, or other
aaagctggagctccccgcggtggcggccgctctagaactagtggatcccccgggctgcaggaattcgcacgagaccattacctagaacatcctaatcgaaaaatcgtctatgtccatggccctctcaagctcgctccgtgggctggtggccctgaccccgctggccctcccttccgctcgcccgagcggggccgcggtggcggccccggcaccacgcgcgggngggtcggacggatacagagccgccactcgagtacctgctagctcctctgacgtcgcacgcggagtgggtgcaccgcgtggcgcacaataagagagcgctgcacacgtgcagcctgacatgtatccaggagcgactgggcaccctcgggttgacgccccgccgctaggcgatcgacgattgccattttcacaagccgctctgcgacgcgggaatcggactcgatgacaccgacctccacatcaggtagttgagactcggtcgtggaaattgtgaccacgatatggcatacaaggtgtacctacgccctaggcagagaacacatccagcacgccatactcgtaagaccttatcctgagcacctggacaggttgctcagagctagcatatgctgaacgaagacgctctgcagaagcaatctatcctgtgtgctgagcggtactagtagcc

SEQ ID NO: 20280 - protein, 67 aa, Zea mays
  misc_feature: Ceres CLONE 1388461-F
MSMALSSSLRGLVALTPLALPSARPSGAAVAAPAPRAGGSDGYRAATRVPASSSDVARGVGAPRGAQ

SEQ ID NO: 20281 - DNA, 668 bp, Zea mays
  misc_feature: Ceres CLONE 1388464-F
  misc_feature: Translation starting site: 130
  misc_feature: SWISSPROT Homolog: EC 2.3.1.110 Tyramine N-feruloyltransferase
aaagctggagctccccgcggtggcggccgctctagaactagtggatcccccgggctgcaggaattcgcacgagaccattacctagaacatcctaatcgaaaacccgtttctctacacttcctgacccagatggcggcggcgccctgctctaccaccttctccggcgacgtgtgggcggagctgcgcctggcctccgctagcgatgtgccgcacatccaccgcctgatacaccagatggccgagttcgagctcctcaccgacctcttcgccgccaccgaagagctgctcacctccacgctcttcccctcgccgacgccgcctcccttcacctccttcacagccctcatcctcgacctatcccccctcccccgtcgcccccgacccctcgtccaccatcgcctcccgccgcctcgacctctccgcgtccccgctcgcggaccccgaggccgccgccttcgcctccccgcgcggaggcggtcgcgtcacggccgggttcgtgatctgcttccccaactactccaccttcctctccaagcccgggctctacgtggaggacatcttcgtgcgcgcgccctggcgccgccgcgggctcggccggatgatgctgtccgccgtcgccggcaggatggccgagctcgagatgagccgcatggagtgttgcgtgctca

SEQ ID NO: 20282 - DNA, 844 bp, Zea mays
  misc_feature: Ceres CLONE 1388465-F
  misc_feature: Encodes the peptide sequence at SEQ ID NO. 20283
  misc_feature (1)..(1): n is a, c, t, g, unknown, or other
  misc_feature (2)..(2): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (766)..(766): n is a, c, t, g, unknown, or other
nnaacccccccccccccccccccaaaacannaannnnnnntttcnnnnnnccaagctggcgctccaccgcggtggcggccgctctagaatagtggatcccccgggctgcaggaattcgcacgagaccattacctagaacatcctaatcgaaaacacaccacacgccagccagccatcgtcacactggtgagctctgcactctgcttagctccgagcttcagtgccttcgttgtttggcccacgcagtccacacacacacaccagtacgtccagctgcactgcaccaatggccgccgtcgagggcaggtcccgactgccgctcccgtcgaggaggttgccaggtggccgccgcctcggccggcgagatcccgaacgaggagacccgctgctccggcggtggaaaaccgaaggccgccttccctaaagaacccgggggcgggccaaaccccaaaaattaagtcccaaggagagtccaggtctaagggttgaaggcccaaagcccgaaggcccgaaaccttgagggcttgaaccccaacccgaaggcaaaaacccccgaaaggccccccctttgcccgcggaagccaaaaaaaccggagggcccaagggaaaaccaaaaaccccggaaggccccctcctttggcccgcgcaaaaaaaaaaaacgggaagtgtttttttgggctgcgccccgcggtcgaaaggttcttcgtaaacccccaaaaaaaaagcccgcccagaaaacaaaaaaagaggggggggggtgggtgantccttcttttagacgcggggggagggagcggggggggggccccccccccccccggggggtttttcttccccacctccg

SEQ ID NO: 20283 - protein, 45 aa, Zea mays
  misc_feature: Ceres CLONE 1388465-F
MAAVEGRSRLPLPSRRLPGGRRLGRRDPERGDPLLRRWKTEGRLP

SEQ ID NO: 20284 - DNA, 781 bp, Zea mays
  misc_feature: Ceres CLONE 1388467-F
  misc_feature: SWISSPROT Homolog: EC 1.2.1.12 Glyceraldehyde-3-phosphate dehydrogenase (phosphorylating)
  misc_feature (1)..(1): n is a, c, t, g, unknown, or other
  misc_feature (16)..(16): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (43)..(43): n is a, c, t, g, unknown, or other
  misc_feature (44)..(44): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
nggttttttggtcccnccnnntctgccccggccggcgggggtnntttnnntgaaannnnngcaagctggagctccaccgcggtggcggccgctctagaactagtggatcccccgggctgcaggaattcgcacgagaccattacctagaacatcctaatcgaaaaacactcgccaaccccgtcatcgatctcgtttcaaatccatccatcctcgtttcctccgtcccgcagcatctcaaccccatgggcaagatcaagatcggggatcaatgggttcggcaggatcggaaggctggtggccagggtggctctgcagagtgacgatgtcgagctcgtcgccgtgaacgaccccttcatcagcaccgactacatgacctacatgttcaagtaccacactgggacacggaccggggaaaggaccattgaagtccaggggggaagggactcccaaaagccctttcttctttgggggaaaggggaggttggcttggggttttggcttggcgggaaccccctggggggagatcccggggggggggtccgggtgtggggggttgaaaaagggttggttcagagcccaaacgggggggggttttcccccgggaaccagggaggaaaggctgggggggctccactttggggggggggggggggccccaaaaaaaagggtgggacattctcccggcctcccaaaaaaaagaggaatgccccccccggggttttggcccccgggggcgggcgcccccgggaaggggggggccccactctcttccgctttttga

SEQ ID NO: 20285 - DNA, 668 bp, Zea mays
  misc_feature: Ceres CLONE 1388469-F
  misc_feature: Translation starting site: 112
  misc_feature: Pfam Name: Orn_Arg_deC_N Pfam Description: Pyridoxal-dependent decarboxylase, pyridoxal binding domain
  misc_feature: SWISSPROT Homolog: EC 4.1.1.20 Diaminopimelate decarboxylase
  misc_feature (349)..(349): n is a, c, t, g, unknown, or other
  misc_feature (361)..(361): n is a, c, t, g, unknown, or other
aaagctggagctccccgcggtggcggccgctctagaactagtggatcccccgggctgcaggaattcgcacgagaccattacctagaacatcctaatagaaaaaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcggggccgatggctacctgtactgcnagggagtgcggntggaggccgccatgacggctgccgagcgcagccccttctacctctacagcaagccacagatcctccgcaacttcgccgcctaccgcgatgctctccagggggctccgctccatcatcgggtatgccgtggaggccaacaacaacctccccgtgctacgcgtcctgcgggagcttggctgcggcggcgtcctcctcaggcggaacgagctccgactcgcccctccggggggattcgaccccggcgggtggatatttaacggaaaggggagacccctcgaccatttaaaataactggtgagaggggagg

SEQ ID NO: 20286 - DNA, 677 bp, Zea mays
  misc_feature: Ceres CLONE 1388470-F
  misc_feature: Encodes the peptide sequence at SEQ ID NO. 20287
aaagctggagctccccgcggtggcggccgctctagaactagtggatcccccgggctgcaggaattcgcacgagaccattacctagaacatcctaatcgaaaacccccatttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgaccccgtcatggaggcggttgttgctggcagcaacacggtagtagctgttgcccaaggtgagttgcaaacaatgaacgtgcagcagcccgctgatgttgccggaccccgcgagggggtggcggcaatctccaaaggggggaaggtagggcccgaaccggggcaccgcctggcaggaagaggttgggctttacgggaatcaactggccgggggggggactttgtactggggcactcccaccggtacctccaaaaaggccgaattggaaatt

SEQ ID NO: 20287 - protein, 151 aa, Zea mays
  misc_feature: Ceres CLONE 1388470-F
  misc_feature (14)..(38): Pfam Name: zf-A20 Pfam Description: A20-like zinc finger
MEHKEAGCQAPEGPILCINNCGFFGSAATMNMCSKCHKEMITKQDQAKLAASSIDSIVNGSDPVMEAVVAGSNTVVAVAQGELQTMNVQQPADVAGPREGVAAISKGGKVGPEPGHRLAGRGWALRESTGRGGDFVLGHSHRYLQKGRIGN

SEQ ID NO: 20288 - DNA, 670 bp, Zea mays
  misc_feature: Ceres CLONE 1388471-F
  misc_feature: Translation starting site: 190
  misc_feature (271)..(271): n is a, c, t, g, unknown, or other
  misc_feature (301)..(301): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (373)..(373): n is a, c, t, g, unknown, or other
  misc_feature (375)..(375): n is a, c, t, g, unknown, or other
  misc_feature (376)..(376): n is a, c, t, g, unknown, or other
  misc_feature (380)..(380): n is a, c, t, g, unknown, or other
  misc_feature (383)..(383): n is a, c, t, g, unknown, or other
  misc_feature (384)..(384): n is a, c, t, g, unknown, or other
  misc_feature (389)..(389): n is a, c, t, g, unknown, or other
  misc_feature (390)..(390): n is a, c, t, g, unknown, or other
  misc_feature (393)..(393): n is a, c, t, g, unknown, or other
  misc_feature (394)..(394): n is a, c, t, g, unknown, or other
  misc_feature (437)..(437): n is a, c, t, g, unknown, or other
  misc_feature (440)..(440): n is a, c, t, g, unknown, or other
  misc_feature (444)..(444): n is a, c, t, g, unknown, or other
  misc_feature (468)..(468): n is a, c, t, g, unknown, or other
  misc_feature (547)..(547): n is a, c, t, g, unknown, or other
tggagctccccgcggtggcggccgctctagaactagtggatcccccgggctgcaggaattcgcacgagaccattacctagaacatcctaatcgaaaaaaccaagcagagcaaagagagagacgcggagccaccgcgttccggagagagacgcggagagccaaggcaaggcagctgtcgccgcagcgacgatgtggagctcgggctctgaccgcgacgaggccctagacacggcgaacgcctcgtcagtcgacgcttcgtcgcccgcgcggnagccgtccacgccgcccccgccgcctcggngccggcgccagcgcgcgcgacgccgcgctcaccgcctcccgtgcagacacggnnnccaaagggggcgggagnanngagnagnnactcnntgnnagccgacccgaacgcggacgacgtctggcgcgggctgcagcancancggnagcgggaggcgtggctgcggcggncgtcaaggcccgtggtggtggtcgccggcgaggaggggccccctccggacgcctccgccggctcggggaaaaccggcgntttggggagggcgcggaacctgaacgaccacgacctggaggagctcaaggggtggggggatctgggggtcggtttcgctaccggagatccccaaggtggggggcacgttgcccggcctccaac

SEQ ID NO: 20289 - DNA, 544 bp, Zea mays
  misc_feature: Ceres CLONE 1388479-F
  misc_feature (299)..(299): n is a, c, t, g, unknown, or other
aaagctggagctccccgcggtggcggccgctctagaactagtggatcccccgggctgcaggaattcgcacgagaccattacctagaacatcctaatcgaaaaagaactttcgggttgcgtgtccttatttataaatggctttcaactttttactcaccagagattttgattaatactttgagaaattcgaatgctctgttttgttttctcgggaaattatcagagtgagataaagatcagaggaaagatgagagccggcgcgagtgcaacaacgtttcggagactataaacgcagccgnctagagggggttgcttctctgatgatcggtcatcaccaccctttccgattataaaaaagaaaaatggcggattcctttaattttttcccacccttccccccccaaaaaaaaacaaaggggaacccctttttctccgagggttaaaccccccccccccattccggggaaaggggggaaaagggtcttttttttaaagaccccacccccccccgggttttttttaaaaaaaaactttctttaaaaag

SEQ ID NO: 20290 - DNA, 670 bp, Zea mays
  misc_feature: Ceres CLONE 1388483-F
  misc_feature: Translation starting site: 170
  misc_feature (624)..(624): n is a, c, t, g, unknown, or other
  misc_feature (640)..(640): n is a, c, t, g, unknown, or other
  misc_feature (641)..(641): n is a, c, t, g, unknown, or other
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgataaacacactcgcttcccccagccgcacgaaaccctaacgccgccgccgcttcacaggtaaaccgccgccatggtctccggttccggcgtatgcgcgaagcgcatcgtggtggacgcgcgccaccacatgctgggccgcctgtcgtcgattatcgccaaggaactgctcaatgggcagaaggtggtcgtcgtccgctgcgaggagatctgtatgtccggtgggctcgtacgccagaagatgaagtacctccgctttctccgcaagcggatgaacaccaagccatcccatgggcccatccacttccgcgccccgtccaagatcctgtggcgcaccatccgcgggatgatccccaaaaaacccaagaaggggggaggcggctctggcgaggctcaagacgtacgagggcgtcccgccgccgtacgacaagaccaagcgcctggtcatccctgacgctcttaaggttctgaggctgcaacccaggacacagtactgcctccttggggactttctaagggagtcggatnaactacatgacacatnngggaggtttgagagaagaggaggaaaagn

SEQ ID NO: 20291 - DNA, 654 bp, Zea mays
  misc_feature: Ceres CLONE 1388486-F
  misc_feature: Encodes the peptide sequence at SEQ ID NO. 20292
  misc_feature (286)..(286): n is a, c, t, g, unknown, or other
  misc_feature (411)..(411): n is a, c, t, g, unknown, or other
  misc_feature (450)..(450): n is a, c, t, g, unknown, or other
  misc_feature (569)..(569): n is a, c, t, g, unknown, or other
  misc_feature (570)..(570): n is a, c, t, g, unknown, or other
  misc_feature (576)..(576): n is a, c, t, g, unknown, or other
  misc_feature (577)..(577): n is a, c, t, g, unknown, or other
  misc_feature (603)..(603): n is a, c, t, g, unknown, or other
  misc_feature (604)..(604): n is a, c, t, g, unknown, or other
  misc_feature (623)..(623): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaaacacgaaccagaagcttgcattgttcgctgctcgatcgttgtaggtaatgcagaaccctgctccgagtatcgtagtgccccccgtcgccgcacctgtatcaccgaacttcagcagactcgccttccgcaacctgtacatccaacggacgggtccagacagcagggagatgctgactgtggaggnaacaacaggctctagtgatcatacaggcgacatgagtcacgtgatggacttccccgtctacgatggtcgtggatccgacgccgtcctggtgcttcgcgtgcaggccgtcactaccgcgttcgggnaactcccaccaggattttcaacgtgcgcccttcgagggntgggcaggttaaaaggccttcccccctttcccttaaaccaagaggatgttgggccccccctgtggaattccccaggaaagggggggattattttcgcgggggggggggggcccccccgnnaaaggnntgtgtttttgttttttttttttgtgnnggggggggggggggggggngggggcctttggcccggcgggatagnaaaaa

SEQ ID NO: 20292 - protein, 128 aa, Zea mays
  misc_feature: Ceres CLONE 1388486-F
  misc_feature (6)..(6): Xaa is any aa, unknown, or other
  misc_feature (48)..(48): Xaa is any aa, unknown, or other
  misc_feature (61)..(61): Xaa is any aa, unknown, or other
  misc_feature (101)..(101): Xaa is any aa, unknown, or other
  misc_feature (103)..(103): Xaa is any aa, unknown, or other
  misc_feature (112)..(112): Xaa is any aa, unknown, or other
  misc_feature (127)..(127): Xaa is any aa, unknown, or other
MLTVEXTTGSSDHTGDMSHVMDFPVYDGRGSDAVLVLRVQAVTTAFGXLPPGFSTCALRGXGRLKGLPPFPLNQEDVGPPLWNSPGKGGIIFAGGGGPPRXRXVFLFFFFVXGGGGGGGGLWPGGIXK

SEQ ID NO: 20293 - DNA, 725 bp, Zea mays
  misc_feature: Ceres CLONE 1388488-F
  misc_feature: Encodes the peptide sequence at SEQ ID NO. 20294
  misc_feature (344)..(344): n is a, c, t, g, unknown, or other
  misc_feature (345)..(345): n is a, c, t, g, unknown, or other
  misc_feature (357)..(357): n is a, c, t, g, unknown, or other
  misc_feature (444)..(444): n is a, c, t, g, unknown, or other
  misc_feature (454)..(454): n is a, c, t, g, unknown, or other
  misc_feature (490)..(490): n is a, c, t, g, unknown, or other
  misc_feature (491)..(491): n is a, c, t, g, unknown, or other
aaagctggagctccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgcccgccgcgnntgtgggcggcgncgccaacgcgcccatgtcagcggccgacctcctcccgccgggccacccggacccgtcccgtcctggagcggctgctcccgctgctgncgtcccgcgncgttttctccgagtccaccgagtccacgcccaccanncgcgcgcgggctattcgcgctcaccgccgtgggccgcaccctggtgccgggggcccgcctcgggcgcgtcctacgccgactacgtgctgcagcaccaccagaacgcgctggtggcggcgtgcccccgctgcagaagccgtgcttgaccccgcgggcccgagccgttccgcgcgccaacgccgggtcaccgctacccctactaggaaggaccagacccaacgggtcatctccccc

SEQ ID NO: 20294 - protein, 150 aa, Zea mays
  misc_feature: Ceres CLONE 1388488-F
  misc_feature (54)..(54): Xaa is any aa, unknown, or other
  misc_feature (58)..(58): Xaa is any aa, unknown, or other
  misc_feature (87)..(87): Xaa is any aa, unknown, or other
  misc_feature (102)..(102): Xaa is any aa, unknown, or other
  misc_feature (103)..(103): Xaa is any aa, unknown, or other
MPPPSANGATAAAAAARDDMSPAEARLAMMELANMVSVPMALAAVIRLGVPAAXVGGXANAPMSAADLLPPGHPDPSRPGAAAPAAXVPRRFLRVHRVHAHXXRAGYSRSPPWAAPWCRGPASGASYADYVLQHHQNALVAACPRCRSRA

SEQ ID NO: 20295 - DNA, 753 bp, Zea mays
  misc_feature: Ceres CLONE 1388489-F
  misc_feature: Translation starting site: 327
  misc_feature (455)..(455): n is a, c, t, g, unknown, or other
  misc_feature (494)..(494): n is a, c, t, g, unknown, or other
caaagctggagctccccgcggtggcggccgctctagaatagtggatcccccgggctgcaggaattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccacgtttcatctaccgcctccgttctatatgccgcctccgtctatctgcccgcgcagcagcaggcgcagccatggcaataccccactcaaccaccgcagctaagcccgtgccaacagttcggatcctggcgggtcggcagcgtcggcagcccgttcctgggccagtgcgtcgagttcctgagggaccagtgcagcccggnggggacagcctacggctcgccacagggcaggcgctgcancagcagggctgccaccagatcagggaggtggagcgcttgcaccggtaccacgggaaatacgggtgtgggcctggaatcccttccttgaaaaaaaaaccgcaaggggaacctcccgggggcttaatggcggccccagataaacccaacaacttgaacgggaatgtgggggtctggaatttgaaaaaaaccaaggcccttgccccttgaaaaagaaattggcgggggggggttactaatgggaggaatttttttcctggag

SEQ ID NO: 20296 - DNA, 705 bp, Zea mays
  misc_feature: Ceres CLONE 1388492-F
  misc_feature (310)..(310): n is a, c, t, g, unknown, or other
  misc_feature (315)..(315): n is a, c, t, g, unknown, or other
  misc_feature (316)..(316): n is a, c, t, g, unknown, or other
aagctggagctcaccgcggtggcggccgctctataactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgcccttcgtttgtttgctccacagtccacacacacacacgtccagctagctgcactgcacccatggccgccgtcgaagtcccagtcccgaatgcccgtcccgtgaaggaagttttccccaaatttgggccnttttnntacgccccccccgtcttaaatttaaaatgtacctgcatataatataaacaacaccgagagtgaaaccataatgaacgtacgtcaggatataacaaagaaattataactgatctgccagagcctcaccaataattcccaaacaacccccacccacacatcctcccacaactactcgcatccttctcacaccttgcaataccggatcagaagaagatactggtttacgcacacccggcatacatgaagccatagcattataccctcattttaatttatgtaattttattacactccctacgctcctccgccacgcaatccatctcattatatccgtacatattagttggatgtccccgtctcgcacagatcattaatcacccccccccccc

SEQ ID NO: 20297 - DNA, 730 bp, Zea mays
  misc_feature: Ceres CLONE 1388496-F
  misc_feature: Translation starting site: 433
  misc_feature: Pfam Name: UPF0041 Pfam Description: Uncharacterised protein family (UPF0041)
  misc_feature (467)..(467): n is a, c, t, g, unknown, or other
  misc_feature (489)..(489): n is a, c, t, g, unknown, or other
  misc_feature (525)..(525): n is a, c, t, g, unknown, or other
  misc_feature (606)..(606): n is a, c, t, g, unknown, or other
  misc_feature (635)..(635): n is a, c, t, g, unknown, or other
aaagctggagctccccgcggtggcggccgctctagaactagtggatcccccgggctgcaggaattcgcacgagaccattacctagaacatcctaatcgaaaagattcgcgaaagagacgaccaccgccgcatcggaccgtgcccgagccccccttctcctcgctgactcggctcccctcctccgccgtcgccggaggcgaagcaagtggggaccacagaagcattagctgggtgaacccactcaaagggggcagggaattgtgtgctagtttgaatggctgctacaaagcttcaggccctttggaaccacccggctggccccaaaacattcatttctgggcgccacattcaaatggggcatcagcattgccaacatagccgactttgctaaacaccctgaaagatatcttaccctcagcaagttgctggtgcatgcactggactcatttgggcaggtacagcttggntatcacaccgagaaactggaancctttcagtgttaacgttgcaatggcgggtacaggnctgtatcagctttcacggaagatcaggcaagaatacttatccgatgagaaagatgctgcttcacaactggaagcatagatnatgaccaccggcaaagaataacggatggnaaagcctgcatcctaggagcctactcttgattttttttttctggggcagcaaagaaaaacggagggccatgtttgttttcctgtaatctgaatcg

SEQ ID NO: 20298 - DNA, 731 bp, Zea mays
  misc_feature: Ceres CLONE 1388498-F
  misc_feature: Encodes the peptide sequence at SEQ ID NO. 20299
  misc_feature (502)..(502): n is a, c, t, g, unknown, or other
  misc_feature (505)..(505): n is a, c, t, g, unknown, or other
  misc_feature (531)..(531): n is a, c, t, g, unknown, or other
aaagctggagctccccgcggtggcggccgctctagaactagtggatcccccgggctgcaggaattcgcacgagaccattacctagaacatcctaatcgaaaaaaactaaactaatgtcgtgtgatgtctattcttctctcagctctagcgaagcaataagctgacgtgtaccaaaaaaaatgaagcccacgaccaatgggctcttcgcttctcaatcttctccctccttcgcgactccgagattccgcggccaccttccgatcaccttcacatcctccaaccaacaccaccaccaccaccacaagaataagaagaatctcgctaacgtcatcactctctccctcccctccgatgactcctcctcacgagtcacatcctctcgccgcgcaattctcgtcgcgccaccgcttctcgccgctgttatttccttatggccgtccgtttcctcagccgccggggagatatcttccatcgtggcggcggatgcttcgccggaaccagnagntcctcctcctccagccactcctccgnctgtagaggagataacgtctaggatctacgacgcgacggcgctaggtgagccgatggctgttgggaagataaaagagagtgtgggagagcttctgaacgcgaggattgctacttaggagaggcggagcagtgcctactagagaacaacagacttggagcctggatcgtgaagaactttagaaagatgcgtgaaagcaacg

SEQ ID NO: 20299 - protein, 155 aa, Zea mays
  misc_feature: Ceres CLONE 1388498-F
  misc_feature (108)..(108): Xaa is any aa, unknown, or other
  misc_feature (109)..(109): Xaa is any aa, unknown, or other
  misc_feature (118)..(118): Xaa is any aa, unknown, or other
MKPTTNGLFASQSSPSFATPRFRGHLPITFTSSNQHHHHHHKNKKNLANVITLSLPSDDSSSRVTSSRRAILVAPPLLAAVISLWPSVSSAAGEISSIVAADASPEPXXPPPPATPPXVEEITSRIYDATALGEPMAVGKIKESVGELLNARIAT

SEQ ID NO: 20300 - DNA, 657 bp, Zea mays
  misc_feature: Ceres CLONE 1388500-F
  misc_feature: Encodes the peptide sequence at SEQ ID NO. 20301
  misc_feature (328)..(328): n is a, c, t, g, unknown, or other
aaagctggagctccccgcggtggcggccgctctagaactagtggatcccccgggctgcaggaattcgcacgagaccattacctagaacatcctaatcgaaaaatttatacccctccgtttcccacccttacctccccactccggcagtccccgtcccaccactacagccactgctgcccggccggccgcgtccctcttcctccgccaggcgccagccgcccgctctccagcaatggcgtctgcctcgcacgccccgacgccgctgctcaaggacgagctggacatcgtcatcccgacgatccgcaacctcgacttcctggagatgtgnaggcccttcttccagccctacccactcatcatcgtgcaggacggcgaccccagcaagaccatccgcgtccccgagggcttcgactacgagctctacaaccgcaacgacatcaaccgcatgctgggggccaaggcatcctgcatctccttcagggactccgcctggcgctgcttcgggtacctggcctccaagaagaagtacatctacccccatcgacgatgactggcttcctttccaagggatccattcggggaaggacatccatggcatttgggcaagcaaatcaaagaacctcccggaggccctttccacccccctttttttcttca

SEQ ID NO: 20301 - protein, 105 aa, Zea mays
  misc_feature: Ceres CLONE 1388500-F
  misc_feature (32)..(32): Xaa is any aa, unknown, or other
MASASHAPTPLLKDELDIVIPTIRNLDFLEMXRPFFQPYPLIIVQDGDPSKTIRVPEGFDYELYNRNDINRMLGAKASCISFRDSAWRCFGYLASKKKYIYPHRR

SEQ ID NO: 20302 - DNA, 584 bp, Zea mays
  misc_feature: Ceres CLONE 1388501-F
  misc_feature (155)..(155): n is a, c, t, g, unknown, or other
  misc_feature (172)..(172): n is a, c, t, g, unknown, or other
  misc_feature (179)..(179): n is a, c, t, g, unknown, or other
  misc_feature (186)..(186): n is a, c, t, g, unknown, or other
  misc_feature (221)..(221): n is a, c, t, g, unknown, or other
caaagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagnccgacggatctctattnccccatnacgtccnacggtcgaacttcacggcagtctcggtctcttccngaagggtcgcgcggggtttgtttgaaaagaaagggaggaaatgagggatgggatctccgtccaaatggggagggggggatccaaatgggaaacgggggttgggaaattttggggccgagaacgggttccaccctggtgggcaagggcccggaaaaaaaacggggggaaatccaaatattttttttaaacctttttttaaaaaaggggggggggaaaaacacccccccgagaattttttttgttaaaaaaccccggtggtttaaagggggggggtttggggaaaaccccctttttttttccccgggggggggttatggggggggggggggggggggctgaaaaattttctccccggccccccca

SEQ ID NO: 20303 - DNA, 661 bp, Zea mays
  misc_feature: Ceres CLONE 1388504-F
  misc_feature: Encodes the peptide sequence at SEQ ID NO. 20304
  misc_feature (661)..(661): n is a, c, t, g, unknown, or other
aaagctggagctccccgcggtggcggccgctctagaactagtggatcccccgggctgcaggaattcgcacgagaccattacctagaacatcctaatcgaaaaatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcgaggcgtgccggacggcggtcggcagcatcggccgccgctccgcccgcatcgcctactgcggcctcttcgcggttgccctcttcgcatcctgggcgctccgcgaggtcgccgcgcccctcctccagtcgatcccatggataaaccacttccacaagacccccgacggcgagtggttcgagaccgacgcggtgctcagggtcagcctcggcaacttctcttctcaccatcctcgcgtcatcagggccgggataaggacagaaggacccccgtgacagatccaccacgggggaggatgggccagatcttctgctgggcatcatcgctttctcatggtctcgggcccaagggggtcgcagtn

SEQ ID NO: 20304 - protein, 106 aa, Zea mays
  misc_feature: Ceres CLONE 1388504-F
MWAASCLASCCAACACEACRTAVGSIGRRSARIAYCGLFAVALFASWALREVAAPLLQSIPWINHFHKTPDGEWFETDAVLRVSLGNFSSHHPRVIRAGIRTEGPP

SEQ ID NO: 20305 - DNA, 722 bp, Zea mays
  misc_feature: Ceres CLONE 1388505-F
  misc_feature: Translation starting site: 153
  misc_feature (325)..(325): n is a, c, t, g, unknown, or other
  misc_feature (369)..(369): n is a, c, t, g, unknown, or other
  misc_feature (398)..(398): n is a, c, t, g, unknown, or other
  misc_feature (478)..(478): n is a, c, t, g, unknown, or other
aaagctggagctccccgcggtggcggccgctctagaactagtggatcccccgggctgcaggaattcgcacgagaccattacctagaacatcctaatcgaaaagccgccgccactcagcgccgcgcttgcgtttccttctctccgcttccaagatgtcgaagcgagggcgtggaggttcggctggtaacaagttccggatgtcactgggtctaccagtggcagctactgtgaactgtgccgataacactggagccaagaacctgtacatcatttctgtgaagggaatcaagggtcgccttaacaggcttcctttctgcctgtgtgntgacatggttatggcaaccgtgaagaaggaaagcctgaccttanaaagaagtgatgccagctgttattgtgangcagcgcaagccatggcgccgaaaggatggtgtctacatgtactttgaagaccatgctggagtgatggtgacccaaaggnagagatgaaaagttctgccatcactgggcccatcgaaaagggatgcgctgatctctggcccaggattgctagcgcggaaaatgaatcggctaaaggaagagttggtcaaagtttcattaaaatggggacttgaaaagggagttcttaataaaccaatttttgatggccctgaaatagttccccggtaatggttgggcggtggacccgtttccgaaactttgctttgaggaatccccccccgtaa

SEQ ID NO: 20306 - DNA, 670 bp, Zea mays
  misc_feature: Ceres CLONE 1388508-F
  misc_feature: Encodes the peptide sequence at SEQ ID NO. 20307
  misc_feature (369)..(369): n is a, c, t, g, unknown, or other
  misc_feature (460)..(460): n is a, c, t, g, unknown, or other
  misc_feature (472)..(472): n is a, c, t, g, unknown, or other
  misc_feature (487)..(487): n is a, c, t, g, unknown, or other
  misc_feature (490)..(490): n is a, c, t, g, unknown, or other
  misc_feature (491)..(491): n is a, c, t, g, unknown, or other
  misc_feature (523)..(523): n is a, c, t, g, unknown, or other
aaagctggagctccccgcggtggcggccgctctagaactagtggatcccccgggctgcaggaattcgcacgagaccattacctagaacatcctaatagaaaactagaaccgtctccaatggcgctactccgagcgctccggcgagcccttccggcgctctcctcgccggcggcggttctcccccgtcgcgccccgcacccactacctcctccgcccgctcctcgtcggttcctggacccgatcgggctccgctccttctccgccgccgccgccaccgcgtcgcaggcgccgcccatgggggccaccctgttcggcgggctcatggacacccggttcccgaagcgccggccgggcttcgccaaccgccgnaagagggctagcttgcgccccaaaggtccgtactactggggtgaagtgcaagcctgacgagcccataccagttagtcagccgaaccagggnagcgtacgaggnaggaaggagaaaaancgnnatcagcagcgcaaggactttatcatggctganaagaaaagcgcaaagctcagtattctgctgctgttaagagaagggggcagaacgaacagaaaggaagatggctgctgtggcaagagagcggcatgggcagcaggttgatagagctaaacagattggaggagacgttaaagctgtatg

SEQ ID NO: 20307 - protein, 102 aa, Zea mays
  misc_feature: Ceres CLONE 1388508-F
MALLRALRRALPALSSPAAVLPRRAPHPLPPPPAPRRFLDPIGLRSFSAAAATASQAPPMGATLFGGLMDTRFPKRRPGFANRRKRASLRPKGPYYWGEVQA

SEQ ID NO: 20308 - DNA, 754 bp, Zea mays
  misc_feature: Ceres CLONE 1388509-F
  misc_feature: Encodes the peptide sequence at SEQ ID NO. 20309
aaagctggagctccccgcggtggcggccgctctataactagtggatcccccgggctgcaggaattcgcacgagaccattacctagaacatcctaatcgaaaactagccgcctgcctctcctcctccagagctcgtcgccaccggccaccgccaccctcgatcacgccgtccgtcgaggtaaggtcagcatggtgagggtcagtgtgctcaacgatgcgctcaagtccatgtacaacgctgagaagatcggcaagaggcaggtcatgatcaggccgtcgtccaaggtcatcatcaagttcctgacggtcatgcagcgccacggctacattggagagttcgagtacgttgatgaccaccgatcgggcaagatcgtggtcgaactcaacgggaggttgaacaagtgcggcgtcatcagcccctcgctttgatatcggcgtgaaagaatttgagggatggactgcaaagcttgctcccgtccaggaagtttcggatacattcgtccttacaaacttcgggagggattctgggaccacgagggaggcccccccggaaaaaagcgaaagagggcaagggtttcttagtttcctccttttggaagaaacttgaacaatcttttttttatggccctgccctggcctggtcttaccttctcccaaaaaacaaagaaaccctggttaattttaccttttaataatggcctctccctcaaaaataaaagccgcctttctttttatattttgaatatttgggcggg

SEQ ID NO: 20309 - protein, 79 aa, Zea mays
  misc_feature: Ceres CLONE 1388509-F
  misc_feature (5)..(80): Pfam Name: Ribosomal_S8 Pfam Description: Ribosomal protein S8
MVRVSVLNDALKSMYNAEKIGKRQVMIRPSSKVIIKFLTVMQRHGYIGEFEYVDDHRSGKIVVELNGRLNKCGVISPSL

SEQ ID NO: 20310 - DNA, 729 bp, Zea mays
  misc_feature: Ceres CLONE 1388510-F
atagctggagctccccgcggtggcggccgctctataactagtggatcccccgggctgcaggaattcgcacgagaccattacctagaacatcctaatcgaaaaatcgaagggtcgacaatggttacgacgatcggtagtccatagcagcggcgggcgcaacttcgacccggttttcttcccatatatctgtcaaatccttctccggttgccctccatcggcagcaatttccgccatagataccggcgatcgagggcctcggacaacccaatcgacggagcagcgcggcggcaggagaggcaaacccttttcttctcagtactctacttgcctgccgctggatcccctccgcaggaagataagactgggccaaggactcggcttgatccaaggggatcaatcgacagtagccatcaaggaaactttttgggaagtttgacaaggccctagagccctggatgcaccttctggcatggggcataaggaaagaaaattggtgggtatctggcactgggtgggcaccaacttgaaggcccgctgcaaaaaaaaaaagaagggaaatggctctcgcaagggtggggaatcgggggaaaaaccgggccctttgccgaaaagggattgggggatttttacaggtttaacaaaacccggggaacaaacccgggcaattgttttttgagggcctccgggcgaagtggcccaaaaaaagaacttggagagatgcgccttgg

SEQ ID NO: 20311 - DNA, 748 bp, Zea mays
  misc_feature: Ceres CLONE 1388513-F
  misc_feature: Encodes the peptide sequence at SEQ ID NO. 20312
  misc_feature (580)..(580): n is a, c, t, g, unknown, or other
  misc_feature (748)..(748): n is a, c, t, g, unknown, or other
atagctggagctccccgcggtggcggccgctctataactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggncttgtagctgtccagcgccgcgtccacctcggcgtccgcggctcctagccgggccgccctgagccgccgccgcgccgcgccgtcgcagcttccgctggcagcagctgcagctcccaaccgtgccgcggcagcgagctcgcgctgccgcacgatggggcaggagcggcn

SEQ ID NO: 20312 - protein, 108 aa, Zea mays; identical to SEQ ID NO: 16131
  misc_feature: Ceres CLONE 1388513-F

SEQ ID NO: 20313 - DNA, 683 bp, Zea mays
  misc_feature: Ceres CLONE 1388514-F
  misc_feature: Encodes the peptide sequence at SEQ ID NO. 20314
  misc_feature (592)..(592): n is a, c, t, g, unknown, or other
aaagctggagctccccgcggtggcggccgctctagaactagtggatcccccgggctgcaggaattcgcacgagaccattacctagaacatcctaatcgaaaattatctccctgactcgcctcgtcctccagatatcggccgccaccttcacctccaccgccccggagcacctgtgcgtctccatcgtcgccgcctctcctccttcggacacgactgaccttccactggcgccaacgaagaaaacacataggaagaagctcaccgccaaacctcatccagatccagtcgctgccctccgaaggccgcatacggaacgtctcgtctcttcctttggatccggcggtcaactccatcacccccagcttcacctcccttagtgcgcctccgtccgctctcacccaccgcttctatatcgccacctctctcgttgtagaagaagacactgaggatctggctttctggaatcacatttctggagaactatctggtggagaactaaactaggctcttggtcatattatggatcagcaagctaggattgatgctgattttcttgaaccaactgtactcttagatgagacccattaccagnaggggtacaaaaatggctataatgatggttgggcattctggaaagggaaaggggagggcaggttggtttaaagatgggttttccagggcgg

SEQ ID NO: 20314 - protein, 47 aa, Zea mays
  misc_feature: Ceres CLONE 1388514-F
  misc_feature (25)..(25): Xaa is any aa, unknown, or other
MDQQARIDADFLEPTVLLDETHYQXGYKNGYNDGWAFWKGKGEGRLV

SEQ ID NO: 20315 - DNA, 741 bp, Zea mays
  misc_feature: Ceres CLONE 1388519-F
  misc_feature (268)..(268): n is a, c, t, g, unknown, or other
  misc_feature (284)..(284): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (585)..(585): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (595)..(595): n is a, c, t, g, unknown, or other
  misc_feature (596)..(596): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (612)..(612): n is a, c, t, g, unknown, or other
  misc_feature (618)..(618): n is a, c, t, g, unknown, or other
  misc_feature (625)..(625): n is a, c, t, g, unknown, or other
  misc_feature (627)..(627): n is a, c, t, g, unknown, or other
  misc_feature (654)..(654): n is a, c, t, g, unknown, or other
  misc_feature (659)..(659): n is a, c, t, g, unknown, or other
  misc_feature (689)..(689): n is a, c, t, g, unknown, or other
  misc_feature (700)..(700): n is a, c, t, g, unknown, or other
  misc_feature (706)..(706): n is a, c, t, g, unknown, or other
  misc_feature (715)..(715): n is a, c, t, g, unknown, or other
  misc_feature (718)..(718): n is a, c, t, g, unknown, or other
  misc_feature (733)..(733): n is a, c, t, g, unknown, or other
  misc_feature (736)..(736): n is a, c, t, g, unknown, or other
  misc_feature (737)..(737): n is a, c, t, g, unknown, or other
  misc_feature (741)..(741): n is a, c, t, g, unknown, or other
gctctagaacaggtggatcccccgggctgcaggaattcgcacgagaccattacctagaacatcctaatcgaaaaacgggtcaccagtcaccacatccctccctcactgccatttgtttggttgttcctctcgctcgccagtcgccaccaggcagcaggcatcccaatctcgcgagagccagtagcgggggcggcgcttccggctcccttcccatgggcctccgggatgggctccgcctcacgacgtgggggtctggctctcccgccgntcgccgcccgccgccnaggggcggcagtttcgtcgccgtcgcctccatgacgtcggccgccgtctccacagggggggagaacaagaagccattgggtccctccgagggagggacctggtcaaggttacactttcaatggcatcctcccacaaccgaaattttccaagccccttgggggattgggcctaagagaataaatttttggaccatttctaaaccccaggccgaagaaggggtggggaagcccaaagggttttccctcccgcgaaccccccggnnnnnnnnnnnnnnnnnnntnnnntnnnnnnnnnnnnntntnnntnnntnntnnnnnnnnnnnnntntttttnttttttntnttttttttttttttttttttttttttnttttntttttttttttttttttttttttttttttnttttttttttntttttnttttttttnttnttttttttttttttnttnntttn

SEQ ID NO: 20316 - DNA, 676 bp, Zea mays
  misc_feature: Ceres CLONE 1388522-F
  misc_feature: Translation starting site: 252
aaagctggagctccccgcggtggcggccgctctagaactagtggatcccccgggctgcaggaattcgcacgagaccattacctagaacatcctaatcgaaaaactcggcacgcaggcagaggcagcatagcagcagccaactccatccatcctctttcccctcctcgcttgtcgcttcgcttcctcggcggattcctcctccctcgagcgtccccgtccccgtccccttccggagcgcgagctcgcccgagatggcaaacgcgagatcgggtgtagctgtgaatgaagagtgcatgctcaagttcggagagctgcagtcgaagaggctgcactgctctctaacttccagatggacgagcagttcagggagatcggtgtaggacgaggtcggggatcgtgctaccagctacgaggacttcacaaacgggcttcccggagaatgactgccgatacgcgatctatgatttcaactttgcccctggacaaggagggccagaaaaacaggacctcctatttcctaaggctccccttcctcccccagggggagaaagaaaatgggtttattggaggtccaaaccaaaaatccaaaaggggggtcaaggggattccggggggattggaaggttagtgggggaagggaaatccccccttgaggaaaacgggggagtcggccccc

SEQ ID NO: 20317 - DNA, 666 bp, Zea mays
  misc_feature: Ceres CLONE 1388523-F
  misc_feature: Translation starting site: 220
  misc_feature (389)..(389): n is a, c, t, g, unknown, or other
  misc_feature (396)..(396): n is a, c, t, g, unknown, or other
aaagctggagctccccgcggtggcggccgctctagaactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttgcggggggggagtgntgctggnaagcacgtgccccgtgctggttttgttgaccttgacccactgtcatcgatgaggggaggactggcacctaccgccagctcttccaccctgagcagctcatcagggggaagggagatgcagcccacaactttgcccgtggtcactacaccatggccagggagattgttgacctatgccttgatcgcatcagggagctttgcgaccactggactggtctccagggcttctcgtctttcaacgttgttgggggagggaacggctctggccctg

SEQ ID NO: 20318 - DNA, 684 bp, Zea mays
  misc_feature: Ceres CLONE 1388524-F
  misc_feature: Encodes the peptide sequence at SEQ ID NO. 20319
  misc_feature (396)..(396): n is a, c, t, g, unknown, or other
aaagctggagctccccgcggtggcggccgctctagaactagtggatcccccgggctgcaggaattcgcacgagaccattacctagaacatcctagtcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgcccgccggcctgtacccctacgcggagtacctgaggcagccgcagtgcagcccgctggcggcggcgccctactacgccgggtgtgggcagcccancgtcatggtccagccgctccgggcaacagtgctgccagcatcagatgaggatgatggacgtgcagtccgtcgcgcagcagctgcagatgatgatgcagcttgagcgtgccgctgccgccagcaggcagctgaacgagccggctctgatgcagcagcagcacgagctgctgggagcccagggtctcaaccccatggccatgatgatggcccagaacatgccgggcagggtggaactctaccaggaccaggttgcccggtaccgcaccacccccgggggcgtctccgctg

SEQ ID NO: 20319 - protein, 81 aa, Zea mays
  misc_feature: Ceres CLONE 1388524-F
MRMMDVQSVAQQLQMMMQLERAAAASRQLNEPALMQQQHELLGAQGLNPMAMMMAQNMPGRVELYQDQVARYRTTPGGVSA

SEQ ID NO: 20320 - DNA, 713 bp, Zea mays
  misc_feature: Ceres CLONE 1388525-F
  misc_feature: Translation starting site: 198
  misc_feature (411)..(411): n is a, c, t, g, unknown, or other
aaagctggagctccccgcggtggcggccgctctagaactagtggatcccccgggctgcaggaattcgcacgagaccattacctagaacaccctaatcgaaaaaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatgggcttcagcaagctgaccggcggcggcccgacgaccccggcgggcctgatcgcggcggcgtggcgcacgcgttcgcgctgttcgtggncgtgtctgtgggcgcgaacatctccggcaggcacgtgaaccctgccgtgaccttcggcgccttcgtgggcgcaacatcaccctggtccgggggctcctgtactgggtggcgcagctgctggggtccaccgtggcgtgctccctgctccgcttctcgacggggggcaaggccacgggcacttcgggctgacgggcgtgtcggtgtggaaggccctggtgcctgaaatcgtgatgaccttcgggctggggaaccgtggtacgccacgggggggacccaaaaaaaggcagcctgggcaccttccc

SEQ ID NO: 20321 - DNA, 682 bp, Zea mays
  misc_feature: Ceres CLONE 1388529-F
  misc_feature: Encodes the peptide sequence at SEQ ID NO. 20322
gctctagaactagtggatcccccgggctgcaggaattcgcacgagaccattacctagaacatcctaatcgaaaactccccaactctccgtttgtcttctgcgcctccatttcggcctctgtcccttgcaagttgaatctcatgctccaccatgtataaagagaaggcgcacatcaacattggggttattggccatgtccactctggcaagtccaccatcacaggacactttatctactagctcggaggcattgacgagcgtgtgatcgagaggcctaaaaaggatggttctgaaatgaataaccactccttcaagaactcgtggatgctcaacaacatccacgggtggggggggggaggggcatcacccattgatattgctctgtcgcaacacttagaccaccatgtactactgcaggtgaattgatgccccctgacatccgatactttttcatgaacatgatccctgcctacctctcagccttgactgtggtgtcccttatgatggactccagcccctgggtgcatgtgaaggttggtatcctcccaggtgggggtctgtaggcggggaaaaattgttccagcttggggttcccccctttggagtggaagcgataggattttgcctgcctcgcaaaaaagatggaatgcaaccacctcgccaaagtaatcaaggggcgtgg

SEQ ID NO: 20322 - protein, 29 aa, Zea mays
  misc_feature: Ceres CLONE 1388529-F
MYKEKAHINIGVIGHVHSGKSTITGHFIY

SEQ ID NO: 20323 - DNA, 740 bp, Zea mays
  misc_feature: Ceres CLONE 1388530-F
  misc_feature: Encodes the peptide sequence at SEQ ID NO. 20324
  misc_feature (436)..(436): n is a, c, t, g, unknown, or other
  misc_feature (463)..(463): n is a, c, t, g, unknown, or other
  misc_feature (506)..(506): n is a, c, t, g, unknown, or other
  misc_feature (530)..(530): n is a, c, t, g, unknown, or other
  misc_feature (662)..(662): n is a, c, t, g, unknown, or other
  misc_feature (668)..(668): n is a, c, t, g, unknown, or other
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgaaaaagttgccatctcgcaaagtcgcaataacttgtcttctcgaatcggctgcaaccccaccccagaccccaccgccgccgccgctagggttttggggtgaggatcgccgatgtcgacggctcccaggcgtcccttccgaggccgcggcgccatgccctcgggcaccggctacgtccgccgcggccccgccccaggctccgccgacgccgccaagcccctgcgcaagcccgtcttcaccaccgtcgaccagcttcgcccccagacacacggtcacactctcacagcccgcgtcattggcgtccgcaccgtcctcgacaagccctccacgcacctcggncgcacccgcgtcgccgagtgcctcgtncgagacagcaccggcaccgtcctcgtcaccgcccgcaacgaanaggttgaccttttgaagcagatancacagtgatcttccgcaatgccaagattgatatgttcaaggcaccatgagactggcggtggacagtggggccggattgaggtgactgattcttctggtttcagggtgatgaaaacacacatgtcactgggtnagtacnanctggtggatggggatggagaagagtgagctgaaccgatattgcatttgcatctgttggggccagccgtgt

SEQ ID NO: 20324 - protein, 95 aa, Zea mays
  misc_feature: Ceres CLONE 1388530-F
  misc_feature (86)..(86): Xaa is any aa, unknown, or other
  misc_feature (94)..(94): Xaa is any aa, unknown, or other
MPSGTGYVRRGPAPGSADAAKPLRKPVFTTVDQLRPQTHGHTLTARVIGVRTVLDKPSTHLGRTRVAECLVRDSTGTVLVTARNEXVDLLKQIXQ

SEQ ID NO: 20325 - DNA, 675 bp, Zea mays
  misc_feature: Ceres CLONE 1388531-F
  misc_feature: Encodes the peptide sequence at SEQ ID NO. 20326
  misc_feature (418)..(418): n is a, c, t, g, unknown, or other
aaagctggagctccccgcggtggcggccgctctagaactagtggatcccccgggctgcaggaattcgcacgagaccattacctagaacatcctaatcgaaaaatcatacctccgaggctccgaccaaaacaccagggtcccagtgctcttggctctaagatggcggcgccggaaccggaggccaagctggaagccgtaaccccatctcggtcccacgagctgccaccggagtccgaatccgacgcccctgcctccaccggcagccaggagctaaagccgtgggagcagcacgccgcggtgatcaacctcccgcgctacgactaccgcgcatcagggtccctcctcctccgttcgcattccggcttcctcatcacgtgccgcgtcaagcgtgaaaaaagtgcaaccaagggaagcattnccatccttgaagagtaccatgcaaattgctgtgtttctgaacatgcagaaccatgtgatgtgaaaatgcaattaagaaaagaaaactgtgctcggaggcatcaggaaagttagaagaggcagtaacgaatgggaatagtagcagtgtttcagaatcaattggaaggaccggaaacaccagctcaccccagtcccaagggaaatgacaatgtttgacagggcttcaaatcctccactggttaagctatcaagaagggg

SEQ ID NO: 20326 - protein, 123 aa, Zea mays
  misc_feature: Ceres CLONE 1388531-F
  misc_feature (87)..(87): Xaa is any aa, unknown, or other
MAAPEPEAKLEAVTPSRSHELPPESESDAPASTGSQELKPWEQHAAVINLPRYDYRASGSLLLRSHSGFLITCRVKREKSATKGSIXILEEYHANCCVSEHAEPCDVKMQLRKENCARRHQES

SEQ ID NO: 20327 - DNA, 680 bp, Zea mays
  misc_feature: Ceres CLONE 1388534-F
  misc_feature (429)..(429): n is a, c, t, g, unknown, or other
aaagctggagctccccgcggtggcggccgctctagaactagtggatcccccgggctgcaggaattcgcacgagaccattacctagaacatcctaatcgaaaaatcgcacatattatttagaccaactagcaacatagaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgtgcggcgggaatcatcagccctattacagcagttaccttttggtgcatttattngcacaaaacatcaggggaacaacaactaccacaactttgggctaagcaaaccttgctggcctactcctcagaaacagaaggtttctccattcaaccaaactagctgcattggaactctgcttccttatttggaaaaaaaaacaaattaccattcagcccagttacctgggtggccaaccccccaggaaattttcttccattcaaccccaatgggggaaggattgaaaccctccccgggctatttaaaacag

SEQ ID NO: 20328 - DNA, 688 bp, Zea mays
  misc_feature: Ceres CLONE 1388539-F
  misc_feature: Translation starting site: 229
  misc_feature (393)..(393): n is a, c, t, g, unknown, or other
  misc_feature (409)..(409): n is a, c, t, g, unknown, or other
aaagctggagctccccgcggtggcggccgctctagaatagtggatcccccgggctgcaggaattcgcacgagaccattacctagaacatcctaatcgaaaaacaagctcgatcaccaacccagctcggtcgtcccagctgatcaggtcgagcaccttgcgacctgctcgatcatcagtgtagagtgtctgtaggtgtctgtctctcttggtggctggttgcaacggtcatggcgacgtcgtctcgtcgggtgcccttgctgctgctggtcctgggcgtgctggtgtcgtgctccttcgcgggcggcagcttggaccaggagctggacatcacgtggcgcgacggcggggcaaggtcctggacacgggcgggtggtgggggtgtcgctggaccncacgtccggctccggntcccaggtccggcacgagtacctgttcggaagatcgacatgcagctgcggttggtgccggacactccgccggcaccgtcaccgcctactaactgtcggcgaagggggggcgggaacgacgagattgaatttcgaagtcctggggaaaggggtccggggaagccctaaccggtgtaacaccaagggggtttccccggggggaagggggcagcgggaagcaaaaaattccccccttctgggttccaaccccaccgggggagcttcccaaccctaattcccc

SEQ ID NO: 20329 - DNA, 685 bp, Zea mays
  misc_feature: Ceres CLONE 1388541-F
  misc_feature (369)..(369): n is a, c, t, g, unknown, or other
  misc_feature (397)..(397): n is a, c, t, g, unknown, or other
  misc_feature (430)..(430): n is a, c, t, g, unknown, or other
  misc_feature (674)..(674): n is a, c, t, g, unknown, or other
aaagctggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgatcgccgaggcgaggaacatcaagaccacgacgacngaaaagaagggacgacgcggtggtgcanccgcagaccttcccgcccttcgaccgcctcggnggcggcgcgtccccggcgttcggcgggctccccggcggcagcattcctggcagcagcattcccggggtcagcatgcccggcagcggcagcagcctacccgggttcagcttgcccggcagcggcagcatgccccctcttcggcggggggctccccggggcttcagcggctttcggcgtcatgcccggggtcccccaccgccgggctccgtcccccgaggacggccaacagccctgaacgccaacnagcgtggttag

SEQ ID NO: 20330 - DNA, 673 bp, Zea mays
  misc_feature: Ceres CLONE 1388542-F
  misc_feature (370)..(370): n is a, c, t, g, unknown, or other
  misc_feature (387)..(387): n is a, c, t, g, unknown, or other
  misc_feature (505)..(505): n is a, c, t, g, unknown, or other
  misc_feature (524)..(524): n is a, c, t, g, unknown, or other
aagctggagctccccgcggtggcggccgctctagaactagtggatcccccgggctgcaggaattcgcacgagaccattacctagaacatcctaatcgaaaattcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtgncgccgctcctggtgctncacctcatcatgtacatcatcgtcatcggcttcgcgagctggaacctgaaccacttcatcaacgggagaccaactaccccggcgtggccggcaacggcgcgacgttctacttcctggntgtcgccatcctggccggncgtggtgggcgctgcgtccaagctgggcgggcgtgcaccacgtgcgcgcctggcgccacgacaggctggccaccaacgccgcgtcgtcgctcatcggctgggccatcacggcgctcgccttcgggctggccctgcaagagatccacatt

SEQ ID NO: 20331 - DNA, 692 bp, Zea mays
  misc_feature: Ceres CLONE 1388544-F
  misc_feature: Encodes the peptide sequence at SEQ ID NO. 20332
  misc_feature (262)..(262): n is a, c, t, g, unknown, or other
  misc_feature (395)..(395): n is a, c, t, g, unknown, or other
  misc_feature (397)..(397): n is a, c, t, g, unknown, or other
  misc_feature (621)..(621): n is a, c, t, g, unknown, or other
agagctggagctccccgcggtggcggccgctctagaactagtggatcccccgggctgcaggaattcgccgagaccattacctagaacatcctaatcgaaaaccaagggccaaggcagggcactgcactgcacgcatgcactgacctgacgacgacgcgcgccacagtccacagctccacactcagacatggcgatgggcgccgcttccatcctactgatgatggtttcgctggaggccctgcttctcgccgccgccgccggngccggcgggaacatccgtctgcccagcgatgtcggaggcgttgctgcagaccttgtcacggcgatggccgagggcgagggcaagggcaaagcatcaccttccccaccaggagagggcgggggggggaatgctncnacttggccgtatgcggtcaggacgtacccgctaacttgctcgggcttcgatcgggttgagcgctgctcccacccccggaagggagcgcggggaaacggaggactccgcgcaccgtctgggttcgacgggtacccggggccacccccggccccaggggccacaacgaaggaaggggaggaaggggcggaccccgctaacaacaacgcttggggggcaagcgaccnccaacggggggggatggcaaaaggacaaaaaaagcggggggggggccgaccacccaccaaagaaaaaggcg

SEQ ID NO: 20332 - protein, 168 aa, Zea mays
  misc_feature: Ceres CLONE 1388544-F
  misc_feature (70)..(70): Xaa is any aa, unknown, or other
  misc_feature (145)..(145): Xaa is any aa, unknown, or other
MAMGAASILLMMVSLEALLLAAAAGAGGNIRLPSDVGGVAADLVTAMAEGEGKGKASPSPPGEGGGGNAXTWPYAVRTYPLTCSGFDRVERCSHPRKGARGNGGLRAPSGFDGYPGPPPAPGATTKEGEEGADPANNNAWGASDXQRGGMAKGQKKRGGGRPPTKEKG

SEQ ID NO: 20333 - DNA, 728 bp, Zea mays
  misc_feature: Ceres CLONE 1388545-F
  misc_feature: Encodes the peptide sequence at SEQ ID NO. 20334
  misc_feature (664)..(664): n is a, c, t, g, unknown, or other
  misc_feature (665)..(665): n is a, c, t, g, unknown, or other
tggagctccccgcggtggcggccgctctagaactagtggatcccccgggctgcaggaattcgcacgagaccattacctagaacatcctaatcgaaaaaaaaaaaaaaattatcacggcggcggtggcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttcaagctttgcaggggtaggtctgttcagtttgggcagaagggcatcccttatctgaacacgtatgacggccgcaccatccgctaccctgaccccctcatcaggnncacgacaccattcagatcgatctggagaccacaggatgtggacttctccaggttgatggttgc

SEQ ID NO: 20334 - protein, 176 aa, Zea mays
  misc_feature: Ceres CLONE 1388545-F
  misc_feature (94)..(164): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
  misc_feature (156)..(156): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCRGRSVQFGQKGIPYLNTYDGRTIRYPDPLIRXTTPFRSIWRPQDVDFSRLMV

SEQ ID NO: 20335 - DNA, 836 bp, Zea mays
  misc_feature: Ceres CLONE 1388546-R
ggggcctggagtgttctttcttctttctgggtagccaaaacatcatccatattacttcgttattgaactattactcataagcaatctaaaagagggcaccaccaatgatgggttgttggtagaacactgctgggtttgtcaaatcaagttagttgaatggcagcaattgttgcaattgtaagaaggtgccagcattaggcatagcgtgcaagtagaacggcaacaactgttgttgtgtcaagaaagcagcacggctcacatcagttagctggctgaatgggagtagttgttgctgctgtaaataatcagcagagttcaatgctgctagttggttgaatggaagaaattgctgggggtaggcagcatctagctggctgaatggtagttgttgttgcaaataagcaccatagttcaatgcagccagttggttgaatggaagaaactgatgtcactgagagtatgcaacaaagcttgctagcacaaattgttgtagttgttttgccctgatcttttgtgccaccaaatgcaccaaatgaaactgctgtaataaagctgaccgaagttagcagaactaaggtgattaagggaagatgccagttccgattgcctgttggaaccaggatggttgaaaaattggggttttatatagtgaagaacaccctggtgatacctatggagggagaaagcgagtgtctatagggtttggaaggattaagggtaaaatggttcgacgatatcttcatctatgataaaaatgcttgccctcttttggaaaacatcaaacagtagtcttgccttctttacggaccaatatattgaccatcctgcgaatgcca

SEQ ID NO: 20336 - DNA, 667 bp, Zea mays
  misc_feature: Ceres CLONE 1388548-F
  misc_feature: Encodes the peptide sequence at SEQ ID NO. 20337
  misc_feature (361)..(361): n is a, c, t, g, unknown, or other
  misc_feature (453)..(453): n is a, c, t, g, unknown, or other
  misc_feature (541)..(541): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatcctaatcgaaaaatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcagggctaagatccaggacaaggagggcatccctccctgacagcagcggcttatcttcgccggcaagcagcttgaggacgnacgcacacttgctgactacgagtccagaaggagtcaaccctccacttggtgctgcgccttaggggaggcatgcagatctttgtcaagacttngactggcagacaatcacccttggagtggagtcctcagacacccattgacatgtcaaggcaaagatccaggagcaggagggcatcccancctgacagcaacgtctcatcttttgcggcagcagttggaggatgggaggaccctggctgactancacatccagaaggagagcaccctccacttggtgctgcgtcttagggggggtatgcagatctt

SEQ ID NO: 20337 - protein, 38 aa, Zea mays
  misc_feature: Ceres CLONE 1388548-F
MQIFVKTLTGKTITLEVESSDTIDNVRAKIQDKEGIPP

SEQ ID NO: 20338 - DNA, 736 bp, Zea mays
  misc_feature: Ceres CLONE 1388551-F
  misc_feature: Translation starting site: 272
  misc_feature (552)..(552): n is a, c, t, g, unknown, or other
  misc_feature (582)..(582): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (601)..(601): n is a, c, t, g, unknown, or other
  misc_feature (602)..(602): n is a, c, t, g, unknown, or other
  misc_feature (618)..(618): n is a, c, t, g, unknown, or other
  misc_feature (619)..(619): n is a, c, t, g, unknown, or other
  misc_feature (627)..(627): n is a, c, t, g, unknown, or other
  misc_feature (629)..(629): n is a, c, t, g, unknown, or other
  misc_feature (630)..(630): n is a, c, t, g, unknown, or other
  misc_feature (642)..(642): n is a, c, t, g, unknown, or other
  misc_feature (646)..(646): n is a, c, t, g, unknown, or other
  misc_feature (652)..(652): n is a, c, t, g, unknown, or other
  misc_feature (663)..(663): n is a, c, t, g, unknown, or other
  misc_feature (666)..(666): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (688)..(688): n is a, c, t, g, unknown, or other
  misc_feature (689)..(689): n is a, c, t, g, unknown, or other
  misc_feature (691)..(691): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (705)..(705): n is a, c, t, g, unknown, or other
  misc_feature (708)..(708): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (719)..(719): n is a, c, t, g, unknown, or other
  misc_feature (720)..(720): n is a, c, t, g, unknown, or other
  misc_feature (723)..(723): n is a, c, t, g, unknown, or other
  misc_feature (724)..(724): n is a, c, t, g, unknown, or other
  misc_feature (727)..(727): n is a, c, t, g, unknown, or other
  misc_feature (728)..(728): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
aaagctggagctccccgcggtggcggccgctctagaactagtggatcccccgggctgcaggaattcgcacgagaccattacctagaacatcctaatcgaaaacccttggcttcgttccatccggcttctcggcggcggcggagaggagggggatggcgcaccggctgctgcgcggacgcgcaggagcacgccggcgagggatcgcacttccccatcatctgcgagtcatgcctcggcgacaacccctacgtccggatgaaaacagctgaatatgacaaagaatgcaaaatttgcgcacggccttttactgaattccgagtggcggcctgagcaaaatgtaaggtacaagaagactgacatctgccagacatgttgcaagctaaagaatgtctgccaggtctgcctgctggatcttgaatatggtctgcctgttcaggtccgagatacagcactctctatcaattccaatgatgcaattccgaggagtgatgtcaatcgcgaatattttgcacaagagcatgataggagggccagagctggcatagactatgnatcatcctatggggaaggctcgtcccacgnaaccaaagnnnntgactanntgtacctagctctggnntggaaagngnntgggtgtagagncgcnagagcnggggggtttgntcnaagtgnnnnntggagtatgagnnanagaaagacnnnngnagnatgnnnaccgnncgnntgnnaannnnnn

SEQ ID NO: 20339 - DNA, 711 bp, Zea mays
  misc_feature: Ceres CLONE 1388554-F
  misc_feature: Translation starting site: 219
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (478)..(478): n is a, c, t, g, unknown, or other
caaagctggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttggtgaccttgaaccactgtcatcgatgaggtggagactggnnnactacgccaggtcttncaccctgagcagctcatcagtgggaaggaggatgcagccacaactttggccggtggccactacccattggcaaggagaatggttgacctatggcttgatcccatcaggaaacttgccgaaaactggactgggctccaggggttcccccgctttacacgttgtggggggaggaacgggttctgggcctgggtccccccccccaaaaagggccttgttttttataaccgaaaaaa

SEQ ID NO: 20340 - DNA, 737 bp, Zea mays
  misc_feature: Ceres CLONE 1388555-F
  misc_feature: Encodes the peptide sequence at SEQ ID NO. 20341
  misc_feature (285)..(285): n is a, c, t, g, unknown, or other
  misc_feature (344)..(344): n is a, c, t, g, unknown, or other
  misc_feature (347)..(347): n is a, c, t, g, unknown, or other
  misc_feature (348)..(348): n is a, c, t, g, unknown, or other
  misc_feature (391)..(391): n is a, c, t, g, unknown, or other
  misc_feature (450)..(450): n is a, c, t, g, unknown, or other
  misc_feature (514)..(514): n is a, c, t, g, unknown, or other
atagctggagctccccgcggtggcggccgctctagaactagtggatcccccgggctgcaggaattcgcacgagaccattacctagaacatcctaatcgaaaaaccagacgccagtccaccaccgcttcccgtgcagcgccctccctctacgttcccccatttcctgtgttggcggcgatggcgcggcacttcgtgctcaacaccggcgccaagatcccctccgtggggctcggcacctggcagtctgaccccggcgtcgttggcaacgctgtctacgccgccgtncagggcgggtaccgacatatcgattgtgccagagttttacgcaacgaaaaggagatggnttnngcgctgaagaagctatttgaagaaggtgtagtgaagcgagaanatctgtttatcacctctaagctatggaatgatcatcatgctcctgaagatgtgcctgangcactaaatgacagcctgaatgatttgcagcttgagtacctggatctttatcttatccatgggncatttagagtcaagaaggaaacaataccagccctgaaattttgtaacacctgacttccctggtacttgggggggaatggaaaagttatatgatgcttgcaaagctcgcgctattggggggaataacttctcctcaaagaattggggggactggcttgcttgaactcggggaacctcaggtggtgatcagggggaatgccatcctggtgggaagaaaactaagg

SEQ ID NO: 20341 - protein, 129 aa, Zea mays
  misc_feature: Ceres CLONE 1388555-F
  misc_feature (7)..(129): Pfam Name: Aldo_ket_red Pfam Description: Aldo/keto reductase family
  misc_feature: SWISSPROT Homolog: EC 1.1.1.21 Aldehyde reductase
  misc_feature (56)..(56): Xaa is any aa, unknown, or other
  misc_feature (57)..(57): Xaa is any aa, unknown, or other
  misc_feature (72)..(72): Xaa is any aa, unknown, or other
  misc_feature (91)..(91): Xaa is any aa, unknown, or other
  misc_feature (113)..(113): Xaa is any aa, unknown, or other
MARHFVLNTGAKIPSVGLGTWQSDPGVVGNAVYAAVQGGYRHIDCARVLRNEKEMXXALKKLFEEGVVKREXLFITSKLWNDHHAPEDVPXALNDSLNDLQLEYLDLYLIHGXFRVKKETIPALKFCNT

SEQ ID NO: 20342 - DNA, 723 bp, Zea mays
  misc_feature: Ceres CLONE 1388559-F
  misc_feature: SWISSPROT Homolog: EC 2.3.1.170 6'-deoxychalcone synthase
  misc_feature (207)..(207): n is a, c, t, g, unknown, or other
  misc_feature (313)..(313): n is a, c, t, g, unknown, or other
  misc_feature (438)..(438): n is a, c, t, g, unknown, or other
  misc_feature (452)..(452): n is a, c, t, g, unknown, or other
  misc_feature (457)..(457): n is a, c, t, g, unknown, or other
  misc_feature (462)..(462): n is a, c, t, g, unknown, or other
  misc_feature (640)..(640): n is a, c, t, g, unknown, or other
aaagctggagctccccgcggtggcggccgctctagaactagtggatcccccgggctgcaggaattcgcacgagaccattacctagaacatcctaatcgaaaaagtcaagtcggagcccgcaggtgtcgacaccgcgcgccgggagccggaagaagggtggggggtgagctgtggaccatgagcgcgaccgggcgagccccgtgcggnctgccgcgcatcggcctgggcacggcggtgcaggccccgcggccggacccgtccgcgccgcggtgctgcgcgccatccagctcgggtaccgccacttcgacacggncgcgcactacgccaccgaggcgcccatcggggaggccgcccgccgagccgtgcgcacggggctcgtcgcctcccgcgaggacctcttcgtcacgtccaaggtctggtgcgccgacgcgcaccggnacagggtgctcccnggccntccgncggacgctcagcaatctccagatggaatacgtggacctgtacatggtgcactggcccgtgacatgaaggccgggaggttcacggccccctcacgcccgaggacttcgagccgttcacatgcgggccgtggtggaggccatgaaggagtgccacgcctggggctgcacaggccatcggngtgtgcaacttctctgcaggagctcgagacctggtctctttcgcacattcctcggggggaaatcagggtgaaatcaacccggg

SEQ ID NO: 20343 - DNA, 727 bp, Zea mays
  misc_feature: Ceres CLONE 1388560-F
  misc_feature: Translation starting site: 170
  misc_feature (338)..(338): n is a, c, t, g, unknown, or other
  misc_feature (523)..(523): n is a, c, t, g, unknown, or other
caaagctggagctccccgcggtggcggccgctctagaactagtggatcccccgggctgcaggaattcgcacgagaccattacctagaacatcctaatcgaaaaatttttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcnagccccgcgttcccagcacccgcaagcctaagcctaccaagctcaggtcgagcatcacgcctgggacggtgctgatcctcctcgcagggcgcttcatggggaagagagtggtgtttctcaagcagctcaagtctggcctgctccttatctctgggccttttcagatcaatggagtaccgatccgnccgtgtgaaccagacctatgtcattgctacatcaacaaaagtgacatcttctggtggtgatgtcccccagtttgatgaacagtactttgccaaggaaaaaaaacagaaggggaaaaaaacggagggcgagctttttgaaaccgaaaaggagggttccaaggccctgcctgactccaagaaggtgcacaaagggtggggattcgt

SEQ ID NO: 20344 - DNA, 734 bp, Zea mays
  misc_feature: Ceres CLONE 1388561-F
  misc_feature: Encodes the peptide sequence at SEQ ID NO. 20345
  misc_feature (326)..(326): n is a, c, t, g, unknown, or other
  misc_feature (485)..(485): n is a, c, t, g, unknown, or other
  misc_feature (513)..(513): n is a, c, t, g, unknown, or other
  misc_feature (534)..(534): n is a, c, t, g, unknown, or other
  misc_feature (627)..(627): n is a, c, t, g, unknown, or other
  misc_feature (648)..(648): n is a, c, t, g, unknown, or other
  misc_feature (678)..(678): n is a, c, t, g, unknown, or other
  misc_feature (694)..(694): n is a, c, t, g, unknown, or other
aaagctggagctccccgcggtggcggccgctctagaactagtggatcccccgggctgcaggaattcgcacgagaccattacctagaacatcctaatcgaaaaaatttcactttccttctctcctctcctcctgctgctactaggttcgggccgtccgtccttgctcttgatctgcattatttaattcggaccattcccccgccgtcctcccgcccgcctgccggagatggagatggagaacgggcacgccaagtaccgggtggccgtcattggcagcggcaactggggcagcgtcgcctcccgcctcatcgcctccaacaccgccnagctgccctccttctatgatgaagtaaggatgtgggtgtttgaggaaatactgcctacaggcaggaagctatctgagtccattaacgaacagaatgagaactgcaaatacttgccaggtataaagcttggaacgaatgttattgccgaccctgacttgnagagcgcagtcaaagacgcgaatatgcntggtttttgtgacgccccatncatttgtggagggtatatgtaaagaagcttgtagggaagctaacacccagagctgaggctatctccctccatcagggcatgggagtcagatgnaaggggcgtgcatgatatccnagttaatcgcggatacacttggaatcattngctgtgtgctcatggntgctaacatgcaaacgagattgctgtccaagagtcagtga

SEQ ID NO: 20345 - protein, 109 aa, Zea mays
  misc_feature: Ceres CLONE 1388561-F
  misc_feature (10)..(106): Pfam Name: NAD_Gly3P_dh_N Pfam Description: NAD-dependent glycerol-3-phosphate dehydrogenase N-terminus
  misc_feature: SWISSPROT Homolog: EC 1.1.1.8 Glycerol-3-phosphate dehydrogenase (NAD(+))
  misc_feature (34)..(34): Xaa is any aa, unknown, or other
  misc_feature (87)..(87): Xaa is any aa, unknown, or other
  misc_feature (96)..(96): Xaa is any aa, unknown, or other
  misc_feature (103)..(103): Xaa is any aa, unknown, or other
MEMENGHAKYRVAVIGSGNWGSVASRLIASNTAXLPSFYDEVRMWVFEEILPTGRKLSESINEQNENCKYLPGIKLGTNVIADPDLXSAVKDANMXGFCDAPXICGGYM

SEQ ID NO: 20346 - DNA, 728 bp, Zea mays
  misc_feature: Ceres CLONE 1388563-F
  misc_feature: Encodes the peptide sequence at SEQ ID NO. 20347
  misc_feature (482)..(482): n is a, c, t, g, unknown, or other
  misc_feature (494)..(494): n is a, c, t, g, unknown, or other
  misc_feature (511)..(511): n is a, c, t, g, unknown, or other
  misc_feature (512)..(512): n is a, c, t, g, unknown, or other
  misc_feature (525)..(525): n is a, c, t, g, unknown, or other
  misc_feature (600)..(600): n is a, c, t, g, unknown, or other
  misc_feature (667)..(667): n is a, c, t, g, unknown, or other
aaagctggagctccccgcggtggcggccgctctagaactagtggatcccccgggctgcaggaattcgcacgagaccattacctagaacatcctaatcgaaaaattccccgtttgccttgtttaccattcctccccaaaacacatcctgcgatcctcgaaacctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaagggatggcagccttttgtcgatgtcctcaaggagggaggcgtcctccctggncatcaggtcgancagggcaccattgaggnntgtggcaccgacnaggagaccacaccccagggcacgatgacctcggcaagcgctgcgctaagtactacgaggccggtgcccgctttgnccaagtggcgtgctgtctcaagattgccccacgagccgtcacagcttgcattgacctgaatgctcanggtctggctcgctacgcatcatctgcaggagaacgtctggtgccattggtgagcctgaatc

SEQ ID NO: 20347 - protein, 159 aa, Zea mays
  misc_feature: Ceres CLONE 1388563-F
  misc_feature (11)..(160): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (105)..(105): Xaa is any aa, unknown, or other
  misc_feature (111)..(111): Xaa is any aa, unknown, or other
  misc_feature (116)..(116): Xaa is any aa, unknown, or other
  misc_feature (141)..(141): Xaa is any aa, unknown, or other
MSAYCGKYADELIKNAAYIGTPGKGILAADESTGTIGKRLSSINVENVEENRRALRELLFCCPGALQYISGVILFEETLYQKTKGWQPFVDVLKEGGVLPGHQVXQGTIEXCGTDXETTPQGTMTSASAALSTTRPVPALXKWRAVSRLPHEPSQLALT

SEQ ID NO: 20348 - DNA, 766 bp, Zea mays
  misc_feature: Ceres CLONE 1388564-F
  misc_feature: Encodes the peptide sequence at SEQ ID NO. 20349
  misc_feature (264)..(264): n is a, c, t, g, unknown, or other
  misc_feature (267)..(267): n is a, c, t, g, unknown, or other
  misc_feature (268)..(268): n is a, c, t, g, unknown, or other
  misc_feature (336)..(336): n is a, c, t, g, unknown, or other
  misc_feature (337)..(337): n is a, c, t, g, unknown, or other
  misc_feature (362)..(362): n is a, c, t, g, unknown, or other
  misc_feature (372)..(372): n is a, c, t, g, unknown, or other
  misc_feature (397)..(397): n is a, c, t, g, unknown, or other
aaagctggagctccccgcggtggcggccgctctagaactagtggatcccccgggctgcaggaattcgcacgagaccattacctagaacatcctaatcgaaaaaatcgcaagctcaagcaaaaacacaaagcgcttaaaccacactcaaaccaaccgccagccaacaaacaggcctcctagtcccgaccagaactcgctcgtagccccgagaacccgacagcgcgagatggctcccgagctgatgacagccaagatgaccgccanggnncgcgcggcggcggcggcggcggctgcgtctaaccctggcacgagggcgtacgtgacgttcctggcggnncgacgccactactggaaaggcgtgntggggctggncaaggcctccgcagggccgcttcgnctaccccctggttgttggccgtctgccccaattggcccaatccaaccgccggatccctctttcgaagggttggctctcccgaaaaccagcccgggtacccccctgaaaaacaaaacaagtgccccgggggaaaaaagtttaaaaaaacccaattccccatttgggaattcggggaaaaaaaaggggggggcccctggccccgaatccccgggggtgagaaaaaaaacggggttttttaataaaaaaagggtttttctcccggggtgggtgcgcttttcaaaaaaaaaggggccacccccccccaataaatttttttttccccaccccccccaagagggggggaaaaaaaacaccccaacaattcccccc

SEQ ID NO: 20349 - protein, 180 aa, Zea mays
  misc_feature: Ceres CLONE 1388564-F
  misc_feature (13)..(13): Xaa is any aa, unknown, or other
  misc_feature (14)..(14): Xaa is any aa, unknown, or other
  misc_feature (37)..(37): Xaa is any aa, unknown, or other
  misc_feature (46)..(46): Xaa is any aa, unknown, or other
  misc_feature (49)..(49): Xaa is any aa, unknown, or other
MAPELMTAKMTAXXRAAAAAAAASNPGTRAYVTFLAXRRHYWKGVXGLXKASAGPLRLPPGCWPSAPIGPIQPPDPSFEGLALPKTSPGTPLKNKTSAPGEKSLKKPNSPFGNSGKKKGGAPGPESPGVRKKTGFFNKKRVFLPGWVRFSKKKGPPPPNKFFFPHPPQEGGKKNTPTIPP

SEQ ID NO: 20350 - DNA, 711 bp, Zea mays
  misc_feature: Ceres CLONE 1388565-F
  misc_feature: Encodes the peptide sequence at SEQ ID NO. 20351
  misc_feature (280)..(280): n is a, c, t, g, unknown, or other
  misc_feature (330)..(330): n is a, c, t, g, unknown, or other
  misc_feature (332)..(332): n is a, c, t, g, unknown, or other
  misc_feature (333)..(333): n is a, c, t, g, unknown, or other
  misc_feature (351)..(351): n is a, c, t, g, unknown, or other
  misc_feature (457)..(457): n is a, c, t, g, unknown, or other
aaagctggagctccccgcggtggcggccgctctagaactagtggatcccccgggctgcaggaattcgcacgagaccattacctagaacatcctaatcgaaaagcggagaggtagcggtggatcgaaaccctaggcgcggtcggcggcgatggcggcggcggcagcagcggcagctgcagcgcctgagtcgtacatcgggagcttgataagcctcatgtcgaagagcgagatccggtacgagggcgtcctgtacacccatcacaccgaggagtccagcatncggctaaaaaaacgtcgctcatttggaactgaaggtcgtaagaagatggncnnacagatcctgccagcgancagatatatgagtacatactctttcgaggaagtgatataaagggatttgcagtcaaatcatctcccacatctcagtcggcaactttacacaatgatcctgctattnatcagtcacattatcctcatccagcttcgctttctacaagtttgccttctgctgcaagcacaatagggagcaaccctacttcacagaatgctccatctttggatcagatgccaccgccatttcaggggaatttgccccttaccagtctgcaccagcttacgtcatggaactcagcactatgccatcatctgcaatgggactggccttacatgccacaatgtactggcaggatataaacacccacactgggtttc

SEQ ID NO: 20351 - protein, 80 aa, Zea mays
  misc_feature: Ceres CLONE 1388565-F
  misc_feature (44)..(44): Xaa is any aa, unknown, or other
  misc_feature (61)..(61): Xaa is any aa, unknown, or other
  misc_feature (62)..(62): Xaa is any aa, unknown, or other
  misc_feature (68)..(68): Xaa is any aa, unknown, or other
MAAAAAAAAAAPESYIGSLISLMSKSEIRYEGVLYTHHTEESSXRLKKRRSFGTEGRKKMXXQILPAXRYMSTYSFEEVI

SEQ ID NO: 20352 - DNA, 740 bp, Zea mays
  misc_feature: Ceres CLONE 1388567-F
  misc_feature: Encodes the peptide sequence at SEQ ID NO. 20353
atagctggagctccccgcggtggcggccgctctagaactagtggatcccccgggctgcaggaattcgcacgagaccattacctagaacatcctaatcgaaaaatcctcgttcctatcgccagttcgccacctcctttgctctcgcctcgcgcgcgctcccccccgcgcatcgtgccgttcgccaccgcaccgcgccgatggaggtcgccgccgtgcccagatccgccgcggcctgccgtgcggcgcccctgctcccggccgtccgagccgctgcgtgccacctggccctgccccggcgcgcgttctccgcatccgtcgcggcggcaccggcgccgcgccgcctcgccgctcgtcgcgctgcggatggtgacagcgtggagacggcgccggaggcggcccccattgagaaaaggttccctcccttccccgagcgtcatggacatcaaccagatccgcgagatcctccccccacaggttccccattccttttggttgataaaggaattgaatacaagggctggagaataatgcaggggggaatcaagaatgttacaataaatgaaaaatttctccccaggaactttttccctgaacgcccccataattgcccgggggccctcatgggcgaaggtaatggccccaggtggggggccctggtgaaggctgcaaacccggaaatttgggggaatctcgaaaacacttctttttttcgccgggaattgaaaaagtaagggttccag

SEQ ID NO: 20353 - protein, 177 aa, Zea mays
  misc_feature: Ceres CLONE 1388567-F
MEVAAVPRSAAACRAAPLLPAVRAAACHLALPRRAFSASVAAAPAPRRLAARRAADGDSVETAPEAAPIEKRFPPFPERHGHQPDPRDPPPTGSPFLLVDKGIEYKGWRIMQGGIKNVTINEKFLPRNFFPERPHNCPGALMGEGNGPRWGALVKAANPEIWGNLENTSFFRRELKK

SEQ ID NO: 20354 - DNA, 720 bp, Zea mays
  misc_feature: Ceres CLONE 1388568-F
  misc_feature: Encodes the peptide sequence at SEQ ID NO. 20355
  misc_feature (523)..(523): n is a, c, t, g, unknown, or other
aaagctggagctccccgcggtggcggccgctctagaactagtggatcccccgggctgcaggaattcgcacgagaccattacctagaacatcctaatcgaaaaacacatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactaacacaacttgtgctaggaaaccttgctgcctactctcagcaacagcagtttcttccattcaaccaactgnctgcattgaactctgctgcttatttgcaaaacacactaccattcagtcagctagctgctgcctacccccagaaatttcttccattcaaacaaactgggaagcattggaactctgctgctaatttacaaaaggaaaggttaccccatttcacccatttagcttatgggagcccctgtttcccttctttaaaaacaaaa

SEQ ID NO: 20355 - protein, 188 aa, Zea mays
  misc_feature: Ceres CLONE 1388568-F
  misc_feature (123)..(123): Xaa is any aa, unknown, or other
MAAKIFCFLMLLGLSASAATATIFPQCSQAPIASFLPPYLSPAVSSVCENPILQPYRIQQAIAAGILPLSPLFLQQPSALLQQLPLVHLLAQNIKAQQLTQLVLGNLAAYSQQQQFLPFNQLXALNSAAYLQNTLPFSQLAAAYPQKFLPFKQTGKHWNSAANLQKERLPHFTHLAYGSPCFPSLKTK

SEQ ID NO: 20356 - DNA, 728 bp, Zea mays
  misc_feature: Ceres CLONE 1388569-F
  misc_feature: Encodes the peptide sequence at SEQ ID NO. 20357
aaagctggagctccccgcggtggcggccgctctagaactagtggatcccccgggctgcaggaattcgcacgagaccattacctagaacatcctaatcgaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaccctataggctccaacaagcaatcgcagcaagcaacatacctttatcacgcttgtttcaacatcgccagccctatcttttgtgcagtcattggtacaaacatcagggcacagcagctgcagcaactcgtgctacctgtgatcaacaagtagctctgcaaaactttctccctactctcagcaacaacattttctccatttcacccactgtctacttggaaccgggctgcttatttgcagaaacaatattaccattcagccagttaattactgcctactctcagaaacacaacttcttcatttaaaccaatggccggactggaccccggtggttatttggagcacgaaatactactaccttttaccccgttaggtgcagcaagccgtggtttccttcttg

SEQ ID NO: 20357 - protein, 103 aa, Zea mays
  misc_feature: Ceres CLONE 1388569-F
MATKIFSLLMLLALSACVANATIFPQCSQAPIASLLPPYLPSMIASVCENPALHPIGSNKQSQQATYLYHACFNIASPIFCAVIGTNIRAQQLQQLVLPVINK

SEQ ID NO: 20358 - DNA, 706 bp, Zea mays
  misc_feature: Ceres CLONE 1388571-F
  misc_feature (287)..(287): n is a, c, t, g, unknown, or other
  misc_feature (288)..(288): n is a, c, t, g, unknown, or other
  misc_feature (313)..(313): n is a, c, t, g, unknown, or other
  misc_feature (314)..(314): n is a, c, t, g, unknown, or other
  misc_feature (326)..(326): n is a, c, t, g, unknown, or other
  misc_feature (329)..(329): n is a, c, t, g, unknown, or other
  misc_feature (330)..(330): n is a, c, t, g, unknown, or other
  misc_feature (337)..(337): n is a, c, t, g, unknown, or other
  misc_feature (348)..(348): n is a, c, t, g, unknown, or other
  misc_feature (352)..(352): n is a, c, t, g, unknown, or other
  misc_feature (353)..(353): n is a, c, t, g, unknown, or other
  misc_feature (419)..(419): n is a, c, t, g, unknown, or other
  misc_feature (424)..(424): n is a, c, t, g, unknown, or other
  misc_feature (426)..(426): n is a, c, t, g, unknown, or other
  misc_feature (427)..(427): n is a, c, t, g, unknown, or other
  misc_feature (462)..(462): n is a, c, t, g, unknown, or other
  misc_feature (463)..(463): n is a, c, t, g, unknown, or other
  misc_feature (566)..(566): n is a, c, t, g, unknown, or other
atagctggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggnncacgactcctcctcctcctcctccnntctcgcgggggnggnngcgctgntctccatcggncgcnntcatcgctcgctcccgcgtgaccagaaaccagatcactcctttcccggcgcgcagaagcacagacngcttncnnagcgcgcgcgcccaaactctgggccgactcccggnnagcgacgacgtcctctccctccgctggacgcgccgctcctcgaatcctcctcctctgcctcgaggagtccgggccctgcttttcggtccggggaatcgccggntgttcggcccccgtcgaacgcttgtcgccgatttctcaacggggcggtaaagggttcgaactttgaaccgccgccgggaaggctcaaacttgcccgcaggggagaagacctcccattggcgaaggggccccctttttctg

SEQ ID NO: 20359 - DNA, 732 bp, Zea mays
  misc_feature: Ceres CLONE 1388572-F
  misc_feature (224)..(224): n is a, c, t, g, unknown, or other
  misc_feature (264)..(264): n is a, c, t, g, unknown, or other
  misc_feature (285)..(285): n is a, c, t, g, unknown, or other
  misc_feature (295)..(295): n is a, c, t, g, unknown, or other
  misc_feature (296)..(296): n is a, c, t, g, unknown, or other
  misc_feature (300)..(300): n is a, c, t, g, unknown, or other
  misc_feature (367)..(367): n is a, c, t, g, unknown, or other
  misc_feature (457)..(457): n is a, c, t, g, unknown, or other
  misc_feature (458)..(458): n is a, c, t, g, unknown, or other
  misc_feature (589)..(589): n is a, c, t, g, unknown, or other
  misc_feature (621)..(621): n is a, c, t, g, unknown, or other
  misc_feature (640)..(640): n is a, c, t, g, unknown, or other
  misc_feature (654)..(654): n is a, c, t, g, unknown, or other
  misc_feature (691)..(691): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (732)..(732): n is a, c, t, g, unknown, or other
aagctggagctccccgcggtggcggccgctctagaatagtggatcccccgggctgcaggaattcgcacgagaccattacctagaacatcctaatcgaaaaacatcgacccagccatctcctcaccctcgttcacacacagtccgccactcctttagtagcttgtgatttgtacgtcgacgagatcactgggtcgggtggcggacgacgacacatggggaagggntagtgtggtgcatcatggtgggcgttcctcctgctcgccngcgtgctgctggtcgtaacancccacgccgnngcgnaggacggagtggtcaaacgggaccgcaaggagacctgcggtggtgcaagcaggcgtgcgagtggcantacggaaaggacaccccgcggaaagggaatgcgagagcgagtgccgcaagcggcaccagcagctgacgcgggcgaggaacgcgacagcgnngtgaacgcctacgtctcccgctccgggagggggcgagtgccgccgcagtgcctgcgcccgcacgaaggccagccggggaaaaccaagagtgcatgagggggtgccgccgccgggacttggcctcaacatgnaacaagatacggtcccggcaacaaaaccgggncaagtgcgggaagagtgcnacccccaccacccnggacttgtggaaaagcaccctgctagataaaaaaaanccnnnngggggggggggnnnnnnnnnggnnnnnngnnnccn

SEQ ID NO: 20360 - DNA, 715 bp, Zea mays
  misc_feature: Ceres CLONE 1388573-F
  misc_feature: Translation starting site: 173
  misc_feature (266)..(266): n is a, c, t, g, unknown, or other
  misc_feature (269)..(269): n is a, c, t, g, unknown, or other
  misc_feature (307)..(307): n is a, c, t, g, unknown, or other
  misc_feature (341)..(341): n is a, c, t, g, unknown, or other
  misc_feature (345)..(345): n is a, c, t, g, unknown, or other
  misc_feature (346)..(346): n is a, c, t, g, unknown, or other
  misc_feature (353)..(353): n is a, c, t, g, unknown, or other
  misc_feature (355)..(355): n is a, c, t, g, unknown, or other
  misc_feature (356)..(356): n is a, c, t, g, unknown, or other
  misc_feature (363)..(363): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (377)..(377): n is a, c, t, g, unknown, or other
  misc_feature (395)..(395): n is a, c, t, g, unknown, or other
  misc_feature (443)..(443): n is a, c, t, g, unknown, or other
  misc_feature (445)..(445): n is a, c, t, g, unknown, or other
  misc_feature (452)..(452): n is a, c, t, g, unknown, or other
  misc_feature (464)..(464): n is a, c, t, g, unknown, or other
aaagctggagctccccgcggtggcggccgctctataatagtggatcccccgggctgcaggaattcgcacgagaccattacctagaacatcctaatcgaaaacatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgnccngcggtcatctaccgccgccggtgcatctgccacctccnggtcacctgcccacctccgtgcatctcccaccgncggnntcactgncnngcgcggntcacnnntgcacgncggtccatgtgccgccgncggttcatctgccgccgccaccatggcactaccctactcaaccgcccngncctcagnctcatccccagncacacccatgcccgtgcaaacagcgcatcccagcccgtgccagctgaaggaaacctggcgggttggcagcaccccaatcctggggccagtgctccaagttcctgaaggaataagggaacccgaaagggaaccccctaatggttcccctaagggccaattttttggggaaaaaagtgtttccccaaatttcaggagggggaaccgcaaaacccggaaccagagggttttctcggtttgtgcccccccacccc

SEQ ID NO: 20361 - DNA, 718 bp, Zea mays
  misc_feature: Ceres CLONE 1388574-F
  misc_feature: Translation starting site: 204
  misc_feature (226)..(226): n is a, c, t, g, unknown, or other
  misc_feature (415)..(415): n is a, c, t, g, unknown, or other
aagctggagctcaccgcggtggcggccgctctagaatagtggatcccccgggctgcaggaattcgcacgagaccattacctagaacatcctaatcgaaaaaactactccgtcactttgtttgcaaagttcctcctcgatccatcgatcactgcaccggccggcggcaccgcgctcgcaggggctagccaacgagacggcagcaatggcggaccgtgaccgcagcgncatctacgggcgcgcccacgccacctacgggcagcagcagcagcagggaagaggcgggcgcccgatgggtgagcaggtgaagggcatgctccacgacaaagggccgacggcgtcccaagcgctgaacgtggcgacgctcttccccctgggcgggctgctgcttggtgctttcggggctggcgctaacgncctccgtggtgggggctggcgtggccacgcccgtgttcctgatcttcagccccgggctggtccccgccgcgctgctcatccggaacggccgtcatggggttcctcacggtcggcgcgcgggggctcgggggcttgtcttcgctaagtgcctcgcaaacagggggggggagggtttcaacgcaccccgaactacttggaggaagcgccacccagaatgggggaagccgcgccacacgggccaaaaaacccggaggaaggcaggcatccggggaggggcaaaagccgcccccgggaaaagtaaag

SEQ ID NO: 20362 - DNA, 603 bp, Zea mays
  misc_feature: Ceres CLONE 1388583-F
  misc_feature: Encodes the peptide sequence at SEQ ID NO. 20363
aagctggagctccccgcggtggcggccgctctagatactagaggatcccccgggctgcaggaattcgcacgagaccattacctagaacatcctaatcgaaaaaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcgtcggcggctgcgcggggcggtaccgactatgggacggacgacagcaagatctcccccgacgagatcctcttcgagggctgcgactacaaccactggctcatcaacatggacttcccggaccccaagccgccgcgcgaaaaaatgttcgggacttcccttcaaaatctcggcaagggcggccggaaagtataaggaggccaaaaataaggagggatgctttttaatacaaacaacttaatgtttggttttccaggccgaaaaggcccgaaaaaaagt

SEQ ID NO: 20363 - protein, 125 aa, Zea mays
  misc_feature: Ceres CLONE 1388583-F
MALALRLRRVLAAASTAAPLLRPSTSVARPCPLVPLASPVAPLPLPPWRFLPGGGAGFRSTASAAARGGTDYGTDDSKISPDEILFEGCDYNHWLINMDFPDPKPPREKMFGTSLQNLGKGGRKV

SEQ ID NO: 20364 - DNA, 618 bp, Zea mays
  misc_feature: Ceres CLONE 1388624-F
  misc_feature: Translation starting site: 357
  misc_feature: Pfam Name: TRAP_beta Pfam Description: Translocon-associated protein beta (TRAPB)
  misc_feature (217)..(217): n is a, c, t, g, unknown, or other
  misc_feature (243)..(243): n is a, c, t, g, unknown, or other
  misc_feature (335)..(335): n is a, c, t, g, unknown, or other
  misc_feature (336)..(336): n is a, c, t, g, unknown, or other
  misc_feature (386)..(386): n is a, c, t, g, unknown, or other
  misc_feature (456)..(456): n is a, c, t, g, unknown, or other
aaagctggagctccccgcggtggcggccgctctagaactagtggatcccccgggctgcaggaattcacacgagaccattacctagaacatcctaatcaaaaattcccaacttcagctgcgcctcgactcgtagcccgaaccctagccaccaagccggaggcgagagagcagccattggcgcggtgcctcgcgcttcgtcgccctcctcgtactcggnctcgccgccgccgccgcctccgcggncgacgcgcccttcgtcgtcgcgcacaagaagatttcgctctcccgcccccagccgggcgtcgagcgcgtcgccgtctcccttcgactctacnnaccaggatccgcgactgcctatgatgtgtccattaatgacgactcttggncaacagaaagtgtttgagcttgtcactggagagaaaattcgagaactttggaaaggggttggaccctggntgccacttgcttcaaaaaacctttttgttcttggaaaacccaaaacaaacggggcaaggggtcccggggggttcccccccgttttttttttttttttttatccccgggggttcccccccacaaaaaaaaaagaactccttttctttttaggggagggggata

SEQ ID NO: 20365 - DNA, 621 bp, Zea mays
  misc_feature: Ceres CLONE 1388628-F
aagctggagctccccgcggtggcggccgctctagtactagtggatcccccgggctgcaggaattcgcacgagaccattacctagaacatcctaatcgaaaaattgggagctcactcgctggacgttgcctgctgcggattgcccccaggcggacccactcactccgctgttgatatttcgtttggttctcctttccgtcttgcccgtcgccgagtccttcttcccctcgctccccagctccagcaggcagatcagatccatccaaccacgaacaggaaagtgagcgccggtaacgagtcctccgtcctcctactagctgcgatccgtagacttgagtcgctttcgcgcctagtctagatcgccacgctctagatctgtgatgttttactttcccgggtgcgcttgggcgaatccttccatccaccaggagagctcgtggcttgtctttgattagctcggtctcccctgtgtccgtgatctgatatacgtccggatctgtctgctgtaatcatcaggaaggtaggacgtctgagggactgaagttgaaccatgagtgccgacgcggattcgtcgtcgctgaacccgaacgcgccgctcttcatcccggcggagctgctgcac

SEQ ID NO: 20366 - DNA, 655 bp, Zea mays
  misc_feature: Ceres CLONE 1388640-F
  misc_feature: Encodes the peptide sequence at SEQ ID NO. 20367
  misc_feature (627)..(627): n is a, c, t, g, unknown, or other
ggagctccccgcggtggcggccgctctagaactagtggatcccccgggctgcaggaattcgcacgagaccattacctagaacatcctaatcgaaaaatccgaactccgaaaagccccccagcggcctcccctccgccccgcagccatggccgccaccggcgtggtcgccgagccgaagaccaagtacgatcgccagctcaggatatggggtgatcaaggccaggctgcactggagaaggctagcatatgcttgcttaactgtggtcctaccggaaccgaagcattgaagaatctcgtgcttggaggcataggaagtgtgactgttgttgatggctccaaagttgaatcatctgacctggggaacaattttctgttggatgaaggatgtttggggcaaccaagagctaaatctatatgttctttcctacaagagcttaatgacgctgttaaggccaagtttggttgaggagtctccagcgcattttgatagatactaatccttcattcttttccccagtttactggttgttattgctacccagcttcccagagagttttttactggaagctagattatatctgcaggaagcaagataattcgttttgggttgctgcacgttcttgggnccaaaaacccggttttggatccaagata

SEQ ID NO: 20367 - protein, 106 aa, Zea mays
  misc_feature: Ceres CLONE 1388640-F
MAATGVVAEPKTKYDRQLRIWGDQGQAALEKASICLLNCGPTGTEALKNLVLGGIGSVTVVDGSKVESSDLGNNFLLDEGCLGQPRAKSICSFLQELNDAVKAKFG

SEQ ID NO: 20368 - DNA, 630 bp, Zea mays
  misc_feature: Ceres CLONE 1388642-F
  misc_feature: Encodes the peptide sequence at SEQ ID NO. 20369
  misc_feature (336)..(336): n is a, c, t, g, unknown, or other
  misc_feature (501)..(501): n is a, c, t, g, unknown, or other
aagctggagctccccgcggtggcggccgctctagaactagtggatcccccgggctgcaggaattcgcacgagaccattacctagaacatcctaatcgaaaaaacccgggtgccttcacgcttgacaggcacccatcccacgccacgggctcctcctcccctccgcttctcctctaggtccctctcctgcagaaccctcccaatccaaagcgattcctccgggccgccgcggcggcgtctccccgggcgcccctagcacagctcgcgttccggtggaacagagaagagaggcgcgaggatggagatccagtcgtctggccgctccatcgaggggtgnatggagaaggtgctgtccgtgaacatcctctcctcggactacttcaaggagctcttcaagtacaaaccttaccacgaggtcggtcgacgagatctacaaccaggtggaccacgtcaaggccctggatgaccggcaactgccgcggcccctcctccgccttctgcntcctctacaagttattcaccatgaagctcaccgtcaagcagatgcacggcctgctcaagcaccaggactcccctacatcaagggctattgaatttctctacctacgatacgttgcagaaccgaagacct

SEQ ID NO: 20369 - protein, 56 aa, Zea mays
  misc_feature: Ceres CLONE 1388642-F
  misc_feature (14)..(14): Xaa is any aa, unknown, or other
MTGNCRGPSSAFCXLYKLFTMKLTVKQMHGLLKHQDSPTSRAIEFLYLRYVAEPKT

SEQ ID NO: 20370 - DNA, 628 bp, Zea mays
  misc_feature: Ceres CLONE 1388651-F
  misc_feature: Encodes the peptide sequence at SEQ ID NO. 20371
aaagctggagctccccgcggtggcggccgctctagaactagtggatcccccgggctgcaggaattcgcacgagaccattacctagaacatcctaatccaaaaaggccctagcaacaaatccgtatcccgagtccggcgacggcagtatccgagctcgcactcgcgcacccgtccatcgcatcgcatctgtcctcccatcccctcagcgccaccgcaccgcaatcacacgcgcgccacctgcgatgacgccgcggcggcggcgatctccggctccagcagccacgtcgtcgtctcctccgcccgcctcagggagacgttcacggtccctccgcgcaccgcttgccatatcgccgccgccgcctcgcccgtgacccgccgtgaggtcgcggtcgccgacgtgtcgagccccgttgtgtccgccggcgtgaggaagtatggcaaacaggttcctaaggatttccttcacatcattgattttgacaaggatacaataatgaagattcttaatcgagtcgtcgacgttaaggcattgatagagtctggagacaagagcttccgaccgttcaaagggcatacaatggccatgatttttgccaagccatcactgaggacccgtgtttcatttgaa

SEQ ID NO: 20371 - protein, 45 aa, Zea mays
  misc_feature: Ceres CLONE 1388651-F
  misc_feature: SWISSPROT Homolog: EC 2.1.3.3 Ornithine carbamoyltransferase
MKILNRVVDVKALIESGDKSFRPFKGHTMAMIFAKPSLRTRVSFE

SEQ ID NO: 20372 - DNA, 628 bp, Zea mays
  misc_feature: Ceres CLONE 1388652-F
  misc_feature: Translation starting site: 184
  misc_feature (283)..(283): n is a, c, t, g, unknown, or other
  misc_feature (478)..(478): n is a, c, t, g, unknown, or other
  misc_feature (555)..(555): n is a, c, t, g, unknown, or other
aaagctggagctccccgcggtggcggccgctctagaactagtggatcccccgggctgcaggaattcgcacgagaccattacctagaacatcctaatcgaaaaaagccgtttttcctcgtcctcgatccagccccctgccgcttccagctccgatcgatctgatccctccccaccaccacgcccatggcggaccaactcaccgacgaccagatcgccgagttcaaggaagccttcagcctcttcgacaggacgggggatgttgcatcacgaccaaggagctggnaactgtcatgcggtcactggggcaaaaccctacagaagctgagctccaggacatgatccatgaagtcgatggcgacggcaacgcaccatcgaatttccagaggttctcaaccctaatgctcgcaagatggaagacaacgactctggagagagctcaagagggctttttccgtgtgttgacaaggaacagaacggntttcatcttctgccgccgagctccgccatgcatgacaaatcttttgtgggaagagctattgatggaggaggtaaacnacgatgatccgcggagggtgaatgttcactagagggaggggcccaaaactaccccaaggggaggttgtttcgg

SEQ ID NO: 20373 - DNA, 627 bp, Zea mays
  misc_feature: Ceres CLONE 1388657-F
  misc_feature: Encodes the peptide sequence at SEQ ID NO. 20374
  misc_feature (243)..(243): n is a, c, t, g, unknown, or other
  misc_feature (281)..(281): n is a, c, t, g, unknown, or other
  misc_feature (377)..(377): n is a, c, t, g, unknown, or other
  misc_feature (420)..(420): n is a, c, t, g, unknown, or other
  misc_feature (477)..(477): n is a, c, t, g, unknown, or other
aaagctggagctccccgcggtggcggccgctctagaactagtggatcccccgggctgcaggaattcgcacgagaccattacctagaacatcctaatcgaaaagaatataaggcaaaaattctgggccggccactgcccagatcccgccgacattctccaaaccaaccgtggcggcgatgaggaaggcgggggtgacctccgcctccagcggtggaggagaaggatgccgtgcggtggtggccncaacctcggtgtgaagctgaacggctgctactgctggntggtggtggccaccaatctggtgtccctgtaccacctctccctccgcgccgccaccgtgccgccggtccttctccagcagcaacgtgacggcgacnaggatctggtcctgatccggcagctggaagccatccgcgcggncgtgtcgcagctgaaccacctccgctcgtcgtcccctcccccgccgcttccgccggngtagcttgtcctctactcccggctcgcccccgtcgcatccgcctgctccgcgcacccggagctcctccaccgctacatgtcctacactccctacgcgctctggcccgaagacgccctctccatcgccgagcccctcctcctccgcggagt

SEQ ID NO: 20374 - protein, 84 aa, Zea mays
  misc_feature: Ceres CLONE 1388657-F
  misc_feature (7)..(7): Xaa is any aa, unknown, or other
  misc_feature (20)..(20): Xaa is any aa, unknown, or other
  misc_feature (52)..(52): Xaa is any aa, unknown, or other
  misc_feature (66)..(66): Xaa is any aa, unknown, or other
MPCGGGXNLGVKLNGCYCWXVVATNLVSLYHLSLRAATVPPVLLQQQRDGDXDLVLIRQLEAIRAXVSQLNHLRSSSPPPPLPP

SEQ ID NO: 20375 - DNA, 647 bp, Zea mays
  misc_feature: Ceres CLONE 1388673-F
  misc_feature (476)..(476): n is a, c, t, g, unknown, or other
aaagctggagctccccgcggtggcggccgctctagaactagtggatcccccgggctgcaggaattcgcacgagaccattacctagaacatcctaatcgaaaacttccccatctccggataaaagataaggagtgtctctcctttgccatcctcctctctttcagctaagtcgcctgccccctctctttttcttacattcaggccctcgcagctcctctcttttttcttgcgtctttcgatctgcgagacgtccaagaccagtactcttctttccctcaaggaactcttgcagccggcccctctggtttcctcgaattcttgatccccggaccctcctcctgtccacgcgtaaatccgtccgaccgaggagcacatcgtccccacgctcatgtttacccaccaggtcctcatgacgtgcgcagtgctcgatgaagctgacagtgctcagtatctgcagtaccactgcttactcgggncatacatctaatggtggaagacttttcatgaacgcctcgcccctcccaaatggtgattccatcgaggggcttaccttgaactttggttctggaaagggcttaccaaaatttccttggggccccggggttttccccgataatttccccaaaaaaaaacccccctccaattaa

SEQ ID NO: 20376 - DNA, 650 bp, Zea mays
  misc_feature: Ceres CLONE 1388679-F
  misc_feature: Encodes the peptide sequence at SEQ ID NO. 20377
  misc_feature (522)..(522): n is a, c, t, g, unknown, or other
  misc_feature (523)..(523): n is a, c, t, g, unknown, or other
  misc_feature (562)..(562): n is a, c, t, g, unknown, or other
  misc_feature (650)..(650): n is a, c, t, g, unknown, or other
tggagctccccgcggtggcggccgctctagaactagtggatcccccgggctgcaggaattcgcacgagaccattacctagaacatcctaatcgaaaaacccgaagcacatcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttgggagttgaagtcgtgatggccaatgattgattggggtgaggaaagttgagaagttggctgccgtttgccnnaaaaggttgaagttctgctcctagagaatgttagattcntacaaggaggaagagaagaacgaaacctgagtttgctaagaagctagcatctgttgcttgacctttatgtcaatgatgcttttggcan

SEQ ID NO: 20377 - protein, 90 aa, Zea mays
  misc_feature: Ceres CLONE 1388679-F
  misc_feature: SWISSPROT Homolog: EC 2.7.2.3 Phosphoglycerate kinase
MATKRSVGTLGEADLKGKKVFVRADLNVPLDDAQKITDDTRIRASVPTIKFLLEKGAKVILASHLGRPKGVTPKYSLKPLVPRLSELLGS

SEQ ID NO: 20378 - DNA, 645 bp, Zea mays
  misc_feature: Ceres CLONE 1388681-F
  misc_feature (434)..(434): n is a, c, t, g, unknown, or other
  misc_feature (595)..(595): n is a, c, t, g, unknown, or other
  misc_feature (596)..(596): n is a, c, t, g, unknown, or other
  misc_feature (622)..(622): n is a, c, t, g, unknown, or other
gctggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacccggtcggccacggcctgcccctaggcgttgacatccagatccatctcgctccgatcntacattcgagaagtttgtctccgacatcgattccccagtctgatccggttgtcgacgtcttcttttgggtgaaacggtcgaagtcacgcgcacgcacatcccacacttgtcccttccccggcggtgcattcagcaacactgtctttcttcctccgtgtcgnnagcacctcgggcccacaggggcgganccggtgaaacgactttcctttcc

SEQ ID NO: 20379 - DNA, 657 bp, Zea mays
  misc_feature: Ceres CLONE 1388682-F
  misc_feature: Encodes the peptide sequence at SEQ ID NO. 20380
  misc_feature (508)..(508): n is a, c, t, g, unknown, or other
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaagtatcaagtacccaaaccctttcgatctgctcaactaccaaactctgctcctccctgcttccgtcacgcgagagcactccactcccacgcgaaccctagcagtggttctccctcggggccccgctaagcagcttggttccaagctgtagaagcatctccgatcccatccgcggcgggttgaggccatcagctccggtttctgcagccggatttgggatccgcgagatgtcttggtccgcgcccgacgacatcctcctctccacctccctcgccggcttcttggacaagaaacttattgtcctgctaagagatggacggaaactgcttggcaccctctgctcatttgatcagtttgcaaatgtgtttcttcagggtgctggtgaacgagtggattgtgggggaacantaattgtgatgttcctcttgggctgtacgtaatccgggaaaaaagaacgttgttttaatacggagaattggatcgcgtaaaaggatgaactccctgctcacatggaccctgtgtttcngaagcagaaaataagataggctgaaaaagca

SEQ ID NO: 20380 - protein, 70 aa, Zea mays
  misc_feature: Ceres CLONE 1388682-F
  misc_feature (13)..(67): Pfam Name: LSM Pfam Description: LSM domain
  misc_feature (61)..(61): Xaa is any aa, unknown, or other
MSWSAPDDILLSTSLAGFLDKKLIVLLRDGRKLLGTLCSFDQFANVFLQGAGERVDCGGTXIVMFLLGCT

SEQ ID NO: 20381 - DNA, 633 bp, Zea mays
  misc_feature: Ceres CLONE 1388694-F
  misc_feature: Encodes the peptide sequence at SEQ ID NO. 20382
  misc_feature (305)..(305): n is a, c, t, g, unknown, or other
aagctggagctccccgcggtggcggccgctctagatctagtggatcccccgggctgcaggaattcgcacgagaccattacctagaacatcctaatcgaaaaaaccaagcagagcaaagaaagagacgcggagccaccgcgttccggagagaaacgcggagagccaaggcaaggcagctgtcgccgcagcgacgatgtggagctcgggctctgaccgcgacgaggccctagacacggcgaacgcctcgtcagtcgacgcttcgtcgcccgcgcggcagccgtccacgccgcccccgccgcctcggngccggcgccagcgcgcgcgacgccgtgctcaccgcctccgtgccaggaacacggccgcaggagcgcaggaggaggagggactcgtgcaggtcgacccggacgcggacgacgtctgccgcggtttgaagcaccatcgtgagcgataggcgtgcctgcggcagacgtctaggaccgtggcgcgggtccccggcgaggaggggcccccctccgacgcctccgccgtttcggggcagaccgtcggaatggttaagacctggaacctgaccgacaacgacttggaggaagtccaggggtgagtggatcttggcgctccattatcaagtaccaa

SEQ ID NO: 20382 - protein, 85 aa, Zea mays
  misc_feature: Ceres CLONE 1388694-F
  misc_feature (38)..(38): Xaa is any aa, unknown, or other
MWSSGSDRDEALDTANASSVDASSPARQPSTPPPPPRXRRQRARRRAHRLRARNTAAGAQEEEGLVQVDPDADDVCRGLKHHRER

SEQ ID NO: 20383 - DNA, 630 bp, Zea mays
  misc_feature: Ceres CLONE 1388701-F
  misc_feature: Encodes the peptide sequence at SEQ ID NO. 20384
  misc_feature (433)..(433): n is a, c, t, g, unknown, or other
  misc_feature (541)..(541): n is a, c, t, g, unknown, or other
aaagctggagctccccgcggtggcggccgctctagaactagtggatcccccgggctgcaggaattcgcacgagaccattacctagaacatcctaatcgaaaatttttctcacgccctccccgcggaattatacctttttttttctctctctctcgcctcgcttccttcgaatccatccatctctcgcctccctttccaattcgatgcctttgtagcgctgctgcctcgcccccgccgcgtcgtcgcgggtccccggcttcgcttgctgctgcgcttccagcgtcatggacggaggatccggcaatgcctccagcggcggagcggcggtgtgctgctactacgcgctcctcggcgtccgcaagagcgcctccgccaccgacatacgcacggcgtaccggaggctcgcgatgaagtggcaccgggaccggtgggncagcgatccctggcgcggcggcgaggccaagcggcgtttccagtggatccaggaggtctactcagttttatccggacaaggggaagaaggccatgtacgacgcccggnctcttcgatcccctcgacgacgacgaccagaatttctccgacttcatgcagaagatgctggtgatgatggataacgtgaaaaacgagaa

SEQ ID NO: 20384 - protein, 106 aa, Zea mays
  misc_feature: Ceres CLONE 1388701-F
  misc_feature (17)..(78): Pfam Name: DnaJ Pfam Description: DnaJ domain
  misc_feature (50)..(50): Xaa is any aa, unknown, or other
  misc_feature (86)..(86): Xaa is any aa, unknown, or other
MDGGSGNASSGGAAVCCYYALLGVRKSASATDIRTAYRRLAMKWHRDRWXSDPWRGGEAKRRFQWIQEVYSVLSGQGEEGHVRRPXSSIPSTTTTRISPTSCRRCW

SEQ ID NO: 20385 - DNA, 602 bp, Zea mays
  misc_feature: Ceres CLONE 1388710-F
  misc_feature: Translation starting site: 188
  misc_feature (165)..(165): n is a, c, t, g, unknown, or other
  misc_feature (192)..(192): n is a, c, t, g, unknown, or other
  misc_feature (232)..(232): n is a, c, t, g, unknown, or other
  misc_feature (276)..(276): n is a, c, t, g, unknown, or other
  misc_feature (289)..(289): n is a, c, t, g, unknown, or other
  misc_feature (290)..(290): n is a, c, t, g, unknown, or other
  misc_feature (292)..(292): n is a, c, t, g, unknown, or other
  misc_feature (303)..(303): n is a, c, t, g, unknown, or other
  misc_feature (402)..(402): n is a, c, t, g, unknown, or other
  misc_feature (458)..(458): n is a, c, t, g, unknown, or other
  misc_feature (581)..(581): n is a, c, t, g, unknown, or other
aaagctggagctccccgcggtggcggccgctctagaactagtggatcccccgggctgcaggaattcgcacgagaccattacctagaacatcctaatcgaaaacccaaagacgccgtcgccgctcttgttgtttccgatcccaaaccccaaacacgctccaccggnacctccgctcccacacacaccgatggnccgcacgaagcagacggcgcgcaagtccacccgaagcaanggcgcgccgaagcagctggcgaccaaagcagcgcgcaagtcggnccccgcaaacggnngngtggaagaagncgcaacgcttccggccggggaccgtggcgctccgcgagatccgcaagtacaaagaagaagggaactggttatccggaaggttcctttcagaggctggtncgcgagatatcgcaagacatcaagaacgaacttcggttccaggtcttcggcggtcncgggctgaggaaggccgcgaagcctaactccgtcggctctttgaagaacacaaacttcggcgcattcaacgcaaagcgcgtcaccatcatgcccaaggacattcagctcgcccgccgcatccngcggggagcgcgcttaagcgg

SEQ ID NO: 20386 - DNA, 641 bp, Zea mays
  misc_feature: Ceres CLONE 1388728-F
  misc_feature: Translation starting site: 152
  misc_feature (487)..(487): n is a, c, t, g, unknown, or other
  misc_feature (525)..(525): n is a, c, t, g, unknown, or other
  misc_feature (530)..(530): n is a, c, t, g, unknown, or other
  misc_feature (543)..(543): n is a, c, t, g, unknown, or other
aaagctggagctccccgcggtggcggccgctctagaactagtggatcccccgggctgcaggaattcgcacgagaccattacctagaacatcctaatcggaaaaacacaaacaagaagcttgcattgttcgtttgctcgatcgttgcagataatggagaaccctgctccgagtatcgtagtgccccccattgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaacagttcttcaccgtcgccttcgaggccggcaggctcaagggctccacgctcccttacgaaggagtgntgacggatggatcagatgaatgggcaatctacggcggnaccgnagagttgctatgncgagaggtgtcgtcaaaagaggtacttgccgatagggatggcgccgggacactgacgagtcagcatgcagtttcctggcccgtgtttgctcatcacac

SEQ ID NO: 20387 - DNA, 642 bp, Zea mays
  misc_feature: Ceres CLONE 1388732-F
  misc_feature: Translation starting site: 313
  misc_feature (325)..(325): n is a, c, t, g, unknown, or other
  misc_feature (341)..(341): n is a, c, t, g, unknown, or other
  misc_feature (347)..(347): n is a, c, t, g, unknown, or other
  misc_feature (354)..(354): n is a, c, t, g, unknown, or other
  misc_feature (383)..(383): n is a, c, t, g, unknown, or other
  misc_feature (384)..(384): n is a, c, t, g, unknown, or other
  misc_feature (457)..(457): n is a, c, t, g, unknown, or other
  misc_feature (548)..(548): n is a, c, t, g, unknown, or other
  misc_feature (570)..(570): n is a, c, t, g, unknown, or other
  misc_feature (582)..(582): n is a, c, t, g, unknown, or other
  misc_feature (603)..(603): n is a, c, t, g, unknown, or other
aagctggagctccccgcggtggcggccgctctagaactagtggatcccccgggctgcaggaattcgcacgagaccattacctagaacatcctaatcgaaaaactcacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcgnacaccatccgcacggncatcgncgtcatncgcaatgggaccgccctagtgctcttccnntctcccggtgctacgttcatccgcatctggaagaaggggtcggtggagcagtactcgccgatcccgtacgtgncgacgctgctgactgattgattatggggtggttgaacgggcttgccgctggttgcacccgcacagattggttggtgatccacatcaacggncaccggcatgctcatccagctngacctacgtggngctctctccctaatccccccngggggggggggcggccccccaaagtgtcccttctggggg

SEQ ID NO: 20388 - DNA, 624 bp, Zea mays
  misc_feature: Ceres CLONE 1388743-F
  misc_feature: Encodes the peptide sequence at SEQ ID NO. 20389
aagctggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcttctcctccttcccccgggcgctcccgccgccgccgccctgggcgcgcatcacctcgccagcctccacctccggggccctacctacctctgagatcgaggagcggctcgccggggtgcccgtgtacgcgctcgccaacgccgcccaggagttcgtgcttgtgtcgtccacacgcgtgggaggtcagggggcgagagcgtgagtccaacgccggcgctcgggctgctctgcttcccgaagaagatgctgacgcgctgctggagcagatggatggcgatatgcgcgccgac

SEQ ID NO: 20389 - protein, 110 aa, Zea mays
  misc_feature: Ceres CLONE 1388743-F
MPFRFQFPWLKNPTTNGGTSNIDTNPSPRFPNPFLPIQAHVTSFFSSFPRALPPPPPWARITSPASTSGALPTSEIEERLAGVPVYALANAAQEFVLVSSTRVGGQGARA

SEQ ID NO: 20390 - DNA, 714 bp, Zea mays
  misc_feature: Ceres CLONE 1388744-F
aagctggagctcaccgcggtggcggccgctctagatactagtggatcccccgggctgcaggaattcgcacgagaccattacctagaacatcctaatcgaaaaattgctctccaaccaaacctcgtctcgtcttctctccgctaccaccaccactgctcgttttacagaaaccggaaggaaccaaacgcctttccgccccgggccgccgctacccatgctcagcaaccgccactcgttggcgtctactactaggccggcaagaaggcgtcctgtttttttttttttgggccctcgaacgtcgtccggaactcccggacagggcatggacatgccccgccgtaggcgggcgaataccccactaaaatcagggtgtccgttggaccccccgaccctgtaagaaggcgttttctgccacctcgaggaaagcggctttggccactgggcaaggtggaacggccaatttgggctgcggccggtccccaggccctttctcaataaacacccctgccgcccccagccgaagttggcacctcaatctgtggcccctgggggtgggggcgcccttccccttcccttgggccaacccagggggggggtcccaatttcgcctgtctctcccccaccgtcgtatgtgcccacatttttggcaccgcacttccgcggggacccgcggtccacccggttgccatatctaaagaatggcgcccttaagca

SEQ ID NO: 20391 - DNA, 663 bp, Zea mays
  misc_feature: Ceres CLONE 1388759-F
  misc_feature: Encodes the peptide sequence at SEQ ID NO. 20392
  misc_feature (388)..(388): n is a, c, t, g, unknown, or other
  misc_feature (459)..(459): n is a, c, t, g, unknown, or other
  misc_feature (460)..(460): n is a, c, t, g, unknown, or other
aaagctggagctccccgcggtggcggccgctctagaactagtggatcccccgggctgcaggaattcgcacgagaccattacctagaacatcctaatcgaaaaatccgtcttgacagctccactcctaactccagcgaccaccgcgtccccaccatggccgctcgccggagcactagccccgcccggcacggcgtcctccccgccctccttctcatcctatgctcgtccctcccttccctcgccgccgcataccgcccaggcgacatcgtcccgatgctccgctcgggccagtaccacggctcgaggtcggtgtggttcgacgtggtggggcgccattgcccggccttcgcggtcaaccgggaggtgctgatgccgatcccaagcctancgggttcactggtgctgatcccgtacagataacatttcaaattggacatgaaaagttccatggtccttggnncttatgtataaatcgcaaaacctctgaaagtccactgatcgattttcatttgagtactctggaaatgatatacttgggggtgcagctaaaagttgggacatggctccccactacgtggaaggtcatcctgactaaaggagaatttctggaatccccaaaatgggcaaaatacgtccttggtaaaaatacctggaagggcaaca

SEQ ID NO: 20392 - protein, 88 aa, Zea mays
  misc_feature: Ceres CLONE 1388759-F
  misc_feature (79)..(79): Xaa is any aa, unknown, or other
MAARRSTSPARHGVLPALLLILCSSLPSLAAAYRPGDIVPMLRSGQYHGSRSVWFDVVGRHCPAFAVNREVLMPIPSLXGSLVLIPYR

SEQ ID NO: 20393 - DNA, 614 bp, Zea mays
  misc_feature: Ceres CLONE 1388760-F
  misc_feature: Encodes the peptide sequence at SEQ ID NO. 20394
  misc_feature (373)..(373): n is a, c, t, g, unknown, or other
  misc_feature (491)..(491): n is a, c, t, g, unknown, or other
  misc_feature (551)..(551): n is a, c, t, g, unknown, or other
  misc_feature (553)..(553): n is a, c, t, g, unknown, or other
  misc_feature (564)..(564): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtancggaaaggacaccccgcggaagagggaatgcgagagcgagtgccgcgagcggcaccagcaagctgacgcgggcgaggacggcgacagcggcgtggacgcctacgtctcccgctccggnaggggcgagtgccggcgccagtgcctgcgcccgcacgaggggcagccgtgggagacccangnagtgcaatganggcggtggcccgcccccccccgggaaagggggccccccccaaaatgggag

SEQ ID NO: 20394 - protein, 74 aa, Zea mays
  misc_feature: Ceres CLONE 1388760-F
  misc_feature (53)..(53): Xaa is any aa, unknown, or other
MGKGSVGASWWAFLLLAGVLLVVAATAGAEDGVVERDRKEDLRWCKQACEWQXRKGHPAEEGMRERVPRAAPAS

SEQ ID NO: 20395 - DNA, 606 bp, Zea mays
  misc_feature: Ceres CLONE 1388764-F
  misc_feature: Encodes the peptide sequence at SEQ ID NO. 20396
aagctggagctccccgcggtggcggccgctctagtactagtggatcccccgggctgcaggaattcgcacgagaccattacctagaacatcctaatcgaaaaaccatcacagtacgcacgcacgcaccagcccagcagcagaagcgcccctcggccctcgctcccacaacaagctcaagccagccttctctctctctctgctccaatggcgcgcttccagctcgcagccgtggccatggccatgctcttcgccgcggcggcggcgcaggacccgaccgccaccccgacgccggctcccaaggcgtcccccccgccggcaacgccgccgccgacccccgtgacggtgtgtccggccgggctgaccttcactttgactttatcggcgagcagggcctgcattgggaattgaagccgatctcagacacttccagattctaaaccgaagcgagatttgagaatgaaatatcaggattcatcgactggaaacagaagacgatggcaatcgggtctataagcaatggagaagaatgctagcatatctgtttctcttgaggggaatatctcttctattcccaattcaatagtcaacgactctaaaacgtcaatg

SEQ ID NO: 20396 - protein, 67 aa, Zea mays
  misc_feature: Ceres CLONE 1388764-F
MARFQLAAVAMAMLFAAAAAQDPTATPTPAPKASPPPATPPPTPVTVCPAGLTFTLTLSASRACIGN

SEQ ID NO: 20397 - DNA, 648 bp, Zea mays
  misc_feature: Ceres CLONE 1388767-F
  misc_feature: Encodes the peptide sequence at SEQ ID NO. 20398
  misc_feature (518)..(518): n is a, c, t, g, unknown, or other
  misc_feature (520)..(520): n is a, c, t, g, unknown, or other
  misc_feature (521)..(521): n is a, c, t, g, unknown, or other
  misc_feature (612)..(612): n is a, c, t, g, unknown, or other
aaagctggagctccccgcggtggcggccgctctagaactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgaggactggcacctaccgccagctcttccaccctgagcagctcatcagtgggaagggagatgcagncnnacacttttgccgtggtcactacaccattggcaagggagattgtgacctatgccttgatcgcatcaggaagcttggccgacactgcactggntctccagggcttctcgtcttcaacggtggtgggtga

SEQ ID NO: 20398 - protein, 142 aa, Zea mays
  misc_feature: Ceres CLONE 1388767-F
  misc_feature (100)..(100): Xaa is any aa, unknown, or other
  misc_feature (101)..(101): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKGDAXXHFCRGHYTIGKGDCDLCLDRIRKLGRHCTGSPGLLVFNGGG

SEQ ID NO: 20399 - DNA, 660 bp, Zea mays
  misc_feature: Ceres CLONE 1388776-F
  misc_feature: Encodes the peptide sequence at SEQ ID NO. 20400
  misc_feature (511)..(511): n is a, c, t, g, unknown, or other
  misc_feature (644)..(644): n is a, c, t, g, unknown, or other
  misc_feature (645)..(645): n is a, c, t, g, unknown, or other
aaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagtagnggcccccccccggggggggggaggaaaaaaaggggctttaactcgaggggacctcgctcgcaaacctggcgcttcgcctccaacttcgacctccttcaaggctgggctgcggccgactggcgcgacacgtccnntctctgcgaggtggg

SEQ ID NO: 20400 - protein, 120 aa, Zea mays
  misc_feature: Ceres CLONE 1388776-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQ

SEQ ID NO: 20401 - DNA, 641 bp, Zea mays
  misc_feature: Ceres CLONE 1388777-F
  misc_feature: Translation starting site: 397
  misc_feature: SWISSPROT Homolog: EC 3.4.21.92 Endopeptidase Clp
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcgaaaaagattagtcacactccttcgcaagcacacaaaaaaaaaaaacccccaaatagcgtaaggataagcctcgccggcgacgaaatcagggtttcatcgaacaagaagatggctcacgcttgcgtctccacatcagcttcctctctcaggtttacagccggattcgtctccgcgagtcccaacgcctcctctttcgattctcagaagctttccctccctttcgagcctcttcgttcaagaaagacgaagaagttggttagcggcagaaagacggctccgaaggctgtatactccggcaatgtctggactccggagactccttcgcctcaaggagtttggtccatcagagatgatttacaagtcccttcttcgccgtattttcctgtgtacgctcaaggacaaggaccacctcctatggtgcaagagcgtttccagagtatcataagccagctcttccatataggattattcgttgtggtggtgctgtggatgatgatatggccaacataatcgtagctcagcttctttacctcgatgctngtg

SEQ ID NO: 20402 - DNA, 643 bp, Zea mays
  misc_feature: Ceres CLONE 1388790-F
  misc_feature: Encodes the peptide sequence at SEQ ID NO. 20403
aaagctggagctccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaa

SEQ ID NO: 20403 - protein, 138 aa, Zea mays
  misc_feature: Ceres CLONE 1388790-F
  misc_feature (49)..(138): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVF

SEQ ID NO: 20404 - DNA, 636 bp, Zea mays
  misc_feature: Ceres CLONE 1388795-F
  misc_feature (360)..(360): n is a, c, t, g, unknown, or other
  misc_feature (361)..(361): n is a, c, t, g, unknown, or other
aaagctggagctccccgcggtggcggccgctctattctagtggatcccccgggctgcaggaattcgcacgagaccattacctagaacatcctaatcgaaaaaaccaagcagagcaaagagagagacgcggagccaccgcgttccggagagagacgcggagagccaaggcaaggcagctgtcgccgcagcgacgatgtggagctcgggctctgaccgcgacgaggccctagacacggcgaacgcctcgtcagtcgacgcttcgtcgcccgcgcggcagccgtccacgccgcccccgccgcctcggcgccggcgccagcgcgcgcgacgccgcgctcaccgcctccgtgccaggaacacggnngtcattgatcggaccacgaggagggactcgtgtaggccgacccggacgcggacgacgtctgccgcgggctgcaacatcaacgcaagcgggaggcgtggctggcgcgaccgtcaagccccgtggtggtggtccgccgccgaggaggggtccccctccggacgcctcccccggctcggagaaaagcggcggcgttgccgaaggccccgaaccctgaccgacgacgacctggaggagttcaaggggtggggggatctggggtccggtttcacctaccg

SEQ ID NO: 20405 - DNA, 629 bp, Zea mays
  misc_feature: Ceres CLONE 1388796-F
  misc_feature: Translation starting site: 206
  misc_feature (464)..(464): n is a, c, t, g, unknown, or other
aagctggagctccccgcggtggcggccgctctagaactagtggatcccccgggctgcaggaattcgcacgagaccattacctagaacatcctaatcgaaaagatgttctcctgcctccgctccgccgccgcaacaaccatttccttctctagccgccgcctccgatcccctcccgaggctacagaaccagttcatccaggcgcgaatggcggcggcgaggagcctgcttctgaggcacctccgcttggcggcggccccgtcagcggcgtccgtgaggccgacggcgtcgttgcatgaggccctgtgggggcagcggtggatgtcttcggaggatgccaagggctctttcctggataagagcgaggtcactgaacgcatcatcaaggtcgtcaagagcttcccgaagatcgatgacccctccaaggtgacaccagatgcccatttcaagaatgatcttgccctanaacgtttggatgcagtggaggctgccatgcccctaagaggaattccagatccgagatacctgaccatgaagctgacaagattgactccgtcaaaggtgcagttgacttcattgcctcacacccgcaagcgaaagataaaatgcgttgcctggaatagaaagctat

SEQ ID NO: 20406 - DNA, 764 bp, Zea mays
  misc_feature: Ceres CLONE 1388801-F
  misc_feature: Encodes the peptide sequence at SEQ ID NO. 20407
  misc_feature (13)..(13): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
aaaaacaaacaanaaataaaaattcaaaaaatttatnnngtcggcccgcccttcaaagctggagctccccgcggtggcggccgctctagaactagtggatcccccgggctgcaggaattcgcacgagaccattacctagaacatcctaatcgaaaaaaaatagaaaaagtctcctgcctccgcggccgtgccgagccggcatcccctcccgtcccccacccccagcagcgatcgcgacgacccgagccggcaagggtgacaggcggctgacgagccccatgggagacaacaagtctccgctgagcctgagcccgatgggcgggcgcgaccgggaccgggagctcctcatcccggtctcgggcggcggctcggcgcccggcgacggggtcgaggacggggacagggcctcctccgcctccgccgcgctatcctcctccggccgcgaggctttccataagggtgtccgcaagctgggcttcaaagaagttcatgaactgcatgtgtaattcctcttccccataagcaataacgttctacatcaacctgggggcgtcaatccattttggctgagtggattctttgcctccaaatccaatgcgtcacctgggaaatccacaacaatttggcactatggactttggccaaatccggatacctctcctaattttttggaaacggtgatccctctagtgagcaaccattggcccatggtggaccctctgggccattctaccccctggcccggaggggggaacccactcaag

SEQ ID NO: 20407 - protein, 75 aa, Zea mays
  misc_feature: Ceres CLONE 1388801-F
MGDNKSPLSLSPMGGRDRDRELLIPVSGGGSAPGDGVEDGDRASSASAALSSSGREAFHKGVRKLGFKEVHELHV

SEQ ID NO: 20408 - DNA, 590 bp, Zea mays
  misc_feature: Ceres CLONE 1388802-F
  misc_feature: SWISSPROT Homolog: EC 3.4.25.1 Proteasome endopeptidase complex
tggagctccccgcggtggcggccgctctagaactagtggatcccccgggctgcaggaattcgcacgagaccattacctagaacatcctaatcgaaaacccccgccgctctcgcatcgtctccggagcgacgtcagatcaggtgcgccgcgcccccctcgcctaagctgcgacgaccatccatcgaacaggaaggatgacgggctccatggatctcccgggcaagggcgggttcagcttcgacctgtgccgccggaacacatgctggagaaaacgggctcaggtccggcatcaggaagacgggacaccatcgtcgcctcgtcttcaggatgggttgttcttggcgcagacacaggggcaactgacggccccataggtggctggataaaaacggggggaaaaaccccttttttggacccaaataaaagggtggggaaaaaaaatcccggggaaacagggggccgtaaaaaaaaggggggggtccccaataacagtttcccgtttttgaagggggccccggaaaacaaagagggggaaccggtctcttcacccaacggggaggccccccccccccttagaaaaaagagggggg

SEQ ID NO: 20409 - DNA, 727 bp, Zea mays
  misc_feature: Ceres CLONE 1388803-F
  misc_feature: Encodes the peptide sequence at SEQ ID NO. 20410
tggagctccaccgcggtggcggccggctctagaactagtggatcccccgggctgcaggaattcgcacgagaccattacctagaacatcctaatcgaaaaccactccactccaaacctccctctctcgatctcgaccaccccccttggaccgcaagccagcccagccgtcccgctccctcggtaagcttccaagcgagtccggcggcgtcgagtcgaatggcgggcaagtcgcacacgcgcaaggcgttcctcctgtgcaactacgtcctcatgggcgccgcctccagctgcatcttcctcacgctgtccgctggcgactgcttgccgtccccgggcggggcctcctcctggtctttcctccaaggccctcaacggccgtctttcttccgggggccggtttgctcgggattccctttaaagggggggccccggccaaaggccccgggggaaatgggggaaaaaaaggggggtaaacacccgggggggggggcccgggggttttacacccgccaatttttttccacagggaaggccccttcccggtttttttttccgggtttcaccccgcaccccccccaaatttttggggggggaggatctctaaatctcaaaaattcccccaagaaaaagagagaggggggccgctaatttccccaaaaaaaagaggggggggggcctccccgaaaccccgcattattttttccccctcaaaagggggggcgcccct

SEQ ID NO: 20410 - protein, 143 aa, Zea mays
  misc_feature: Ceres CLONE 1388803-F
MAGKSHTRKAFLLCNYVLMGAASSCIFLTLSAGDCLPSPGGASSWSFLQGPQRPSFFRGPVCSGFPLKGGPRPKAPGEMGEKKGGKHPGGGARGFYTRQFFSTGKAPSRFFFPGFTPHPPQIFGGGGSLNLKNSPKKKREGGR

SEQ ID NO: 20411 - DNA, 669 bp, Zea mays
  misc_feature: Ceres CLONE 1388804-F
  misc_feature: Encodes the peptide sequence at SEQ ID NO. 20412
  misc_feature (579)..(579): n is a, c, t, g, unknown, or other
ggagctccccgcggtggcggccgctctagaactagtggatcccccgggctgcaggaattcgcacgagaccattacctagaacatcctaatcgaaaaacccttctcgctcggttgctcgggagctttccccttcctgttcctgaagcttccgacatccgaccgcctcctcctcctcgttctactcgccgccccttctagaatcatccagaggcgtgccggtgaagcgcgagagcggtgaggcatggcgatgcagacgggggtcgcgacctccaaggtcctcatcctcgtcggtgcagggatgacgggctcgatcctgctgcggaatggccgcttatctgatgtgttgggagaactccaggagattatgaagggtgtaaatcaaggaacttcttcgggtccctatgacattgcacttattcaagctcagattcggaatttagcgcaagaagtcagagatttgacattgtcaaagcccattaccatactgaatggcaaatctgacttcgggaggcagtttatcatcctacatactgccagcagcagcagttggagcaatgggttattgctactgtggggggnaaggggttgtctctctcagaagggcatgtttgtcacaaaacacaaatgggcaaatgctgttcagagaatgtcaaaggagtttggagcaag

SEQ ID NO: 20412 - protein, 142 aa, Zea mays
  misc_feature: Ceres CLONE 1388804-F
  misc_feature (113)..(113): Xaa is any aa, unknown, or other
MAMQTGVATSKVLILVGAGMTGSILLRNGRLSDVLGELQEIMKGVNQGTSSGPYDIALIQAQIRNLAQEVRDLTLSKPITILNGKSDFGRQFIILHTASSSSWSNGLLLLWGXRGCLSQKGMFVTKHKWANAVQRMSKEFGA

SEQ ID NO: 20413 - DNA, 724 bp, Zea mays
  misc_feature: Ceres CLONE 1388806-F
  misc_feature: Encodes the peptide sequence at SEQ ID NO. 20414
caccgcggtggcggccgctctagaactagtggatcccccgggctgcaggaattcgcacgagaccattacctagaacatcctaatcgaaaaaagctcaccagagcagagaaactcgcacgcactcactctcttccccccctcctgcccactctccaaagcggcgcaagcatctagcaaagctgcgcagcgcagccagcaagcttggtctggagagacagatatagccagccagagagcagcagacgaggcatggcgacgtccgtggcttgcgccttcttcttcgacgcggagccgctgggcgagcccgggcggcacgcgctggacgcctgcgcgctctgcgccaagccgctgagccgcaacagcgacatcttcatgtacaagggcgacaccccgttctgcagcgaggactgccgctacgagcagatgcacccacgacgcggcgtacgcaaggcaggcggccagcagccggcggaagcagcagcagtcgcagtcgcagcggagcagaggggcctcgtccgtgggcgccaaggcggacgtgtccgtggccagctagtcagtagaaaaagcaagcacagcgacgccgagaaaggaggaggaggaggaggagaaaaacaaggccgtgctggttgaagcagcgtacagctgcagagacgcctggggggagggggggaaataccatctcacctcctggatagtcccccccaacacctcgaagccgaaaaaa

SEQ ID NO: 20414 - protein, 126 aa, Zea mays
  misc_feature: Ceres CLONE 1388806-F
  misc_feature (14)..(68): Pfam Name: DUF581 Pfam Description: Protein of unknown function (DUF581)
MATSVACAFFFDAEPLGEPGRHALDACALCAKPLSRNSDIFMYKGDTPFCSEDCRYEQMHPRRGVRKAGGQQPAEAAAVAVAAEQRGLVRGRQGGRVRGQLVSRKSKHSDAEKGGGGGGEKQGRAG

SEQ ID NO: 20415 - DNA, 665 bp, Zea mays
  misc_feature: Ceres CLONE 1388808-F
  misc_feature: Encodes the peptide sequence at SEQ ID NO. 20416
  misc_feature (498)..(498): n is a, c, t, g, unknown, or other
  misc_feature (591)..(591): n is a, c, t, g, unknown, or other
ggagctccccgcggtggcggccgctctagaactagtggatcccccgggctgcaggaattcgcacgagaccattacctagaacatcctaatcgaaaaaacgctcctgctcacagcgtgggggatcttcgcagagatggcgaggacctcgttcctgcagaagctggagcacagggtggaggcgtcggccgccgacttgcagcacatcgagtccatcgccctcgacaccgtctccttcgaggagctcctcggccactgcggcgaggcgctcaaagtctacgcgcgccacgccgacgccctccagtcgcacctcgcttcctttggctacgagcccccggacgcacaacaccccgagatcgacgtggatgtggaagatggagatgtcgggaaggttggggaccctggagatagatgcctcagcgtgtcgcgttcagtgctcagggtcgggtaagcggcggtttgatagccacagcgatgcgatatttgaaagtcactgaaggnatctttgggttttcagatgcttgtctagccactctttcttctgaagggcacatttatggtgagagcccaaagaagctttacagaaatgctganagtaactgatgattggcgaaaagatcatggaatgaagctgaaattatgactcccctaaatgaagaaaatggtca

SEQ ID NO: 20416 - protein, 104 aa, Zea mays
  misc_feature: Ceres CLONE 1388808-F
MARTSFLQKLEHRVEASAADLQHIESIALDTVSFEELLGHCGEALKVYARHADALQSHLASFGYEPPDAQHPEIDVDVEDGDVGKVGDPGDRCLSVSRSVLRVG

SEQ ID NO: 20417 - DNA, 742 bp, Zea mays
  misc_feature: Ceres CLONE 1388810-F
  misc_feature: Translation starting site: 194
  misc_feature (503)..(503): n is a, c, t, g, unknown, or other
  misc_feature (597)..(597): n is a, c, t, g, unknown, or other
  misc_feature (684)..(684): n is a, c, t, g, unknown, or other
  misc_feature (685)..(685): n is a, c, t, g, unknown, or other
  misc_feature (706)..(706): n is a, c, t, g, unknown, or other
  misc_feature (722)..(722): n is a, c, t, g, unknown, or other
aagctggagctccccgcggtggcggccgctctagaactagtggatcccccgggctgcaggaattcgcaagagaccattacctagaacatcctaatcgaaaagcactcatccattccatcatcccctttgcaagtatagtctctctgctaagcgaagcgaagcttcaagctagtctcggcggctctagaagacgatgggcaagaacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctactgcaccngccggcatctcggggggccacatcaaccccgccgtcaccttcggcctcttcctggcgcgcaaggtctccctggtgcgcgcgctgctctactcgntgggcgcagtgcctcgggcgccatctgcggcgtcggctttcgtcaaggcgttccagagcgctacttcgacaggggaccggggggggnngccaactcgctcgcctccggntactcccgcgcaccgncttcttggggccgagatctt

SEQ ID NO: 20418 - DNA, 892 bp, Zea mays
  misc_feature: Ceres CLONE 1388818-F
  misc_feature: Encodes the peptide sequence at SEQ ID NO. 20419
ctcctcttattctcgctcttttcctgacgcctcgccccccccccaagctggagctccaccgcggtggcggccgctctagaactagtggatcccccgggctgcaggaattcgcacgagaccattacctagaacatcctaatcgaaaaccaccacctcggctcctcccccgcggccatggccaccaccactctggggcaaggcgacgacggctgcaaaggccgcagcgccaacgggaatgacaatgccgacgccttccatttggaggatgccaacatccaagatactcctaccaagatgaacagtaccagccttgcaatgaagtggtgagcctgcaccaggtgcaggaggcgaccccgaggagcagcaggaggtatgcggacgggagatgccactctcaaaacagcaggcccacccttgcgaaagagggaaaagaggtaaacctggtcctggaacagcccaccccactttgttggcccgggggacatccccacaaaaaaggggggcggggggaaaaaaaatcctttgccttgaaaaggccccctttttggggaccccccaccaaaaggccctcccccccctcaaaaaggggggaaagcaatttatcaggggcaagtggggggttttttcacccccctttttccccccccccgacggaggagttaccccacgggggagggtgtgccccccccagaaacgactttttgtggcactctatccacgggggggcaaacacattttcccccccgagggcgaacgaaaacaaaatattctagccgcggaacatcccacccagaccagcgttcgccccagagagtggtcaacctacccctccccacagaacagggggggggagggctaattttcggaggacccaccccaccgtgcatggcca

SEQ ID NO: 20419 - protein, 50 aa, Zea mays
  misc_feature: Ceres CLONE 1388818-F
MATTTLGQGDDGCKGRSANGNDNADAFHLEDANIQDTPTKMNSTSLAMKW

SEQ ID NO: 20420 - DNA, 730 bp, Zea mays
  misc_feature: Ceres CLONE 1388825-F
  misc_feature: Encodes the peptide sequence at SEQ ID NO. 20421
  misc_feature (726)..(726): n is a, c, t, g, unknown, or other
tccccgcggtggcggccgctctagaactagtggatcccccgggctgcaggaattcgcacgagaccattacctagaacatcctaatcgaaaatgcggtctgcctctgcccttaccgctacgctttcctcccggattccagcagcgaaacacgcgcggggcaaggacggagctggtaagccgatcgagccggcgagggtggacaagatgatgatggccgaggtggccgccaaccacagcaaaaggagccacaacgacggctacttcagtgccaaagccgccgccgccgccgccgcgagcccagaggagttgggaagcatgtccatgtcctcgaagaagccgaggaatagcaacagcccgagaaccgcgcccgtatcgcccaaggagaagaaggacaggatcggcgagagagtcgcggcgctccagcagctagtgtcgccgttcgggaagacagacacggcttccgttctgcaggaggcgtcggggtacatcaggttcctgcaccagcagctccaggtcctcagctccccttacatgcgtgctcctccggctgccggcgccgcgcctgaggataccgagcactacagcctccggagccgcgggctgtgcctggtgccggtggaccagacactgcagctgacccagagcaacggggccgacctgtgggcgccggcgacacgaccaggcgcaggtgaggaggagcctgctgccggctgtggccctggtggntgtc

SEQ ID NO: 20421 - protein, 213 aa, Zea mays
  misc_feature: Ceres CLONE 1388825-F
MRSASALTATLSSRIPAAKHARGKDGAGKPIEPARVDKMMMAEVAANHSKRSHNDGYFSAKAAAAAAASPEELGSMSMSSKKPRNSNSPRTAPVSPKEKKDRIGERVAALQQLVSPFGKTDTASVLQEASGYIRFLHQQLQVLSSPYMRAPPAAGAAPEDTEHYSLRSRGLCLVPVDQTLQLTQSNGADLWAPATRPGAGEEEPAAGCGPGGC

SEQ ID NO: 20422 - DNA, 726 bp, Zea mays
  misc_feature: Ceres CLONE 1388828-F
  misc_feature: Encodes the peptide sequence at SEQ ID NO. 20423
  misc_feature (596)..(596): n is a, c, t, g, unknown, or other
  misc_feature (613)..(613): n is a, c, t, g, unknown, or other
ggagctccccgcggtggcggccgctctagaactagtggatcccccgggctgcaggaattcgcacgagaccattacctagaacatcctaatcgaaaactcccgtccgtatctctctcttgctcgcactcgcggagatcgaagagaagcgcaggaggccccagcactagcgccgccccgccgccgcatcagacatggcgctggccgctcgcctcgtctcgcgctcccgtcagctatattcggttcaagccactttggggaatggaggtgtcactcaagttcgctcctttgccaaggatgcagctccagctgaccgtcctcctgtcagtggggatgatctcctgaagggcatattctttgaggtaaagaagaagtttgagacagctcttggtgttcttaaaaaggaaaagatcactattgatccagatgacccagcggcagtttctcgttatgcccaagtcatgaagactgtaagggaaaaggcggatcttctctctgattctcaaaggattaaatataccattgagaccttcaccaagggcatccctgatgcacggacttacttgaatactctttcacagctcagaataaagagtggntctatagatcatctggnaattgagcctttgatgatggaagctcttgagaagattgagaaggacattaagaaccacctttggagagcgacaagagaacatggccaccctcctggcagagtttgacaagata

SEQ ID NO: 20423 - protein, 175 aa, Zea mays
  misc_feature: Ceres CLONE 1388828-F
  misc_feature (141)..(141): Xaa is any aa, unknown, or other
MALAARLVSRSRQLYSVQATLGNGGVTQVRSFAKDAAPADRPPVSGDDLLKGIFFEVKKKFETALGVLKKEKITIDPDDPAAVSRYAQVMKTVREKADLLSDSQRIKYTIETFTKGIPDARTYLNTLSQLRIKSGSIDHLXIEPLMMEALEKIEKDIKNHLWRATREHGHPPGRV

SEQ ID NO: 20424 - DNA, 662 bp, Zea mays
  misc_feature: Ceres CLONE 1388833-F
  misc_feature: Encodes the peptide sequence at SEQ ID NO. 20425
  misc_feature (385)..(385): n is a, c, t, g, unknown, or other
  misc_feature (572)..(572): n is a, c, t, g, unknown, or other
  misc_feature (639)..(639): n is a, c, t, g, unknown, or other
ggagctccccgcggtggcggccgctctagaactagtggatcccccgggctgcaggaattcgcacgagaccattacctagaacatcctaatcgaaaactttcgtcaactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggttttgcatatggacagaaatgactactatggaggagattccacctcgctcaaccttaatcagctctggaagaggtttagaggggaagacaagcccccagcacatctaggtgcaagcagagactacnatgtggacatggtgccaaagtttatgatggcaaatgggacattggttcgaaccctcatccacaccgacgtgacaaagtacttgtcattccaaaggctggttgaagggaaaccaattgttttccccaaaaggggggaaaattttttaaaaagccccccccccccccccaataaataatgagggagggntttttttaataaaaccccccccccctctttttttttgtgtggtgttggtttttttttattttttttnaaaagaggggggggggttttttt

SEQ ID NO: 20425 - protein, 129 aa, Zea mays
  misc_feature: Ceres CLONE 1388833-F
  misc_feature (1)..(130): Pfam Name: GDI Pfam Description: GDP dissociation inhibitor
  misc_feature (72)..(72): Xaa is any aa, unknown, or other
MDEEYDVIVLGTGLKECILSGLLSVDGLKVLHMDRNDYYGGDSTSLNLNQLWKRFRGEDKPPAHLGASRDYXVDMVPKFMMANGTLVRTLIHTDVTKYLSFQRLVEGKPIVFPKRGENFLKSPPPPPNK

SEQ ID NO: 20426 - DNA, 698 bp, Zea mays
  misc_feature: Ceres CLONE 1388834-F
  misc_feature: Translation starting site: 236
tggagctccccgcggtggcggccgctctagaactagtggatcccccgggctgcaggaattcgcacgagaccattacctagaacatcctaatcgaaaatcatttttctctctcctgcgccgcgacgtccctcgccttcgccgccgaatccgagactccgatctcgggttcaccgcagcgcacagagcagccccgactcccggaccgatccgcgctctcctctccgtcgcttcagtcatggcaggaatggcacctgagggttctcagttcgatgctaagcactatgattctaagatgcaggagctgctgagcactggtgagactgaggagttcttcacttcatatgatgaagtttttgagagttttgatgatatgggcctccaagagaatcttctgagaggcatttatgcttatggttttgagaagccctctgcaattcagcagagaggaattgttcccttctgcaagggtcttgatgtcattcagcaagcacaatctggtacaggaaagacagcaccttctgttctgtgatcttgcagcagctggactatggcctgcttgaatgccaggacctgatccttgctcccacccgtgagcttgcacagaaaattgagaagtcatgcgagcgcttgtgattacttttggggtagggccatgcatggtgtggaaggaacatccgtccggaagacaaggattcttg

SEQ ID NO: 20427 - DNA, 759 bp, Zea mays
  misc_feature: Ceres CLONE 1388838-F
  misc_feature: Encodes the peptide sequence at SEQ ID NO. 20428
aagctggagctccccgcggtggcggccgctctagaactagtggatcccccgggctgcaggaattcgcacgagaccattacctagaacatcctaatcgaaaaacggggcacaggacgcgcgcgatcccctcgagtccggattgccatggccaccacggcgttcgccgccgccaggttcttccccgcccacctcgactcctccccacgcatcgcgccccaccgcgtcgggcccaccgcgaatctctccttctcaccgctttccgccaactcctcgtccctgctccgcctccattccccctgccatccgggcccccggagggtaggctgccccccgccgccgcagatcgtaccggcggcgccggacggaatctgcgcgacgccgccgaaactccggtaggacctcataaacccctccacccgccgccctccctcgttgtttcttccttctgtgtatgtaggcaccaaaagacaaaaaaacaaagaatcagtaatcagatgacataattactaatttattcatccccctgcaccctcctcgtccctcgcctctcctccccctcctcctcctacctccacagcccccgcccccctggccagcggcgcaccttaccctcagcgctgcccccccgcccaccttatctaccatactataaccaccctccctcctcacgctccccccgcgacccagtcacaaccaccccctgtcatccacacctccaccgcccggcggacgggttctgaatccctcaacctgccatcc

SEQ ID NO: 20428 - protein, 83 aa, Zea mays
  misc_feature: Ceres CLONE 1388838-F
MATTAFAAARFFPAHLDSSPRIAPHRVGPTANLSFSPLSANSSSLLRLHSPCHPGPRRVGCPPPPQIVPAAPDGICATPPKLR

SEQ ID NO: 20429 - DNA, 676 bp, Zea mays
  misc_feature: Ceres CLONE 1388840-F
  misc_feature: Encodes the peptide sequence at SEQ ID NO. 20430
ggagctccccgcggtggcggccgctctagaactagtggatcccccgggctgcaggaattcgcacgagaccattacctagaacatcctaatcgaaaaaccttcgtatccgacggcccaccccgctcgtctatatccgcctccaaaccctagctcttccattcttccccctccggcgccgcctcccccagacacttcgccgccggcaagatgggccgcgtgattcgcgctcagcgcaagggtgcggggtccgtgttcaagtcccatacccatcaccgcaagggccctgcccggttccggtccctcgacttcggcgagcgcaacgggtacctgaagggcgtggtcaccgacgtcatccacgacccgggccgcggcgcgccgctggccaaggtcaccttccgccatccattccggtacaagcaccagaaggagctgttcgtggctgctgagggcatgaacactgggccagttcgtttactgcggacgccgtgctacactctccaattggtaacgtcctgccggttcagggggatgccctgaggggtgcctatttgccgacaacaacaactacccactcgggcgaacgacctggcggtctaccccgaggaatttctttccatttcaccaattgccagccatagaacctctcctgcttcattacagaaggaaacacctactg

SEQ ID NO: 20430 - protein, 109 aa, Zea mays
  misc_feature: Ceres CLONE 1388840-F
  misc_feature (11)..(90): Pfam Name: Ribosomal_L2 Pfam Description: Ribosomal Proteins L2, RNA binding domain
MGRVIRAQRKGAGSVFKSHTHHRKGPARFRSLDFGERNGYLKGVVTDVIHDPGRGAPLAKVTFRHPFRYKHQKELFVAAEGMNTGPVRLLRTPCYTLQLVTSCRFRGMP

SEQ ID NO: 20431 - DNA, 684 bp, Zea mays
  misc_feature: Ceres CLONE 1388842-F
  misc_feature: Encodes the peptide sequence at SEQ ID NO. 20432
aagctggagctccccgcggtggcggccgctctagaactagtggatcccccgggctgcaggaattcgcacgagaccattacctagaacatcctaatcgaaaaccccgccctccgaagtccgaaggccagaagcttccggaagccagcccaagccatgaacgccgccagcaccgccgccgcggcccccgcgcctgccgcgaccgtgcaggtcccgcgcgggcaggtggatctgatcgacttcatcgactggaccggcgtcgagtgcctcaaccaggactcgtcccacagcatcgtcaacgcgctcaagcagagtttgagagacgacgaggggctgtacctcgccagcgattcggacgagcagctgctgatctacatccccttcatgcaggtagtcaaactgcattccgcgatattcaaaggtccccgaggaagagggccccaaaacagtaaaactcttctccaacaagaggccatatgggtttcagcaatgtcaatgactatccaccaagggacaccctcgagctatcatccgatcatttgatagagaataaattttgccactaaagtatgcaagggtttaaaaaatgttcgcagctgcctatattttattgagacaaccccagggggaagggggatgtctccaaaattcacaagattggctcattatggaaacaactggtggaac

SEQ ID NO: 20432 - protein, 128 aa, Zea mays
  misc_feature: Ceres CLONE 1388842-F
MNAASTAAAAPAPAATVQVPRGQVDLIDFIDWTGVECLNQDSSHSIVNALKQSLRDDEGLYLASDSDEQLLIYIPFMQVVKLHSAIFKGPRGRGPQNSKTLLQQEAIWVSAMSMTIHQGTPSSYHPII

SEQ ID NO: 20433 - DNA, 734 bp, Zea mays
  misc_feature: Ceres CLONE 1388843-F
  misc_feature: Translation starting site: 214
  misc_feature (522)..(522): n is a, c, t, g, unknown, or other
  misc_feature (641)..(641): n is a, c, t, g, unknown, or other
  misc_feature (645)..(645): n is a, c, t, g, unknown, or other
  misc_feature (646)..(646): n is a, c, t, g, unknown, or other
ggagctccccgcggtggcggccgctctagaactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtggctgtttttgttgaccttgaacccactgtcatcgatgaggtgaggactggcacctaccgccagctcttccaccctgagcagctcatcagtggggaaggaggatgcagccaacaacntttgcccgtggtcactacaccattgggcaagggagattgttgacctaatgccttgatcgcatcaggaagcttgccgacaactgcactggtctccagggcttctcgcctcaaacccctgntggnngggaggaacggcttccggggccttggttccctctcctaaaaaggcgcctgtctgtgattaacggcagaagtctccagagcttggggtg

SEQ ID NO: 20434 - DNA, 737 bp, Zea mays
  misc_feature: Ceres CLONE 1388844-F
  misc_feature: Encodes the peptide sequence at SEQ ID NO. 20435
  misc_feature (612)..(612): n is a, c, t, g, unknown, or other
tccccgcggtggcggccgctctagaactagtggatcccccgggctgcaggaattcgcacgagaccattacctagaacatcctaatcgaaaaacaccaacaaaccaaacaccatccgccacgaccacgactccacgagagagcggaggaggagggggagcaatggcagagccgggccagcagttgctgcggtcgttcgtggaggtggcagcgggctcgcacttccctatccagaacctgcccttcggggtcttccgccggcgggggtcgccaccgcaggctccgctccccccggtggccatcggggacttcgcgctcgacctcgccaccgtcgccgacgcgggtctcttcgacgggcccgcgctctccggctccccgtgcttccaccaggagacgctcaacatgtttcttggggatgggcccgaccggcgtggagggaggcgcgcgccacgctacaaaaaatcctctcagccgacgagccagtcttgcgtgacaacgaagccctggaggaataaatgtcttattccaatgagtgattaatcgagatggttctaccaatcaaccggttggagggttacacaggatttctttttgttctgtgcaccatgcaaggnaactgcggatccaatcttccggagggccgcagactccgttaatccccaaaatttggttttatctttccaataggaatacaatggacgagacccctcttttaagggtggtgccctggaaaccgaag

SEQ ID NO: 20435 - protein, 125 aa, Zea mays
  misc_feature: Ceres CLONE 1388844-F
  misc_feature (11)..(125): Pfam Name: DUF1969 Pfam Description: Domain of unknown function (DUF1969)
  misc_feature: SWISSPROT Homolog: EC 3.7.1.2 Fumarylacetoacetase
MAEPGQQLLRSFVEVAAGSHFPIQNLPFGVFRRRGSPPQAPLPPVAIGDFALDLATVADAGLFDGPALSGSPCFHQETLNMFLGDGPDRRGGRRAPRYKKSSQPTSQSCVTTKPWRNKCLIPMSD

SEQ ID NO: 20436 - DNA, 613 bp, Zea mays
  misc_feature: Ceres CLONE 1388846-F
  misc_feature: Encodes the peptide sequence at SEQ ID NO. 20437
  misc_feature (334)..(334): n is a, c, t, g, unknown, or other
  misc_feature (373)..(373): n is a, c, t, g, unknown, or other
  misc_feature (393)..(393): n is a, c, t, g, unknown, or other
aagctggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgtgcatcaagcgcgcttcgcggtcgcacacgtaccatcgccgtgagctgtggggcatcaaggccaagaacggcggtgacttccccaaagccgacaaggccgacgccgccgtgtaacccaagttctactctgccgacgacgtcnagacacgcagtcccagcagccgacagcctaagactaccnagctgcagtcgagcatcacncctggtgacggtgctgatccctcctcgcaggcgctccctggaggaaaaaaagggtgctacccagcatgatcaagctaggcctgttccttacctgttggcaattttagaacaaaggggggattgatccccccccgttgccccaaccaaagggaattggccaaccaaccaaaagtgacatttgcgggaggtttctttgccccccctttatccaaacaagccc

SEQ ID NO: 20437 - protein, 46 aa, Zea mays
  misc_feature: Ceres CLONE 1388846-F
MAPTSKLSTCIKRASRSHTYHRRELWGIKAKNGGDFPKADKADAAV

SEQ ID NO: 20438 - DNA, 725 bp, Zea mays
  misc_feature: Ceres CLONE 1388847-F
  misc_feature: Encodes the peptide sequence at SEQ ID NO. 20439
aagctggagctccccgcggtggcggccgctctagaactagtggatcccccgggctgcaggaattcgcacgagaccattacctagaacatcctaatcgaaaaacacgaactcgagacctcgcccgcccaaatacaaaagcctcatatctcagtgaccagcgccgccgcttcgttcgtgtcgaatagagaagagaggaaatggtggcgagcgagggcgtgctcctggggatgggcaaccccctcctcgacatctccgccgttgtcgatgacgccttcctggcaaagtatgacatcaagctgaacaatgccattctcgctgaggagaagcactcgcctatgtatgatgagttggctagcaacagcaatgttgaatatattgctggaggagccacccagaactctatcagggatgcccaatggatgcttcaaactcctggtgcaacaagttacatgcgatgcattggtaaggacaagtttggtgaggagatgaagaacaatgctcaagctgcaggagttactgctcattactatgaggatgagactgctcctactggcacatgtgctgtatgtgttgatggtggcgaatggtcattgattgcaaatctgtcggcggtaaactgttacgaatctgagcatctcatgagaccagatgactgtgcactagatgatgacgcaaatacatctacatttgctggatttgtcctcaccgtgacacctgagtctatc

SEQ ID NO: 20439 - protein, 176 aa, Zea mays
  misc_feature: Ceres CLONE 1388847-F
  misc_feature: SWISSPROT Homolog: EC 2.7.1.20 Adenosine kinase
MVASEGVLLGMGNPLLDISAVVDDAFLAKYDIKLNNAILAEEKHSPMYDELASNSNVEYIAGGATQNSIRDAQWMLQTPGATSYMRCIGKDKFGEEMKNNAQAAGVTAHYYEDETAPTGTCAVCVDGGEWSLIANLSAVNCYESEHLMRPDDCALDDDANTSTFAGFVLTVTPESI

SEQ ID NO: 20440 - DNA, 721 bp, Zea mays
  misc_feature: Ceres CLONE 1388849-F
  misc_feature: Encodes the peptide sequence at SEQ ID NO. 20441
  misc_feature (473)..(473): n is a, c, t, g, unknown, or other
  misc_feature (498)..(498): n is a, c, t, g, unknown, or other
  misc_feature (511)..(511): n is a, c, t, g, unknown, or other
  misc_feature (622)..(622): n is a, c, t, g, unknown, or other
  misc_feature (687)..(687): n is a, c, t, g, unknown, or other
tggagctccccgcggtggcggccgctctagaactagtggatcccccgggctgcaggaattcgcacgagaccatttacctagaacatcctaatcgaaaatgcagtcggaggacgtcgggcgcacgctggacctctccgccgtcgcgtcgtacgaggagctctaccagaggctcgccgacatgttcggcgtcgacaaggccgagctgaccagccacgtgttctaccgcgacgacgcttccggagcgctcaagcaccctggcgacgagcctttcagtgagttcaccaagaccgcccggaggctgaccatactgacggacgagagcagcgacagcttagcgaggtagagtccagtctcaaggagacggcggttcggcagtttcggttgggagtgggaggcgccccggaacgggagcgcgtgcgtgcgtctgatccaggaccaaagatttgtcggactagtagctctacagtagtggnagtacgtacgtacaccttgatgctngctgcttctgctngtcagttcaagtggccataaccataatgcagctgcctttggtccagtgctggatccgggaatgtgttgtgtacatcgggaccgttgatttgcgaacgcgattactgaagantattatatttatttttttttggatttttgatataaaaaaaaaaaaaaaaaagcttatcgtaccgncgaacccctccgggggggggggccccggtaccca

SEQ ID NO: 20441 - protein, 81 aa, Zea mays
  misc_feature: Ceres CLONE 1388849-F
  misc_feature: The sequence is a functional homolog of SEQ ID NO 1185 in the 10/666,642 US patent application
  misc_feature: The sequence is a functional homolog of SEQ ID NO 1184 in the 10/666,642 US patent application
  misc_feature: The sequence is a functional homolog of SEQ ID NO 442 in the 10/666,642 US patent application
  misc_feature: The sequence is a functional homolog of SEQ ID NO 1428 in the 10/666,642 US patent application
  misc_feature: The sequence is a functional homolog of SEQ ID NO 1431 in the 11/479,226 US patent application
  misc_feature: The sequence is a functional homolog of SEQ ID NO 168 in the 10/666,642 US patent application
MQSEDVGRTLDLSAVASYEELYQRLADMFGVDKAELTSHVFYRDDASGALKHPGDEPFSEFTKTARRLTILTDESSDSLAR

SEQ ID NO: 20442 - DNA, 727 bp, Zea mays
  misc_feature: Ceres CLONE 1388851-F
  misc_feature: Encodes the peptide sequence at SEQ ID NO. 20443
  misc_feature (457)..(457): n is a, c, t, g, unknown, or other
  misc_feature (502)..(502): n is a, c, t, g, unknown, or other
  misc_feature (651)..(651): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (720)..(720): n is a, c, t, g, unknown, or other
gctccccgcggtggcggccgctctagaactagtggatcccccggggctgcaggaattcgcacgagaccattacctagaacatcctaatcgaaaaaacccctcacactcccatccagccgccaccaggtgcagagtctttcgtcatctcttctccggcgaagaacccccagtcgcccaccagatcacttgttaaactttgttgaggggtgatggcggtttctttcgcaaacctcaactccgaggcagggcttaaaaagcttgatgagtaccttctcactcgcagctacatcactggctaccaagcttccaaggatgacttggctgtctacacttcgttttcgggtgctccctcgtccaagtatatcagcggagcaaggtgctttaaccacattgatgcgctcgtgaggctgagcggaattactgcagagggccaaggtgtgaaagttgaatcctcagnagttccttcagccccaactccagatgttgctgaagcacaggcccnagttgctgaggaggacgacgaccatgatgttggacctttttggtgaggagaccgaagatgagaaagaaggtggttgaaaagcgtgctggagctgccaaggcttctggcaagaaaaaagaatctggggaagtcatcaagttttacttggntgtgaaggccatgaggacgtggagactgagcatgggccaggnnncaaggagctgtgtgtagggatgggnccagagt

SEQ ID NO: 20443 - protein, 112 aa, Zea mays
  misc_feature: Ceres CLONE 1388851-F
  misc_feature: SWISSPROT Homolog: EC 6.1.1.16 Cysteine--tRNA ligase
  misc_feature (83)..(83): Xaa is any aa, unknown, or other
  misc_feature (98)..(98): Xaa is any aa, unknown, or other
MAVSFANLNSEAGLKKLDEYLLTRSYITGYQASKDDLAVYTSFSGAPSSKYISGARCFNHIDALVRLSGITAEGQGVKVESSXVPSAPTPDVAEAQAXVAEEDDDHDVGPFW

SEQ ID NO: 20444 - DNA, 710 bp, Zea mays
  misc_feature: Ceres CLONE 1388858-F
  misc_feature: Encodes the peptide sequence at SEQ ID NO. 20445
tggagctccccgcggtggcggccgctctagaactagtggatcccccgggctgcaggaattcgcacgagaccattacctagaacatcctaatcgaaaaaagactcaaggaccaaggcagggcactgcactgcacgcatgcactgacctgacgacgcgcgacatagtgcactccacactcaggcatggcgatgggcgccgcttccatcctactgatgatgatgtctctgtaggccctgattctcgccgccgacggcgggggcgtaaccatccgactgcccagcgatgtcgcacgggttgctgcagaccttgtcacggcgatggggagggcgagggcgagggcaaagcatcagcttctcgcatcacaagagaccgtgtctcgaatgctgctacttgttcgtatgcgtaaagacgtacccgctaacttgctcgcgcactgatcggactgagcgctgctcctacacatgtaacgactgcttgcaaacggacgactcgtgccacgtctgcgctcatagtcaccgtgtcgacaccgaggccagatgccacgaataggacgcgaggagcgccgtacccgctgacgacgacgctaatgctcaagcgacgccgacggcatcgatgatggatgacaagaaagcatgcgacgtcgacgacgaccacaagaagagccgtcgaaatgctgccagatgccatctgcacacgacctggactcagtt

SEQ ID NO: 20445 - protein, 88 aa, Zea mays
  misc_feature: Ceres CLONE 1388858-F
MSHGLLQTLSRRWGGRGRGQSISFSHHKRPCLECCYLFVCVKTYPLTCSRTDRTERCSYTCNDCLQTDDSCHVCAHSHRVDTEARCHE

SEQ ID NO: 20446 - DNA, 696 bp, Zea mays
  misc_feature: Ceres CLONE 1388860-F
  misc_feature: Encodes the peptide sequence at SEQ ID NO. 20447
tggagctccccgcggtggcggccgctctagaactagtggatcccccgggctgcaggaattcgcacgagaccattacctagaacatcctaatcaaaaagcacaaacgcgctcggcgcttccccacccaaaaaggaaaaccaaccaccactcccaccaccctccgcctccgcctgcgccacagctgccgattcgaaagccctcgtcctgacccctcgcaaaaccctagctccaaccaccatgaagggcaaggccaacgcctccaagaaggatgaggccaggctccgggccggcggcggcggcgccggaaagcgcaagaaggccgccgcgagcggcaagcccaagcgccctccctccgccttcttcgtcttcatgtctgaattcaggcaggagtaccaggcgcagcaccctggcaacaagagcgttgcggccgtgagcaaggcagcaggggaaaagtggcgctctatgtcagagcaagagaagcaaccctatgtggaccaagctgggcagaagaagcaggactatgagaagactaaggcaaatattgagaaggagagcacaagctcaaagaaggctaagactgatgacgacgatggctcgaagtccgaggtcgatgatgaggatggcggtagtgacgaggataacgacgacgacgagtaaatagtatttccgctgttgtgaggtgtttatgaaggggaa

SEQ ID NO: 20447 - protein, 139 aa, Zea mays
  misc_feature: Ceres CLONE 1388860-F
  misc_feature (34)..(103): Pfam Name: HMG_box Pfam Description: HMG (high mobility group) box
MKGKANASKKDEARLRAGGGGAGKRKKAAASGKPKRPPSAFFVFMSEFRQEYQAQHPGNKSVAAVSKAAGEKWRSMSEQEKQPYVDQAGQKKQDYEKTKANIEKESTSSKKAKTDDDDGSKSEVDDEDGGSDEDNDDDE

SEQ ID NO: 20448 - DNA, 607 bp, Zea mays
  misc_feature: Ceres CLONE 1388861-F
  misc_feature: Encodes the peptide sequence at SEQ ID NO. 20449
  misc_feature (210)..(210): n is a, c, t, g, unknown, or other
  misc_feature (260)..(260): n is a, c, t, g, unknown, or other
  misc_feature (289)..(289): n is a, c, t, g, unknown, or other
  misc_feature (328)..(328): n is a, c, t, g, unknown, or other
ggagctccccgcggtggcggccgctctagaactagtggatcccccgggctgcaggaattccacgagaccattacctagaacatcctaatcgaaaaatacatttcgactctcaactcccaaggtcccttttttttctcgatctggaagcgccgcagtagcagccatggacgtgagcggagcaggcgggaaggcgaagaagggcgcggcggngcgcaaggccggcgggccgacgaagaaagtcggtgtcgcgtccgcagggncggctgcagtccccgtcagccgggcgggnggtacctccaaaagggccggtacccccaacgggggaagnaaggggggcccccgtttaaacttcgccgccgggctgggggaaaacccccgggggcggagggggtttaaattctcccccggaaacggggcgggggggggaaaaaaaaaaaaaagaggggggttttttcccccccccgcgcgggggggtttcccccccccccccccaaaaaaaaaaaaaaaatttttttttaaatggggggtgggggggggcccaccccccccccggggggggggccccccaccaaaaaaagtgggggtggcccccccaaaaaaggggggg

SEQ ID NO: 20449 - protein, 148 aa, Zea mays
  misc_feature: Ceres CLONE 1388861-F
  misc_feature (16)..(16): Xaa is any aa, unknown, or other
  misc_feature (33)..(33): Xaa is any aa, unknown, or other
  misc_feature (55)..(55): Xaa is any aa, unknown, or other
MDVSGAGGKAKKGAAXRKAGGPTKKVGVASAGXAAVPVSRAGGTSKRAGTPNGGXKGGPRLNFAAGLGENPRGRRGFKFSPGNGAGGGKKKKRGGFFPPPARGGFPPPPPKKKKKFFFKWGVGGGPPPPRGGGPPPKKVGVAPPKKGG

SEQ ID NO: 20450 - DNA, 664 bp, Zea mays
  misc_feature: Ceres CLONE 1388867-F
  misc_feature: Translation starting site: 448
  misc_feature (664)..(664): n is a, c, t, g, unknown, or other
tccccgcggtggcggccgctctagaactagtggatcccccgggctgcaggaattcgcacgagaccattacctagaacatcctaatcgaaaaatcgaagggtcgacaatggttacgacgatcggtagtccatagcagcggcgggcgcaacttcgacccggttttcttcccatatatctgtcaaatccttctccggttgccctccatcggcagcaatttccgccatagataccggcgatcgagggcctcggacaacccaatcgacggagcagcgcggcggcaggagagggcaaacccttttcttctcagtactctacttgtctgcgcctggatcccctccgcaggaagataagacatgggtcaagcactcggcttgattcaagtggatcaatcgacagtagccatcaaggaaactttttgggaagttttgacgaggtcctagagcctggatgccacttcttgccatggtgcatagggaagcaaattggctgggtatctgtcactgcgtgtgcagcaagtttgatgttcgctgcgaaaccaagacaaaggataatgtcttcccgccaatggtgggggcatctggggcaatatcgtggcctttgccgattaggcaatctgatgcatttttacaggcttagtaacaccagggagcaatcccggccttan

SEQ ID NO: 20451 - DNA, 661 bp, Zea mays
  misc_feature: Ceres CLONE 1388869-F
  misc_feature: Encodes the peptide sequence at SEQ ID NO. 20452
tccccgcggtggcggccgctctagaactagtggatcccccgggctgcaggaattcgcacgagaccattacctagaacatcctaatcgaaaaaacgagagcacccggaccagacgcccaagtcgatcgccatggcgatgaagccggcggcggcggctccccctaccccggccgcggagcacagcgtgttcgtctacggcagcctgatggcggacgaggtggtccgcaccatcctcaagcgcgtcccgcccgccgccccggccctcctcccaaactaccaccggttcaacatcaagggccgcatttacccggcgatcctgcccgttgagagcaagagagttgctgggaggattatcatgggtgttactgatgaaaagctccagcttcttgacgcgtttgaagacgtggagtacaccaggacaagagctgagatatcattgggtgactcttccgagaacatgctggctgacacttacgcgtgaagggatgcagaggatctccctctttatggacaatgagactttgaggcgatatgactggtttcctgagcacctggcgagttaatgctatgtgattatcatgctacgtggatcatatcaaaatgatgaactctatcagctactgcccgtcctcgggatctaaaattctgttgcgacccgcaca

SEQ ID NO: 20452 - protein, 116 aa, Zea mays
  misc_feature: Ceres CLONE 1388869-F
  misc_feature (19)..(116): Pfam Name: AIG2 Pfam Description: AIG2-like family
MAMKPAAAAPPTPAAEHSVFVYGSLMADEVVRTILKRVPPAAPALLPNYHRFNIKGRIYPAILPVESKRVAGRIIMGVTDEKLQLLDAFEDVEYTRTRAEISLGDSSENMLADTYA

SEQ ID NO: 20453 - DNA, 747 bp, Zea mays
  misc_feature: Ceres CLONE 1388873-F
  misc_feature: Translation starting site: 194
tcaccgcggtggcggccgctctagaactagtggatcccccgggctgcaggaattcgcacgagaccattacctagaacatcctaatcgaaaaaccaattccccaacttttttgcttccattccacaaaaacacaaccgcgcgcctttctcactccccggactcccgcggcgaaagagaaaccgacccaagcgccatgggcgccgccggccccgacgccaacgcctacgatatcccgtgggtggacaaccagcgcccctcccgggtggttgacgtagtaggaaactccgatgccgacgaccgactggaggacattgaccgcgacgaggacatgcccaacctcatcctctccggccctccggagaccggaaagacgaccagcatcctggcgatggcgaaagagatcctcgcgaccagctatcgtgatgtcatgctggagatcaatgccacagatgacaggacgtcgaatgttcgccgcgtcaacagagatcaagatggtcgcacacaataacggcaccctacagacaggcaggcacaaaatcacgatcatggcatgaagctgacagcatgacatcaggatgacagcaagctctgagaagaacaatggacatctattcagacaccactagatttgccacttgcatgcaacacatcatcacagataattgaaccccagttcaaagccgatgtgtctatcgtcaggtctcaaaaggctctcctgatcaaggagatcctcggtcgccttcatgg

SEQ ID NO: 20454 - DNA, 741 bp, Zea mays
  misc_feature: Ceres CLONE 1388874-F
  misc_feature: Translation starting site: 163
  misc_feature: SWISSPROT Homolog: EC 3.1.3.16 Phosphoprotein phosphatase
tcaccgcggtggcggccgctctagaactagtggatcccccgggctgcaggaattcgcacgagaccattacctagaacatcctaatcgaaaactctctctctctctctcgtcctgcgccacacgccgcggtcgtctccggacaggaaggaagtgggcgggaagatgatgatgacgcgggcaccgatggggccgatggagggcgcggcggtggacgagatggtgcgccgcctcgtggagggcggccgaggcggtcgccaggtgcagctgtccgaggcggagatccggcagctctgcgtagagggcaagcgggtgctcctctcccagcccaatctcctccgaatccacgccccagtcaagatctgcggtgatatccatggccagtttgtcgaccttctgagattattcgatttgggtggttatcctccagcttcaacttacgtattccctcggagactatgtcgatagaggcaaacagagcctggagactatatgcttgctgctggcgtacaaaatccggtaccccgaaaaatattttcctgttgaggggtaaccacgaggatgcaaagatctgcagagcctatggtttttatgaccaatgtaagagaaggttccattgttctgctggggaagatattctctgattgcttcaactgcctgcccaattgaagggtttcatcgagaacaaaatactgtgcaaggcttggtggcctcttcaccgaaatgaactatttcggacctaat

SEQ ID NO: 20455 - DNA, 732 bp, Zea mays
  misc_feature: Ceres CLONE 1388875-F
  misc_feature: Translation starting site: 265
  misc_feature (499)..(499): n is a, c, t, g, unknown, or other
tggagctccccgcggtggcggccgctctagaactagtggatcccccgggctgcaggaattcgcacgagaccattacctagaacatcctaatcgaaaagcgtgcccccctccctccctcagtccctctctctcgctctcggcgacgactgggcgaccgccgccgccgctgcgccgcccttgtccaggtgcccaggtcttcgcaggcgccttcgccaggtcttcgacggtaacgagcaccaaccggattcagggaatataagtaaaatgaggccagttttttgtgggaaccttgactatgatgttcgcatctcagaggttgagcgcctttttgggaagtatggaagggtggaacgagtggatctaaagacagggtttgcatttgtctacatggaagatgaacgcgatgctgaagatgctatcagtagacttgatggaattgattttggcagaaaaggaaggaggatcagggttgagtggacaaaggaggatcgcactgttnggcgaaaagcagctcaaggaggtctccaaccaatacaaaaccgaccaaaaccttgtttgtgatcaactttgacccgatcaacacaagaatccgagatctggagaggcacttcgataaatatggcagggtcgcaaatgtaagaatcaaaaaagactttgccctttatccagtttgagataaaaggaggatgctacaagagcattggaagggtactaatggaaacccattcctgg

SEQ ID NO: 20456 - DNA, 722 bp, Zea mays
  misc_feature: Ceres CLONE 1388879-F
  misc_feature: Translation starting site: 166
  misc_feature: Pfam Name: HTH_3 Pfam Description: Helix-turn-helix
  misc_feature (536)..(536): n is a, c, t, g, unknown, or other
gctggagctccccgcggtggcggccgctctagaactagtggatcccccgggctgcaggaattcgcacgagaccattacctagaacatcctaatcgaaaaaagtcctgtcaacagcgtgctcgagattataagcacaaggaaatacaaggaaataagagtacagagatgccaactggtaggctgagcggcaacatcacccaggactgggagccggtggttctgcgccgtacgaagccgaaggcggcggacctcaagtcgtcgaaggcggtgaaccaggcgctgcggtcgggcgcggccgtggagacggtgcgcaagtcagcagcgggcatgaacaagcactccgctgcggtggcgcccgcgcgtaagctggacgagacgacggagcccgctgcggtggagcgggtggctgtgcaggtgcgcgcggccattcagaaggcgcgcgtggccaagggatggagccaggcggagctggcgaagcgcatcaacgagcgcgcgcaggtggtgcaggagtacgagagcggcaaggcggcgccggnccaggccgtgcttgccaagatggagcgcgccctcgaggtcaagctccgtgggaaaggcgtcggcgcgccactggcggccggcgggaaaggaaccgatattctgatgtgatggacttgtgcaaatttgcacgttgataggttaacctcttttttgaaaaaaaaaaaaaaaaagcttatcgaatacct

SEQ ID NO: 20457 - DNA, 626 bp, Zea mays
  misc_feature: Ceres CLONE 1388884-F
  misc_feature: Encodes the peptide sequence at SEQ ID NO. 20458
ggagctccccgcggtggcggccgctctagaactagtggatcccccgggctgcaggaattcgcacgagaccattacctagaacatcctaatcgaaaaacaaacacgtgacacctccgcccaccctcgccccctccctaccggcaccgcccagatggcctgctcccacatcgccgccgcgggggtctcctcccccgccgcagcggcggctcgttccccggcgcattctcccgcttccgccttcgcgcgcctccggtcgacgcctcgtttcgcgagcgctggcttgtcggttaagggaaacggagcggcgttcccgttggtcgccgccgcggggccggccgcggcggcaccggtgggcgacctggacgggcgcccggccacggagaagcagcccatcatcgtcatcgacaactacgacagcttcacatacaacctctgccagtatatgggggagcttggattgaacttcgaaggataccggcaatgatgaactgaccatagaagatgtgagaaagaagaaccccaaggggattacttatttctccaggaacctggtggaaaccacaggattccggaaatatcaatggcagactggttctttggattaaggccccacccattcccaattt

SEQ ID NO: 20458 - protein, 110 aa, Zea mays
  misc_feature: Ceres CLONE 1388884-F
  misc_feature (81)..(102): SWISSPROT Homolog: EC 4.1.3.27 Anthranilate synthase
  misc_feature (81)..(102): SWISSPROT Homolog: EC 2.6.1.85
MACSHIAAAGVSSPAAAAARSPAHSPASAFARLRSTPRFASAGLSVKGNGAAFPLVAAAGPAAAAPVGDLDGRPATEKQPIIVIDNYDSFTYNLCQYMGELGLNFEGYRQ

SEQ ID NO: 20459 - DNA, 680 bp, Zea mays
  misc_feature: Ceres CLONE 1388886-F
  misc_feature: Encodes the peptide sequence at SEQ ID NO. 20460
  misc_feature (490)..(490): n is a, c, t, g, unknown, or other
tggagctcaccgcggtggcggccgctctagaactagtggatcccccgggctgcaggaattcgcacgagaccattacctagaacatcctaatcgaaaaatcacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgagctgcagcggggtgcgctcgctcaacagccgcgcgtcgtcgacggcgagacggcaggccacctgcaactgcctcaagagcatgacgggccgtctcggcggcggcgtcagcatgaccaaggnccgccaacatccccttcaagtgcggggtctccgtcggggtggccaatcagccccacccgtggaatggcccaagaacaactggatccagggaaccctagggggggggaaattccctctttgggaggaaaccggaattgggcccacacaaaaagtagaaatctcctccccaaaaaaaaaattgccttttttg

SEQ ID NO: 20460 - protein, 167 aa, Zea mays
  misc_feature: Ceres CLONE 1388886-F
  misc_feature (39)..(116): Pfam Name: Tryp_alpha_amyl Pfam Description: Protease inhibitor/seed storage/LTP family
  misc_feature (104)..(104): Xaa is any aa, unknown, or other
MAARSSSSQPQLVAAAAVLAAALLLLAAGAGTASAAVSCGEVTSSVAPCLGYAMGSAASPSAASCSGVRSLNSRASSTARRQATCNCLKSMTGRLGGGVSMTKXRQHPLQVRGLRRGGQSAPPVEWPKNNWIQGTLGGGKFPLWEETGIGPTQKVEISSPKKKLPFL

SEQ ID NO: 20461 - DNA, 798 bp, Zea mays
  misc_feature: Ceres CLONE 1388896-F
  misc_feature: Encodes the peptide sequence at SEQ ID NO. 20462
  misc_feature (798)..(798): n is a, c, t, g, unknown, or other
acccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgatcgccgaggcgaggaacatcaagaccacgacgacggataagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagcctacccgggttcagcttgcccggcagcggcagcatgcccctcttcggcggcggctcctcgggcttcagcggcttcggcggcatgcccgggtcccccaccgccggctccgtccccgagcacgccaacaagccctgaacgccacaagcgtggtaagtagagtggtgctactgttactggtagtacgtcgtcgtctcaatgatgggggggggttcgtggtttcccctagctccatacggagcagtagttgggccttgcaacgtaccgtacgtctagtagctatatttattn

SEQ ID NO: 20462 - protein, 128 aa, Zea mays
  misc_feature: Ceres CLONE 1388896-F
MARSSKMMVAAALLALALAVSIAEARNIKTTTTDKKDDAVVQPQTFPPFDRLGGGASPAFGGLPGGSIPGSSIPGFSMPGSGSSLPGFSLPGSGSMPLFGGGSSGFSGFGGMPGSPTAGSVPEHANKP

SEQ ID NO: 20463 - DNA, 898 bp, Zea mays
  misc_feature: Ceres CLONE 1388899-F
  misc_feature: Encodes the peptide sequence at SEQ ID NO. 20464
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (898)..(898): n is a, c, t, g, unknown, or other
nnnnnggggcccccccccnnnnnncnnnnnnnnnannacnnnnnaacggccannnttcaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaacccacttcatcaacgggcagaccaactaccccggggtggccggcaaacgggcgcgacgttctacttccctggtgttcgccatcctggcccggcgtggtgggcccggccgtccaaacctggcggggcggtggcaaccacgggcgcggcctgggggcccacgaaacagcctggggccaccaaaggccggggtcggcggttccttcggcctggggccatcaaggggggttcgccctttcgggcttgggccctgcaaaggaaatatccccactccggggggaacaccgccggttgggccgcccctgccccggtggcttggaaaaggcccttttccgccatacaatttccttccgcctttttaggggagggttttcccttttaaaggggggttccatggtggtccccn

SEQ ID NO: 20464 - protein, 157 aa, Zea mays
  misc_feature: Ceres CLONE 1388899-F
MAGIGRNMVAPLLVLNLIMYIIVIGFASWNLNPLHQRADQLPRGGRQTGATFYFPGVRHPGPAWWARPSKPGGAVATTGAAWGPTKQPGATKGRGRRFLRPGAIKGGSPFRAWALQRKYPHSGGNTAGWAAPAPVAWKRPFSAIQFPSAFLGEGFPF

SEQ ID NO: 20465 - DNA, 810 bp, Zea mays
  misc_feature: Ceres CLONE 1388901-F
  misc_feature: Encodes the peptide sequence at SEQ ID NO. 20466
  misc_feature (690)..(690): n is a, c, t, g, unknown, or other
tggcggccgctctagaactagtggatcccccgggctgcaggaattcgcacgagaccattacccagaacatcctaatcgaaaacacgatcacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgatcgccgaggcgaggaacatcaagaccacgaccacggataagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagcctacccgggttcagcttgcccggcagcggcagcatgccccctcttcggcggcggctccccgggcttcagcgggcttcggcgggcatgcccgggtcccccacccgccggctccgtccccgagcacgcccacaagccctgaacgcaaccaagcgggggaaagtagagtggtgctactgttaccgggaanaacgtcgtcgctcattggaggggggggggggtttgcgggggtttcccctagctccataacgaggccaggaggtgggcccttgcccccgtaccggacgtctagtagtttatattgttttgg

SEQ ID NO: 20466 - protein, 165 aa, Zea mays
  misc_feature: Ceres CLONE 1388901-F
  misc_feature (147)..(147): Xaa is any aa, unknown, or other
MARSSKMMVAAALLALALAVSIAEARNIKTTTTDKKDDAVVQPQTFPPFDRLGGGASPAFGGLPGGSIPGSSIPGFSMPGSGSSLPGFSLPGSGSMPPLRRRLPGLQRASAGMPGSPTRRLRPRARPQALNATKRGKVEWCYCYREXRRRSLEGGGGLRGFPLAP

SEQ ID NO: 20467 - DNA, 757 bp, Zea mays
  misc_feature: Ceres CLONE 1388903-F
  misc_feature: Encodes the peptide sequence at SEQ ID NO. 20468
  misc_feature (436)..(436): n is a, c, t, g, unknown, or other
  misc_feature (441)..(441): n is a, c, t, g, unknown, or other
  misc_feature (477)..(477): n is a, c, t, g, unknown, or other
  misc_feature (629)..(629): n is a, c, t, g, unknown, or other
tccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcggcgttgcaggggttcctgtgcctggaggaggtgnacggnaggcggtgaagctacgtggtggacggtggggccgcnaaaagggagagcaggggcggggccgtccccgctgggggcgccgtcagggccgtgccgctgcagtcgccgcttccggctgccgaggaataatggcatccatagatcatatgtggtgcctgaaggggttccagacagggtactccttcatatgnaccttactggactggaaggctctgagcatttctttggtgagggaggggagggttacaacaaaacctggtgagttctgtggaggctcccaagcagtaaacccagggcttgctataatgatccccagggg

SEQ ID NO: 20468 - protein, 67 aa, Zea mays
  misc_feature: Ceres CLONE 1388903-F
  misc_feature (64)..(64): Xaa is any aa, unknown, or other
MAPAVGLKRSATQTITLPPPDTRLAVRDVMRSTIPSQPAVAPASTERQAPAAALQGFLCLEEVXGRR

SEQ ID NO: 20469 - DNA, 734 bp, Zea mays
  misc_feature: Ceres CLONE 1388904-F
  misc_feature: Translation starting site: 338
  misc_feature (346)..(346): n is a, c, t, g, unknown, or other
  misc_feature (351)..(351): n is a, c, t, g, unknown, or other
  misc_feature (352)..(352): n is a, c, t, g, unknown, or other
  misc_feature (362)..(362): n is a, c, t, g, unknown, or other
  misc_feature (365)..(365): n is a, c, t, g, unknown, or other
  misc_feature (384)..(384): n is a, c, t, g, unknown, or other
  misc_feature (465)..(465): n is a, c, t, g, unknown, or other
  misc_feature (501)..(501): n is a, c, t, g, unknown, or other
  misc_feature (519)..(519): n is a, c, t, g, unknown, or other
  misc_feature (525)..(525): n is a, c, t, g, unknown, or other
ggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggnattgnncagaacatgntgncgccgctcctggtgctcancctcatcatgtacatcatcgtcatcggcttcgcgagctggaccctgaaccacttcatcaacgggcagacaactacccccgncgtggcccgcaacggcgcgacgttctacttcctggntgttcgcatcctggccgncgtggntgggcgccggcttccaagctagcggggcgggccccacgtgcgcgcctggggcgcccgaaaagcctggcccaccaagggcgcggggggtccttcattgccctggggcaattccggggctcccctttggggttggccgggaagggaaatccccatcgggaacacccccggtggggcccctgccgggttttaaaacccttccccccaccctc

SEQ ID NO: 20470 - DNA, 639 bp, Zea mays
  misc_feature: Ceres CLONE 1388905-F
  misc_feature (177)..(177): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
ggagctccccgcggtggcggccgctctagaactagtggatcccccgggctgcaggattcgcacgagaccattacctagaacatcctaatcgaaaactcccgcccgatacatttctcgtacatcgctctcgctctcgctctctctcctgctgtccacgaccgaccaaaggcggccggncacagactcttccttcggactaagagaaagttcggggcccctccccaaaacaaggggttcccgggggggaacctcccaagggtttcggggctccggaaagggccccccctttgggtttttttctcccccgggggccccctttttgggatattttaaaaaaaaaaggggggggggaaaaaaacccccccccacccccccccgtggggggcgccttttaaaaaaaaaaaaaaggagggggggggtataaaaaaaaggcgccccctgtggacccccccccaccaaaaagagggggggggtgggggccaaaaaaaaaaaaaaaaggggcggtgggggggtttgtcctctccccccaaggagaaaaaannnagggggggggggggttttttttcttcttctcccccgccgcggggggggggggggggggccacacaaaaaaaaatttctttttcttctttccccccc

SEQ ID NO: 20471 - DNA, 797 bp, Zea mays
  misc_feature: Ceres CLONE 1388906-F
  misc_feature: Encodes the peptide sequence at SEQ ID NO. 20472
tccccgcggtggcggccgctctagaactagtggatcccccgggctgcaggaattcgcacgagaccattacctagaacatcctaatcgaaaaaacgtgtcttccttcccgcggtctctccgccgcctcccagatccggcggccatggcaaggaacccgggctgcaccgtcttcataggtaacttggatgacaaggttcctgagagggttctgtatgaaattcttattcaggtaggtcgtgttgtagacctacacatacctcgtgacaaggaaactagccgaccaaaaggctatgcttttgctgagtatgaaacagaggagattgcccaatatgctgttaagctattttctggtcttgttcgacttcataataaaacgcttagatttgcgatctctgggcaagacaaaccctcattaaatggcaatatccctgtaactcctaggttaaactctgtaccacagccaaagcctcatcaacctatgaggtctagtgatactcctttgccacagcatgcagcagtgaatggcaggaatgccgggtatggtatccccaccaaatcattcatacgacacgcacactcaagcactgtcggagtgggttaccgaatagaggactaagcaacggtacatatgaatatagtaggccgggtatttggttcttgtctgaatgatgttaacccgtcgagctaccaggaaaccattcccgtacccgtcctactagcatgttgagccccggtgactgtgactctgtgctgacaaaaatatttctgaagaggttgcctgtttgtgcacccacctg

SEQ ID NO: 20472 - protein, 157 aa, Zea mays
  misc_feature: Ceres CLONE 1388906-F
  misc_feature (9)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MARNPGCTVFIGNLDDKVPERVLYEILIQVGRVVDLHIPRDKETSRPKGYAFAEYETEEIAQYAVKLFSGLVRLHNKTLRFAISGQDKPSLNGNIPVTPRLNSVPQPKPHQPMRSSDTPLPQHAAVNGRNAGYGIPTKSFIRHAHSSTVGVGYRIED

SEQ ID NO: 20473 - DNA, 783 bp, Zea mays
  misc_feature: Ceres CLONE 1388909-F
  misc_feature: Encodes the peptide sequence at SEQ ID NO. 20474
gctctagaactagtggatcccccgggctgcaggaattcgcacgagaccattacctagaacatcctaatcgaaaaaacccctcacactcccatccagccgccaccaggtgcagagtctttcgtcatctcttctccggcgaagaacccccagtcgcccaccagatcacttgttaaactttgttgaggggtgatggcggtttctttcgcaaacctcaactccgaggcagggcttaaaaagcttgatgagtaccttctcactcgcagctacatcactggctaccaagcttccaaggatgacttggctgtctacacttcgttttcggctgctccctcgtccaagtatatcaacgtagcagggtggtttaaccacattgatgcgctcgtgaggctgagcggaattactgcagagggccaaggtgtgaaggttgaatcctcagcagttccttcagccccaactccagatgttgctggaagacagggcccagttgctgaggaggacgacgacgatgatgttgaccttttttggggaggagaccgaagatgagaagaagggtgctgaaaagggtgctggagctgccaaggtttctggaaagaaaaaaaaatctggaaaagcatccagttttacttgaggggaagccatgggacgaaggaaactggcattggccaagttccgaggaaatttttaaagaagggcccaaaatggaaaggctggtctttgggggggcaatccaaggtttgtcccaaatgtggaattgggtaaccaaaaaagctggaaaaatatggg

SEQ ID NO: 20474 - protein, 117 aa, Zea mays
  misc_feature: Ceres CLONE 1388909-F
  misc_feature: SWISSPROT Homolog: EC 6.1.1.16 Cysteine--tRNA ligase
MAVSFANLNSEAGLKKLDEYLLTRSYITGYQASKDDLAVYTSFSAAPSSKYINVAGWFNHIDALVRLSGITAEGQGVKVESSAVPSAPTPDVAGRQGPVAEEDDDDDVDLFWGGDRR

SEQ ID NO: 20475 - DNA, 809 bp, Zea mays
  misc_feature: Ceres CLONE 1388913-F
  misc_feature: Encodes the peptide sequence at SEQ ID NO. 20476
  misc_feature (636)..(636): n is a, c, t, g, unknown, or other
  misc_feature (660)..(660): n is a, c, t, g, unknown, or other
  misc_feature (661)..(661): n is a, c, t, g, unknown, or other
  misc_feature (708)..(708): n is a, c, t, g, unknown, or other
  misc_feature (787)..(787): n is a, c, t, g, unknown, or other
  misc_feature (788)..(788): n is a, c, t, g, unknown, or other
  misc_feature (801)..(801): n is a, c, t, g, unknown, or other
ggagctccccgcggtggcggccgctctagaactagtggatcccccgggctgcaggaattcgcacgagaccattacctagaacatcctaatcgaaaagtcaaagcagagtctgcccctccccgcgccgttctttttggttccccagtccccgccgccgccgaaacccgcagatggaggtcgtcgtcgccgcgaagcagaaggcgaagaaacacatacacctcttctactgctcagaatgcgaggagctcgccctcaagatcgccgccagctccgacgccatcgagctccaatccatcaactggcggagcttcgacgacgggttcccgaacctgttcatcaacaaggcgcacgacatccgtgggcagcacgtggcgttcctggcctccttcagctcgccgtcggtcatattcgagcagatctccgtcatcttcgcgctgcccaagctattcatcgcctcattcacgctcgtgctgccattcttccccacgggctcattcgagcgcgttgaggaggagggcgatgtcgccaccgcgttcaccctcgcgcgcattctctcgatgatccccaagtcgcgcggcgggcctaccagcgtcgtcatctacgacatccacgcgctcccaggagaggttttacttncggggacgatgtcctggcatgctnncgagacagggatccccgctctgctggcagcgctcccgcagctccggnacgcagaaatatcaccattggcttttccgatgacggggcgtggaagcggttccacagctggtacagactttccatgagnncctgaacaagggntcggaagg

SEQ ID NO: 20476 - protein, 204 aa, Zea mays
  misc_feature: Ceres CLONE 1388913-F
  misc_feature: SWISSPROT Homolog: EC 2.7.6.1 Ribose-phosphate diphosphokinase
  misc_feature (156)..(156): Xaa is any aa, unknown, or other
  misc_feature (164)..(164): Xaa is any aa, unknown, or other
  misc_feature (180)..(180): Xaa is any aa, unknown, or other
MEVVVAAKQKAKKHIHLFYCSECEELALKIAASSDAIELQSINWRSFDDGFPNLFINKAHDIRGQHVAFLASFSSPSVIFEQISVIFALPKLFIASFTLVLPFFPTGSFERVEEEGDVATAFTLARILSMIPKSRGGPTSVVIYDIHALPGEVLLXGTMSWHAXETGIPALLAALPQLRXAEISPLAFPMTGRGSGSTAGTDFP

SEQ ID NO: 20477 - DNA, 848 bp, Zea mays
  misc_feature: Ceres CLONE 1388915-F
  misc_feature: Encodes the peptide sequence at SEQ ID NO. 20478
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (555)..(555): n is a, c, t, g, unknown, or other
  misc_feature (556)..(556): n is a, c, t, g, unknown, or other
  misc_feature (562)..(562): n is a, c, t, g, unknown, or other
  misc_feature (563)..(563): n is a, c, t, g, unknown, or other
  misc_feature (569)..(569): n is a, c, t, g, unknown, or other
  misc_feature (570)..(570): n is a, c, t, g, unknown, or other
  misc_feature (611)..(611): n is a, c, t, g, unknown, or other
  misc_feature (626)..(626): n is a, c, t, g, unknown, or other
  misc_feature (628)..(628): n is a, c, t, g, unknown, or other
  misc_feature (654)..(654): n is a, c, t, g, unknown, or other
  misc_feature (717)..(717): n is a, c, t, g, unknown, or other
  misc_feature (730)..(730): n is a, c, t, g, unknown, or other
  misc_feature (743)..(743): n is a, c, t, g, unknown, or other
  misc_feature (752)..(752): n is a, c, t, g, unknown, or other
  misc_feature (765)..(765): n is a, c, t, g, unknown, or other
  misc_feature (811)..(811): n is a, c, t, g, unknown, or other
  misc_feature (832)..(832): n is a, c, t, g, unknown, or other
tcaccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggttcggtccttcttctcgcgctcccgcagcggcaagcgcggcagcgcccggagagcaggctcgtcctcgccgcactcctccgcggccagcgcgccgccgtccccgtccccactcccgaggaggtcaccgtcgtcgtcgtcaaccacaaccagggacgagacggagcgcgtgttccgcaagttcgacgcgaacggcgacgggcagatctcgcggtccgagctggcggcgctggttcgagggcgtgggccacgccggaccgacacagggttttttttttggggggggggggggggggaagnnntnnnnnnnnnnnttttnntttttnnaaaatnngttgaaaaaaataagggggtttttttggtatgggaggattngaatttatggggggntngtttaaggggttgatttaaggggggnttaaaaatgttttattttaagtggaatgggaattgggaaaaatttgagaaagtaaagtttttnttgttgaaataantttgttgtttggnttttaaatnaaaagttaaaatnaatgttaaaaaaaaaaaaaaaagaaaaggtttaatggataggggtnggaatttggggggggtgtggnaggagaataaaagttg

SEQ ID NO: 20478 - protein, 137 aa, Zea mays
  misc_feature: Ceres CLONE 1388915-F
  misc_feature (56)..(84): Pfam Name: efhand Pfam Description: EF hand
  misc_feature (103)..(103): Xaa is any aa, unknown, or other
  misc_feature (104)..(104): Xaa is any aa, unknown, or other
  misc_feature (105)..(105): Xaa is any aa, unknown, or other
  misc_feature (106)..(106): Xaa is any aa, unknown, or other
  misc_feature (107)..(107): Xaa is any aa, unknown, or other
  misc_feature (108)..(108): Xaa is any aa, unknown, or other
  misc_feature (109)..(109): Xaa is any aa, unknown, or other
  misc_feature (110)..(110): Xaa is any aa, unknown, or other
  misc_feature (112)..(112): Xaa is any aa, unknown, or other
  misc_feature (114)..(114): Xaa is any aa, unknown, or other
  misc_feature (128)..(128): Xaa is any aa, unknown, or other
  misc_feature (133)..(133): Xaa is any aa, unknown, or other
  misc_feature (134)..(134): Xaa is any aa, unknown, or other
MGKVRSFFSRSRSGKRGSARRAGSSSPHSSAASAPPSPSPLPRRSPSSSSTTTRDETERVFRKFDANGDGQISRSELAALVRGRGPRRTDTGFFFWGGGGGEXXXXXXXXFXKXVEKNKGVFLVWEDXNLWGXXLRG

SEQ ID NO: 20479 - DNA, 828 bp, Zea mays
  misc_feature: Ceres CLONE 1388919-F
  misc_feature: Encodes the peptide sequence at SEQ ID NO. 20480
  misc_feature (614)..(614): n is a, c, t, g, unknown, or other
  misc_feature (696)..(696): n is a, c, t, g, unknown, or other
  misc_feature (795)..(795): n is a, c, t, g, unknown, or other
ggagctccccgcggtggcggccgctctagaactagtggatcccccgggctgcaggaattcgcacgagaccattacctagaacatcctaatcgaaaaagccgcgtggacgcacaccagcacctgccctcctcgccgtcgccgcctccctccgcgcgaccgatctaccctccgccgccaccatgtcgctgatcgccggggaggacttccagcatatcctgcgtttgctgaacaccaacgtggatgggaagcagaagatcatgttcgccatgacctcaatcaagggtgtcgggcgccgcttctccaacatcgtctgcaagaaggccgacatcgacatgaacaagagggccggcgagctgacgcctgatgagctggagcgcctgatgacggtcgtggccaaccctaggcagttcaaggtgccggactggttcctcaacaggaagaaggattacaaggacggcaggttctcgcaggtcgtctccaacgcccttgatatgaagctcagggacgaccttgagaggctcaagaagatcaggaaccaccgtggtctgcgtcactactgggggcctccgcgtccgtggccagcacaccaagactaactggtaggcgtggaaagnaccgttggtgtctccaagaagcgatgagctctatatcaccctgagaaatctgccgcactaaccgtgggttggttggtgtccnacagtccctgatgggaagggtttctgttttagagttccctggggaaatggtgttttgtctagaaacaatccctcgcggtattgaccttataatcgcggncccccggcggggggggtgggttttttgacactt

SEQ ID NO: 20480 - protein, 138 aa, Zea mays
  misc_feature: Ceres CLONE 1388919-F
  misc_feature (14)..(131): Pfam Name: Ribosomal_S13 Pfam Description: Ribosomal protein S13/S18
MSLIAGEDFQHILRLLNTNVDGKQKIMFAMTSIKGVGRRFSNIVCKKADIDMNKRAGELTPDELERLMTVVANPRQFKVPDWFLNRKKDYKDGRFSQVVSNALDMKLRDDLERLKKIRNHRGLRHYWGPPRPWPAHQD

SEQ ID NO: 20481 - DNA, 736 bp, Zea mays
  misc_feature: Ceres CLONE 1388921-F
  misc_feature: Translation starting site: 207
  misc_feature (337)..(337): n is a, c, t, g, unknown, or other
  misc_feature (338)..(338): n is a, c, t, g, unknown, or other
  misc_feature (447)..(447): n is a, c, t, g, unknown, or other
ggagctccccgcggtggcggccgctctagaactagtggatcccccgggctgcaggaattcgcacgagaccattacctagaacatcctaatcgaaaactcccctgagcctgactggaaccttcccgagagaggatacaaaggcacccggatcgaggaaaccaatccattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcgnngtcatcatggacgtgtgacccccggagcaggcgcgcctcgcggagggaggccgcgcgtgcgccgtgatggcgctggagcgggtccccgccacatccgcgcgcagggggncgtgccgcgcatgtcggacccggggctcatccgcgacatcagcgcgcgtcacatcccggtcatggccaaggccccatcgggcactttcgtggaggccagaatcctggagggccgtgggcgcccactacgtgaccgaaagggaggtggctgacccccgcggacgagggaaccactcaaaaggacaactccggggcccctttcgttggggggtgcgggaactcgggagggggctccccaaggggggggggagagggcccccatgatccaaaaaaaagggggggagggcgcg

SEQ ID NO: 20482 - DNA, 801 bp, Zea mays
  misc_feature: Ceres CLONE 1388927-F
  misc_feature: Translation starting site: 315
  misc_feature: Pfam Name: vATP-synt_E Pfam Description: ATP synthase (E/31 kDa) subunit
  misc_feature: SWISSPROT Homolog: EC 3.6.3.14 H(+)-transporting two-sector ATPase
  misc_feature (431)..(431): n is a, c, t, g, unknown, or other
  misc_feature (590)..(590): n is a, c, t, g, unknown, or other
  misc_feature (592)..(592): n is a, c, t, g, unknown, or other
  misc_feature (644)..(644): n is a, c, t, g, unknown, or other
  misc_feature (748)..(748): n is a, c, t, g, unknown, or other
tggagctccccgcggtggcggccgctctagaactagtggatcccccgggctgcaggaattcgcacgagaccattacctagaacatcctaatcgaaaagagggggaataaaatcccagcggcttcccccaaacaaaacctcttctccgccagagtccgcgtcggccagatcaaacgaatcggcacgacgcatcggcatcgcctccgacgatcttgagacaaacaaaacccaccgctgcggcaactccgcctcccgctgacacggggatcgcctgacaacaggcagagaaaagaggcgcagggtttgcccgcgaagatggaggacgtggacgtctcgcggcagctgaagcagatgacgaacttcatccgccaggaggccgtcgagaaggccgccgagatcgaggccgccgccgccgaggagttcaaatagaanagttgcagctggtggaagctgaaaagaagaagatcaggcaggaatatgaccggaaagagaagcaagttggcatcaagaagaaaattgattactcgatgcagctcaatgcttccagaattaaagtcctttcagctcaggatgatttggtaacagatatgntnggagtcagcaggaaaagagctactgtgcataagtagagatcaccccacttancagaagctcctcaagacacttatttggtcagagtttgctgcgcctgaaagaaccagctgtgcttctccgctgcagggagggaggatcctcactggttgatttanttttggaatctgcaaggatgagtatgcaaataaggcaaaagtatatcttcctg

SEQ ID NO: 20483 - DNA, 796 bp, Zea mays
  misc_feature: Ceres CLONE 1388929-F
  misc_feature (368)..(368): n is a, c, t, g, unknown, or other
  misc_feature (499)..(499): n is a, c, t, g, unknown, or other
  misc_feature (500)..(500): n is a, c, t, g, unknown, or other
  misc_feature (608)..(608): n is a, c, t, g, unknown, or other
  misc_feature (613)..(613): n is a, c, t, g, unknown, or other
aaagctggagctccccgcggtggcggccgctctagaactagtggatcccccgggctgcaggaattcgcacgagaccattacctagaacatcctaatcgaaaaagccgtggatcgagtgcggagggggagaagcgtctatcccatgtcccgcgacggcggagaatagggcgacagctgcggcggggatcggctgcggcgtctcgacgaggcgctggcgtcggcgcgtgtggctgctggcacatgtctgcgatagtctgtggcagaggtcctcctcatcttcacgacgagctcctgccggcatccctactcccctcactccctccacagccggagcccagaggtcccgccggtccccctcgcaccgcggnagctccgacggacaccgacgggaggcgctcgtccaccatctgcttttactcttccccgacatggatccacagttgctttgaaaagctctggaagcatctggagatgacttggatttctgcataaagagttnngatttgctacgcttagagtcagcagaggctatcttgtcatctactggtttcaaacctggaaatggtcagcatactggcatttcagcctcctgtttgagaatttcctantggtnggtggtgatacgactacaggacatcctcctactgtagataattaccagacaagtaaaaatgggtcctgaatgggttgagctatttggcagggagatgacaaatggcttctgaaataaatgatgcaccgggctcgggcggtcaagagttttggagggtttgggagaactcagttgtaaaggggg

SEQ ID NO: 20484 - DNA, 797 bp, Zea mays
  misc_feature: Ceres CLONE 1388930-F
  misc_feature: Encodes the peptide sequence at SEQ ID NO. 20485
tccccgcggtggcggccgctctagaactagtggatcccccgggctgcaggaattcgcacgagaccattacctagaacatcctaatcgaaaaatacatttcgactctcaactcccaaggtccctttttttttctcgatctggaagcgccgcagtagcagccatggacgtgagcggagcaggcggtaaggcgaagaagggcgcggcggggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgcccgtcctggagtacctcggcgggccgaggtgcctcgagctcggccgggcaacgcggcaaagggaacaaccaagaaagaagggggaattcattccccggggccaaggggctccctccccattccgaaaagaaaagggagctcgggaaagttgttgggcccggggcacccttcgccccaaggggggggtcccccccccaaaatccaaaaggggggtccccccccccaaaaaggggggccccaaaaaagggggcccccaaggggccccccaaaaaaagcccccttataccccccccccaaaaagaggggcaaaaaaggggtgcccccccccggttattttaaaaaaaaattttcccctcctccttcaacccccccgcccgggggggaaaaaaaaaaaaaaaagcgttgggtgttggtgggggggaaaaaccacaccccccggtgtg

SEQ ID NO: 20485 - protein, 212 aa, Zea mays
  misc_feature: Ceres CLONE 1388930-F
MDVSGAGGKAKKGAAGRKAGGPTKKSVSRSSRAGLQFPVSRVGRYLKKGRYAQRVGTGAPVYLAARPGVPRRAEVPRARPGNAAKGTTKKEGGIHSPGPRGSLPIPKRKGSSGKLLGPGHPSPQGGGPPPKIQKGGPPPQKGGPQKRGPPRGPPKKAPLYPPPKKRGKKGVPPPGYFKKKFSPPPSTPPPGGEKKKKKRWVLVGGKNHTPRC

SEQ ID NO: 20486 - DNA, 982 bp, Zea mays
  misc_feature: Ceres CLONE 1388932-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (858)..(858): n is a, c, t, g, unknown, or other
nnnccccccccccccccccnnnnnannannnnntacgagtccgatccgaccaacctgcgactccccgcggtggcggccgctctagaactagtggatcccccgggctgcaggaattcgcacgagaccattacctagaacatcctaatcgaaaaaacttttcctccttcagtttttatcacacgtcaatggagtggggctagcaatggcatggtaacttttccaatctttttgcattaaaaaagaaatcctaaagaaaaaggattactaaacgagcacgctcgccggcgctgggaccaggctctgggtctcgcatcacgatcagatccaatccaaggccgtgccccagcccggcggatggattccgccgccgtggccatcgtgacggtgccgttcccgggggagggccacctgaaccacctgctggaacctgtcccctgctcctggcaatcgcggggggcttccctgtccacttcgcccgcgccggaagccgcaccttccggggaaggccccggcgcgacgcctgcaacgggtctggagggccccgacccccccgtccggtggtggttttccccccgccgcttgtgacggtggcccccactgaaagaactccccccatcccccggcaaccccattccctcccccgcgtttcccgcggggggccccatggccccgccccccctggttccccaagggtccctttcgtgggaacgcgggggggtgggggggggcccttcggcgtaagcccgcgggctctccctgggacggggatcctgggcccggtggtccaaaaacccccccgggctccgaggagtccctcctacctaacccccatagggcgcggccctttcaccggcgggnacggagaggccccgccgttttaacccatacccccaagtcccccccccgcctagcatgggggatggccggcatcctacacacgccacgctgggccgcacccggggataatacgcttctgggatcg

SEQ ID NO: 20487 - DNA, 727 bp, Zea mays
  misc_feature: Ceres CLONE 1388933-F
  misc_feature: Encodes the peptide sequence at SEQ ID NO. 20488
  misc_feature (411)..(411): n is a, c, t, g, unknown, or other
tacccgcggtggcggccgctctagaactagtggatcccccgggctgcaggaattcgcacgagaccattacctagaacatcctaatcgaaaaacgcgcgcccaaaggcccccaaggccccaaccccaaccttgcaggaaaaaaaaagagacgaccccccaaatcggaatccgcacacccatcatccatggccgccgccctgctccgccgctcgccggcggcgcgcgcgctcctctcgccggcactctcgtcccgcctcgtcgcgtccaagccccactcctcgtcccccgcgcccgccgccaccctgcgagggcgactccaggacgaagaccttctcgatctacggtgggacccggactcggcgtcgacgagccggcacttcaagactaccaggtggacctgtccactgcggnccatggtgctggacccctgttcaaaatcagaacgaggaggacccgtggtaacctttccgccgaattggcgggagggcatttggggaaagtggccatgaaaaccaagggaaaaagggcccccctgggctccccaaaaaattccggggcccccccccggggccagggttcccccctttccccaaaatgtttcccccaaaggaaacactggggggggaaaaataagaaacttttttaaagggggggaaaaaaaaaagcctgccaccatgtgtttttcaggggcgggggaaacccccccccccccccgcagggggagaaa

SEQ ID NO: 20488 - protein, 107 aa, Zea mays
  misc_feature: Ceres CLONE 1388933-F
  misc_feature (76)..(76): Xaa is any aa, unknown, or other
MAAALLRRSPAARALLSPALSSRLVASKPHSSSPAPAATLRGRLQDEDLLDLRWDPDSASTSRHFKTTRWTCPLRXMVLDPCSKSERGGPVVTFPPNWREGIWGKWP

SEQ ID NO: 20489 - DNA, 909 bp, Zea mays
  misc_feature: Ceres CLONE 1388936-F
  misc_feature: Encodes the peptide sequence at SEQ ID NO. 20490
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (50)..(50): n is a, c, t, g, unknown, or other
nnnnnnnccccnnnnnnncccccccccnnnnnnnnccccccccccccgcncccccccccccggcgcgccgccgggcattggagctccccgcggtggcggccgctctagaactagtggatcccccgggctgcaggaattcgcacgagaccattacctagaacatcctaatcgaaaagaggcctcccgtcgcggtggtcgctttcggccctggaccccgctgccggaatcgaatctcctcccctcctttctcctccgacctcccccttccccccctccgcggctccgccccgacccgtgacgcctcgcttcgcacccctctcgcatctccgccgcatctccgccgcgatcctcccgactagccgcgactgcctcccctccagcggccaggcagaggatggagggggcaggcaaggatggcaacccgttgaggaattatcggattggcaagactctcggaattggctcattcgggaaggtgaaaattacggagcatatcagcactggacacaaggtggcaatcaagattctcaaccgccgtaaaatcagaggcatggagatggaagagaaagttaaaagagagattaagatattgaggttatttatgcatcccacatattatccgccctctatgagggttatagacacaccggctgatatttatggtgctatggagaatgttaagggtggggaattatttgattacattgctcgagaaaggtaggctgccaggaggaaaaggctcgccgttttcttccaacagaataatatcccggggttggaatattggccataaaaacatgggggggggcatccgtgaatcaacagccaggaaaaccctcctaatttggtttcaaaaaggcaatggttaagaattggcagatttttggctttaaagaatgggttatggcg

SEQ ID NO: 20490 - protein, 108 aa, Zea mays
  misc_feature: Ceres CLONE 1388936-F
  misc_feature: SWISSPROT Homolog: EC 2.7.11.1 Non-specific serine/threonine protein kinase
MEGAGKDGNPLRNYRIGKTLGIGSFGKVKITEHISTGHKVAIKILNRRKIRGMEMEEKVKREIKILRLFMHPTYYPPSMRVIDTPADIYGAMENVKGGELFDYIARER

SEQ ID NO: 20491 - DNA, 777 bp, Zea mays
  misc_feature: Ceres CLONE 1388937-F
  misc_feature: Encodes the peptide sequence at SEQ ID NO. 20492
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (685)..(685): n is a, c, t, g, unknown, or other
ccccgcggtggcggccgctctagaactagtggatcccccgggctgcaggaattcgcacgagaccattacctagaacatcctaatcgaaaaactcctcgtcgccaaaaccctagccctgcttctttgccatggcgagcagcgctagccaggcgagcctcctgctccagaagcagctcaaggatcttgcgaagaaccccgtggatgggttctccgccgggcttgtagacgacagcaacatcttcgagtggcaggtcaccatcatcggaccgcctgacaccctatatgatggaggctacttcaatgcaataatgaccttcccccagaactatcccaacagcccgccatcagtaagatttacttctgagatgtggcatccgaatgtttatcctgatggacgtgtttgcatttctattcttcatccacctggtgaagatcccaatggttatgagcttgcaagcgaacgatggacaccagtgcacacggttgaaagtatagttctgagcatcatttcgatgctctctagtccaaatgacgagtctccagcgaatatcgaagctgccaaggattggagagaaaagcgggatgagttcaagaaaaaggtaagggcatgtgtccgcaaatctcaggaaatgctctgaaggagaacatatgnnngagtgaacgagtgctgcacttcacaaccagntacctagccagcattcttttgcttttcccctgtatattttccatcagggcattcccgaagggggggtgggtgggctctttaaccaaactggg

SEQ ID NO: 20492 - protein, 169 aa, Zea mays
  misc_feature: Ceres CLONE 1388937-F
  misc_feature (11)..(162): Pfam Name: UQ_con Pfam Description: Ubiquitin-conjugating enzyme
  misc_feature: SWISSPROT Homolog: EC 6.3.2.19 Ubiquitin--protein ligase
MASSASQASLLLQKQLKDLAKNPVDGFSAGLVDDSNIFEWQVTIIGPPDTLYDGGYFNAIMTFPQNYPNSPPSVRFTSEMWHPNVYPDGRVCISILHPPGEDPNGYELASERWTPVHTVESIVLSIISMLSSPNDESPANIEAAKDWREKRDEFKKKVRACVRKSQEML

SEQ ID NO: 20493 - DNA, 879 bp, Zea mays
  misc_feature: Ceres CLONE 1388938-F
  misc_feature: Encodes the peptide sequence at SEQ ID NO. 20494
  misc_feature (20)..(20): n is a, c, t, g, unknown, or other
  misc_feature (42)..(42): n is a, c, t, g, unknown, or other
  misc_feature (43)..(43): n is a, c, t, g, unknown, or other
tataatttattttctatgtngtaacaccaacatgggtgtttnncaaagctggagctccaccgcggtggcggccgctctataactagtggatcccccgggctgcaggaattcgcacgagaccattacctagaacatcctaatcgaaaactctccagtctccagcctccatcagtccaggtcgatcgcgatcggaggccagaaatccatggccgctcccgccgccgcgccgctcgacgagggcaaggcgaagaaagtccttcgccaggtcgagttctacttcagcgacagcaacctcccccgcgataagttcctgcgggagacggtcgagcagagcgatgacggattggcgagcttgaccttgatatgctccttctcgcggatgaagccccaccttggggctggacgcagatgtcaagcccgagactgtgccggaggagaccgtgcttgcggccgctgaggtgcttccggccctcttcctgccctccgggtatcggaggctggcaagaagattggaaagagccaccgggacccttgcagcccgcaggaggacctccgacctcggtagcactcccaggactatttggttggtaatcctcccgcctgcccttggcactggaagcgggggcgaagcacgctccacaacctttttttcctacccgattatccgccaaagcgaacattagcgcccggctaacttccccagcgcaatcattgggccccaaaaagcaaacgcatctcctgggcgcgcactggtcctctgggattggggagtctttcttgttgacaccgccgtgtgggctattcccatcgtgtttagtggtgggaaacctgacttccacaaataatttctgctacgggtccacaacaatctcggcggaa

SEQ ID NO: 20494 - protein, 83 aa, Zea mays
  misc_feature: Ceres CLONE 1388938-F
  misc_feature (17)..(69): Pfam Name: La Pfam Description: La domain
MAAPAAAPLDEGKAKKVLRQVEFYFSDSNLPRDKFLRETVEQSDDGLASLTLICSFSRMKPHLGAGRRCQARDCAGGDRACGR

SEQ ID NO: 20495 - DNA, 772 bp, Zea mays
  misc_feature: Ceres CLONE 1388939-F
  misc_feature: Encodes the peptide sequence at SEQ ID NO. 20496
  misc_feature (421)..(421): n is a, c, t, g, unknown, or other
  misc_feature (428)..(428): n is a, c, t, g, unknown, or other
  misc_feature (485)..(485): n is a, c, t, g, unknown, or other
  misc_feature (486)..(486): n is a, c, t, g, unknown, or other
  misc_feature (531)..(531): n is a, c, t, g, unknown, or other
  misc_feature (540)..(540): n is a, c, t, g, unknown, or other
  misc_feature (551)..(551): n is a, c, t, g, unknown, or other
  misc_feature (552)..(552): n is a, c, t, g, unknown, or other
  misc_feature (571)..(571): n is a, c, t, g, unknown, or other
  misc_feature (649)..(649): n is a, c, t, g, unknown, or other
tggagctccccgcggtggcggccgctctagaactagtggatcccccgggctgcaggaattcgcacgagaccattacctagaacatcctaatcgaaaaaattcgccttcacctcgccgcttcctccttgaccgccaccgttgacgtcgtcttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccatggcgatccgcatcaccgtctcctactccggctacgtggcgcagaacctcgccgcgtcgctcgggcaccgcttctcctccgactccgnctcgggnagccgcctcctccatgacggcgcctggcgccccttctgcatcttcaccctccaccgnncagccgagcagcatcgcggcagcggcagcgaccgccatgacggangcgactacnaccacccgaanngcccaggcatcgccgccgnagctcactcgttgctgctcacgcgtgcgtgcttatcgtccaagtcgcccgccgcgtctcttggcgtgaggctgctctncgtgcttgcgcagaggacgggaccgacgcctggaaccaccggatcggcggcttctctctcaggctcgtcgccgattttccctcggtttcagcccacctccttactcccgttcctgcagacagg

SEQ ID NO: 20496 - protein, 146 aa, Zea mays
  misc_feature: Ceres CLONE 1388939-F
  misc_feature (30)..(30): Xaa is any aa, unknown, or other
  misc_feature (52)..(52): Xaa is any aa, unknown, or other
  misc_feature (67)..(67): Xaa is any aa, unknown, or other
  misc_feature (70)..(70): Xaa is any aa, unknown, or other
  misc_feature (73)..(73): Xaa is any aa, unknown, or other
  misc_feature (74)..(74): Xaa is any aa, unknown, or other
  misc_feature (80)..(80): Xaa is any aa, unknown, or other
  misc_feature (106)..(106): Xaa is any aa, unknown, or other
MAIRITVSYSGYVAQNLAASLGHRFSSDSXSGSRLLHDGAWRPFCIFTLHRXAEQHRGSGSDRHDGXDYXHPXXPGIAAXAHSLLLTRACLSSKSPAASLGVRLLXVLAQRTGPTPGTTGSAASLSGSSPIFPRFQPTSLLPFLQT

SEQ ID NO: 20497 - DNA, 733 bp, Zea mays
  misc_feature: Ceres CLONE 1388940-F
  misc_feature: Encodes the peptide sequence at SEQ ID NO. 20498
ggagctcaccgcggtggcggccgctctagaactagtggatcccccgggctgcaggaattcgcacgagaccattacctagaacatcctaatcgaaaagtctccaacccgactctgaaatccacgagctcttccccctcgtccacaccccgcccctccctgctctccgcctccccgtccccgcccccatcgctacccacaagcaccttcggaggctccaggcaacccacctcctgcacccggcgtccctcgcggcggcgacgcgcgaacgtcccgctccccggtgagtaacggagagacggagccatgagcggaggggtggagccggataccccgcccggtagcagcagcagcagcagcaggagcgggggtagcacgcccgtgggcggaaagccgccacgccaccacctcacgtccatccgccactgcgccagcagtgcccgcatcgccgctgcctccgccgaattcgtaagcaaggtcgctgccacccaggccctctatccctaacacgaatttgatggctggcccttctgacctcctgaaggtgctgggagacggggaagctcagtttggattcacctaccgaagaactccggccgcggcttcctgcctggtggtcaggtccgggaagtttcttcgattaaggaaccaaaatccttcagggaagaccaagatgcctgtggtgaacaacccccgcgcagcaccctagaaacccagtggcccggtgaatcccctg

SEQ ID NO: 20498 - protein, 66 aa, Zea mays
  misc_feature: Ceres CLONE 1388940-F
MSGGVEPDTPPGSSSSSSRSGGSTPVGGKPPRHHLTSIRHCASSARIAAASAEFVSKVAATQALYP

SEQ ID NO: 20499 - DNA, 743 bp, Zea mays
  misc_feature: Ceres CLONE 1388943-F
  misc_feature: Translation starting site: 255
  misc_feature: SWISSPROT Homolog: EC 3.5.4.12 dCMP deaminase
tggagctccccgcggtggcggccgctctagaactagtggatcccccgggctgcaggaattcgcacgagaccattacctagaacatcctaatcgaaaagccccagattttcccgcgttcgtggtctccactctccagttctccgttccccaaccccaacctagcatccttgcatcccggggctcagttagcgttgccgccgcaccgtactacacctccggcggccggtgcgcccatttcccgccgatcaagcgcgatggcctcgacgagggatctagccatagcttctctctcagctgcgaccggcgccgttgttgccgccgctgcactgcgcctcttgtcttcccgcagaacatcctccgtcagaccccagaacctccccgccgccgctaacggatctgcctccgagcgcccgctggctcagtcccccttcgatcctgtcaagagggaaggatatatttcctgggacgactacttcatggcgatcgccttctttttcggctgaacgatttaaggatcctaaccgggaggttggaacatgtttggttacccaagagggaataaccctaggaattgggataaaatggctttccaaaaaggtggttccgattaacaagtttccttgggcaaaaaaaacctggaaggggtgaacccctttaagaaacaaattttcgccaaacttgggccaggtttaaggttaataggaaattttaaaataccaaaccctggttttcaggggttggga

SEQ ID NO: 20500 - DNA, 669 bp, Zea mays
  misc_feature: Ceres CLONE 1388944-F
  misc_feature (258)..(258): n is a, c, t, g, unknown, or other
  misc_feature (471)..(471): n is a, c, t, g, unknown, or other
  misc_feature (546)..(546): n is a, c, t, g, unknown, or other
  misc_feature (584)..(584): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
gctggagctccccgcggtggcggccgctctagaactagtggatcccccgggctgcaggaattcgcacgagaccattacctagaacatcctaatcgaaaagaagcctcaccagagaccacaaggagggatattcgcaggacccggtttttgcagcacgaggagcggaggctgctctgccataccaaaaagcagacagaggaccaaggaaggaagcagggatccggctttgctctgcaaccatgagctccctgtacgacngtctcctgacttcgcggctggtcctggctgggaaacgtcttcgccctcgccctcttcctgtcgccggtggcaaagttcaagaaggggcctcaagggccaggccgaaggaacaaatttaaaggggttgccccaaacgggggtgccccctggcaaaagagggggggaaaccgcgccccgggggggaaggggccccccccccggggggggtggccnccccccccccgggcaaggagagtagagggtgtcttttctgccccccacccaacatataatatatttgtaagcggngaaattttggggcggggggggcgggcccaccaccaaanaagagtgtttccggatttttttttttcctctaannnccacccaccacaccacaacgcgggagcacagcccccgcccccgcgccgg

SEQ ID NO: 20501 - DNA, 736 bp, Zea mays
  misc_feature: Ceres CLONE 1388946-F
  misc_feature (351)..(351): n is a, c, t, g, unknown, or other
  misc_feature (360)..(360): n is a, c, t, g, unknown, or other
  misc_feature (391)..(391): n is a, c, t, g, unknown, or other
aagctggagctccccgcggtggcggccgctctagaactagtggatcccccgggctgcaggaattcgcacgagaccattacctagaacatcctaatcgaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtcctggccttcgtgggatcttgaaaatgtgatggtctaatggagtcccagggtggncaagataantctagcagtagtcggtcctccctgatgtacnaagctcccttggctaccgcatcaaggagttccggccctgcaggcgccatcaagaagttcctcgctggttacttgaaactgccgagggagccatcttgattttttgggggaatcccattccagaaggggaaaaccccccggtttttcttttggtcccccaaaacccccgggatattgttttcgggggcaaaagaataaaaaaacctttccccttttcccccggggtttttggtttttgggtttgaaaaaaggggggccccgaaagttttgtgtggggcccccccccttttttttgaggtgggccgggggttaaaaaaccccttgaaaatcttttttggggggccgg

SEQ ID NO: 20502 - DNA, 737 bp, Zea mays
  misc_feature: Ceres CLONE 1388950-F
  misc_feature: Encodes the peptide sequence at SEQ ID NO. 20503
  misc_feature (440)..(440): n is a, c, t, g, unknown, or other
  misc_feature (460)..(460): n is a, c, t, g, unknown, or other
  misc_feature (600)..(600): n is a, c, t, g, unknown, or other
  misc_feature (635)..(635): n is a, c, t, g, unknown, or other
tggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttgnagaaggtgtgactgacgtanctccgggcgaccatgtccttccctgtgtcactggggagtgcaaggagtgtgcccactgcaagtcggcagagagcaacatgtgtgatctgctcaggatcaacaccgaccgcggtgtgatgattgccgatggcaagtcgcgnttttcaaatcatgggaaagctatctaccactttgntgggacttccacttcagcgagtacaccgtcatgcatggtgggtttgtgtgcaaagatcaaccctccagctcccttgataaagtttgcgtcttagctgtggat

SEQ ID NO: 20503 - protein, 174 aa, Zea mays
  misc_feature: Ceres CLONE 1388950-F
  misc_feature (34)..(163): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (79)..(79): Xaa is any aa, unknown, or other
  misc_feature (86)..(86): Xaa is any aa, unknown, or other
  misc_feature (144)..(144): Xaa is any aa, unknown, or other
MATAGKVIKCKAAVAWEAGKPLSIEEVEVAPPQAMEVRVKILFTSLCHTDVYFWEAKGQTPVFPRIFGHEAGGIIESVXEGVTDVXPGDHVLPCVTGECKECAHCKSAESNMCDLLRINTDRGVMIADGKSRFSNHGKAIYHFXGTSTSASTPSCMVGLCAKINPPAPLIKFAS

SEQ ID NO: 20504 - DNA, 748 bp, Zea mays
  misc_feature: Ceres CLONE 1388951-F
  misc_feature: Encodes the peptide sequence at SEQ ID NO. 20505
  misc_feature (501)..(501): n is a, c, t, g, unknown, or other
ctggagctccccgcggtggcggccgctctagaactagtggatcccccgggctgcaggaattcgcacgagaccattacctagaacatcctaatcgaaaaagttctactccccgctccccattcacgcactctcactctacctccctccctccctcgccggcgccgcgcgtgctcccgcgggatgctgcgtgcggcgcggtacctgctggggtcgccgggcgcgagcgggttcgggtccaggtcgacggcggaggaggtgaccccggacctgggcgcgacgacggccatcatcacgggcgccacgtccgggatcggcgccgagacggcgcgcgtgctggctaagcgcgtcgcgcgcgtgatgatcccggcgcggagggccaaggcgacgaaggacgtgcgcgcgcgcatcgtggccgagtgccccggcgccgccgtcttcgtgatcccgttcgacctcagatcgctcggggtccgtgcgggccttcgccgacagggttctagngctcgggctcccgttccacctcgtcatgtaaggacgttcggcgattcggggcgcgccaccggcggccctcgtccaagtccacagtacatgtatgaatgcctatgggtgggaaggcctgggcccgcccgcggggaagaaccaacgccggcaagttctcccaccgggcaggttggcgctctcagaaggacggggggggaaattaaccttccgcacacaatttaccgggggccccttccctgctgaaaaa

SEQ ID NO: 20505 - protein, 187 aa, Zea mays
  misc_feature: Ceres CLONE 1388951-F
  misc_feature (107)..(107): Xaa is any aa, unknown, or other
MLRAARYLLGSPGASGFGSRSTAEEVTPDLGATTAIITGATSGIGAETARVLAKRVARVMIPARRAKATKDVRARIVAECPGAAVFVIPFDLRSLGVRAGLRRQGSXARAPVPPRHVRTFGDSGRATGGPRPSPQYMYECLWVGRPGPARGEEPTPASSPTGQVGALRRTGGEINLPHTIYRGPLPC

SEQ ID NO: 20506 - DNA, 727 bp, Zea mays
  misc_feature: Ceres CLONE 1388952-F
  misc_feature: Encodes the peptide sequence at SEQ ID NO. 20507
  misc_feature (399)..(399): n is a, c, t, g, unknown, or other
  misc_feature (486)..(486): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtgtcagtacggaaaggacaccccgcggtagagggaatgcnagagcgagtgccgcgagcgacaccagcaagctgaccgcgtacgaagacggcgacagcggcgtggacgcctacgtctccccctcccgnaggggcgtagtgcgggtcccatgcctgcgccgccacaggggcaagcgtgggagacccatgagtgaatgaaggggtgccgccccccggaactgggcctccaatggaacaaaaattcggtcccggaaaccaaaacccgggaatggcccggaaaaggtgcaagccccccaccgcggggaattggtggaaaagcaacccttgcctaggaccaaaaaaaacccccgaggggggggggaacctggcg

SEQ ID NO: 20507 - protein, 59 aa, Zea mays
  misc_feature: Ceres CLONE 1388952-F
MGKGSVGASWWAFLLLAGVLLVVAATAGAEDGVVERDRKEDLRWCKQACECQYGKDTPR

SEQ ID NO: 20508 - DNA, 738 bp, Zea mays
  misc_feature: Ceres CLONE 1388959-F
  misc_feature: Translation starting site: 495
aaagctggagctccccgcggtggcggccgctctagaactagtggatcccccgggctgcaggaattcgcacgagaccattacctagaacatcctaatcgaaaaacctagaacatcctaatcaaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggactcagcctcatccccagccacacccatgcccgtgccaacagccgcatccaagcccgtgccagctgcacggaacctgcagcgttggcagcaccccgatcctgggccagtgcgtcgagtatctagagcatcagtgcagcccgacggcgacgccctactgctcgcctcagtgtcagtcgttgctggctgcagtgttgccagcagctcaggcaggtggagccgcagcacgggtaccaggcgatccttcggcgttggcctacagtgcatcctgc

SEQ ID NO: 20509 - DNA, 730 bp, Zea mays
  misc_feature: Ceres CLONE 1388963-F
  misc_feature: Encodes the peptide sequence at SEQ ID NO. 20510
  misc_feature (426)..(426): n is a, c, t, g, unknown, or other
  misc_feature (469)..(469): n is a, c, t, g, unknown, or other
  misc_feature (589)..(589): n is a, c, t, g, unknown, or other
aagctggagctccccgcggtggcggccgctctagaactagtggatcccccgggctgcaggaattcgcacgagaccattacctagaacatcctaatcgaaaaatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtacatctcctcctcccccaccccgccctacgaactgacgtccttccgggtcagccccatcaaggagtccatcgtgtcccgcgagatgacccgntgctacatgacggacatgatcacccacgccgacaccgacgtgntgatcgtgggcgcccgggtcgcggggctgtcctgggggtacgagctgtccaagaaccccaccgggagggggccattccggaagaaaatccgggcccccgggggggggtcccgggtttggntggaaatttgttcccaccccaggggggggggccaaggggggacacctttatcctgaaaaatttggggggggtataaccagggccgagggacatggggggggtaaaaccgggtgggttttccacccccccggggggtgcccg

SEQ ID NO: 20510 - protein, 148 aa, Zea mays
  misc_feature: Ceres CLONE 1388963-F
  misc_feature (91)..(91): Xaa is any aa, unknown, or other
  misc_feature (131)..(131): Xaa is any aa, unknown, or other
MATTAASSLLKSSFAGSRLPSATRTTTPSSVAVATPRAGGGPIRAYISSSPTPPYELTSFRVSPIKESIVSREMTRCYMTDMITHADTDVXIVGARVAGLSWGYELSKNPTGRGPFRKKIRAPGGGSRVWXEICSHPRGGGQGGTPLS

SEQ ID NO: 20511 - DNA, 677 bp, Zea mays
  misc_feature: Ceres CLONE 1388965-F
  misc_feature: Encodes the peptide sequence at SEQ ID NO. 20512
  misc_feature (661)..(661): n is a, c, t, g, unknown, or other
tggagctccccgcggtggcggccgctctagaactagtggatcccccgggctgcaggaattcgcacgagaccattacctagaacatcctaatcacaatattatcgctgccctcccctttcgtcatccatgacttccctccccgccgcggtcatggccaccgcgacgacgctgcccctaggcctcctcccctccaaaacgctgaccctctcccctctcccttctgcgcgccgatccctctccatcgccgccgtggagccccggcgctggctcctccgagccgccgctgaggaggcgcctgaggccgtggaggttgagttcgtggagcccgacgcggaggcggaggaggagcccgcggtaccggagcccgtagaggcgcagctcgccgccgcgggggctgggaaggacgccgacatcttcgctgttgtcatggatgggtcaagacaataaatggggatggcgggccaggtttttttccccccccgaaaactggaagggggcccagggccatgggccccaactcttttataaaaagggggggccaggggggggcccccaaagaaaaaaaaaatttttcttttgggtggggcccggggggggggaaaaaaacagtggtgtttttctccaaggggggggggagaaaaacaaaaccccgcggcggggnaaagaaaaattttttt

SEQ ID NO: 20512 - protein, 98 aa, Zea mays
  misc_feature: Ceres CLONE 1388965-F
MATATTLPLGLLPSKTLTLSPLPSARRSLSIAAVEPRRWLLRAAAEEAPEAVEVEFVEPDAEAEEEPAVPEPVEAQLAAAGAGKDADIFAVVMDGSRQ

SEQ ID NO: 20513 - DNA, 681 bp, Zea mays
  misc_feature: Ceres CLONE 1388969-F
ggagctccccgcggtggcggccgctctagaactagtggatcccccgggctgcaggaattcgcacgagaccattacctagaacatcctaatcaaaaacctctcctcactcataccgagcgccagttgccagcacgaagagtaggagtagggatcgaagagtgagtgaaactgaaaacgagtaggagtcatgacgaccccgaatgaccgcggcagctgattgctgtacctgtcactagccgccatatgcgccggctaccacgcttaccgcctcgcgttctacctgatcgtctgcgccgtgtcttcggcttgacctggctctgcactgctgcttcccgagagccctccgtgacgacgtcgtggatgacgagaggctcggtgcaagtgacatatctacccgccttcgaccgcgtcctgccggggcgagccggctgtccgtgtctccacatgtgatcatgctgccctggcactcccagttcgcgtggcgggggagacctcgcctccggggctgattgcctcctcctcggagcatgaccttgtcgggggctctcccccggattgcgggttaaacctatgacccggctttcacgacgggtccttcaagaagtcgcgaaaggccccgatcccaccagcatgggtttgggcctacagtggtaatggggggcccttccccttgtgggttcc

SEQ ID NO: 20514 - DNA, 751 bp, Zea mays
  misc_feature: Ceres CLONE 1388971-F
  misc_feature: Encodes the peptide sequence at SEQ ID NO. 20515
  misc_feature (658)..(658): n is a, c, t, g, unknown, or other
tccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctggcagccaccgccgccggttcatctaccgccgccggtgcatctgccacctccggttcacctgccacctccggtgcatctcccaccgtcggtccacctgccgccgccggtccacctgccaccgccggtccatgtgccgccgccgtttcatcttgccgccgccaccatgccccctaccctactcagccggcccgggctcagcctcattcccagccaaacccttgcccgttgcaaaagccgaattccaagcccggtgccagctggaagggaacctgcggggttggcaccacccccaaccctggcccagtgggtccagtttctgaaggaataagtggcaacccgagggtgaaccccccactggtcgccttgagtgccagtccttttccggaatcagtgtttggccggcagctctagggngggtggaaccccgaaaaaccgggtaaccggggggaatctctttgtttggggccccccgaaccatcccgggcaagggggcacccccaaaaaggg

SEQ ID NO: 20515 - protein, 54 aa, Zea mays
  misc_feature: Ceres CLONE 1388971-F
MPPTLLSRPGLSLIPSQTLARCKSRIPSPVPAGREPAGLAPPPTLAQWVQFLKE

SEQ ID NO: 20516 - DNA, 704 bp, Zea mays
  misc_feature: Ceres CLONE 1388972-F
  misc_feature: Encodes the peptide sequence at SEQ ID NO. 20517
  misc_feature (253)..(253): n is a, c, t, g, unknown, or other
  misc_feature (344)..(344): n is a, c, t, g, unknown, or other
ggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggtctgcgacgggaggtggcgggggctacggcgacctccagcgcgngggcggcatgcacggcgaggcgcagcaccagcagaagcagggcgtcatgatgacggcgctcaaggtggcgacggccgcgaccttcggcggntcgatgctgatgctgtccgggctgatcctggccggcaccgtgatcgcgctcacgatggccacccccgtgctgttgatcttcagcccggtgctggtggcggccgccatcgcgctggcgctcatggcgtccgggatcgtcacctccggcggtctcggcgtcactgcgctgtccggggtctcctggatggcaaggacctgaggggaaagcccccgccggtcgccgacagctgtaccacgccaagtcgtgctggcgaccaaggcccccacatcaaggatgaggagacaaccccttcgaccagctgcagggttcttgaaagagaacccacctcgagggacccgcgcgcgggcttccttgaacccg

SEQ ID NO: 20517 - protein, 116 aa, Zea mays
  misc_feature: Ceres CLONE 1388972-F
  misc_feature (36)..(116): Pfam Name: Oleosin Pfam Description: Oleosin
  misc_feature (21)..(21): Xaa is any aa, unknown, or other
MADHHRSATGGGGGYGDLQRXGGMHGEAQHQQKQGVMMTALKVATAATFGGSMLMLSGLILAGTVIALTMATPVLLIFSPVLVAAAIALALMASGIVTSGGLGVTALSGVSWMART

SEQ ID NO: 20518 - DNA, 667 bp, Zea mays
  misc_feature: Ceres CLONE 1388977-F
  misc_feature: Translation starting site: 183
  misc_feature: SWISSPROT Homolog: EC 5.2.1.8 Peptidylprolyl isomerase
tggagctccccgcggtggcggccgctctagaactagtggatcccccgggctgcaggaattcgcacgagaccattacctagaacatcctaatcgaaaaaagacagaagactgcagcaaaaccatcagatctagcagaactctctcgacctcatcggcgttggcggagcgcgtgttgaccggagatggcgccgagcggctggaggaggagcgcggcggcgcgggtcgcctggcgcccggccacggtttgcctgtggctcgcgctcgccgccgccgcactgacgctcgcccaggctaagaaggacctgacggaggttacccacaaggtctacttcgacatcgagatcgacggcaagcccgcaggccggattgtcatggccgctttctgggaagactggtcctaagacggcagatgacttccgagctctttgcacagaagagaaagggggttggcaagagtgtcaaagccctccactaccaagggaagtaagtttccaagaatcatcccccggtttcctgtttccaaggggggggactttccctccccccggaaacggaagggggggggggggaacccttttctcccccttttaaaattttgggggggggggaaatctttcaaaaaaaaaccccccccccggggggtccaagaggcttttttggggagggg

SEQ ID NO: 20519 - DNA, 735 bp, Zea mays
  misc_feature: Ceres CLONE 1388980-F
aagctggagctccccgcggtggcggccgctctagaactagtggatcccccgggctgcaggaattcgcacgagaccattacctagaacatcctaatcgaaaaaacaagccagtctctcgcctgatcgcactgactatctctatctgccatcgagagagagtgggcttctcttcccaagaaaacccttctgctctttactttctccccctcggcatctggctctcgacagcctctgcttactcatccaccagcctctcgatggcgtggatggagtatccagacaactagcttcgtgtagatgcaataggattagagcaagctcgccttatgattgttcgagacgacgttacgatgcgtatgagtggccattcagatatccacagcttctcgctgctagaactatggacagcccgactatctttctcgtaaacattgatgagatacttcgtcttgctctgtcgccagattcactgccctgtatttcttgacgtaatctggaaggcagacgataaggatcggtggagattcactacgaacgagtatgtgccaatctcttgtttgtcgaattcacgcttaggttcctaacgctcgttacactctttctcgctggcagggtatcgcttgcctcatcttctagcactacgaagtgacgtggagctatacagagaccgggtcttagtggatctatgacactagacgttggaagacggttaaagcagatcccgtacggaggcaa

SEQ ID NO: 20520 - DNA, 698 bp, Zea mays
  misc_feature: Ceres CLONE 1388981-F
  misc_feature: Translation starting site: 182
tggagctccccgcggtggcggccgctctagaactagtggatcccccgggctgcaggaattcgcacgagaccattacctagaacatcctaatcgaaaaatccatcgtgaatgcaagcttgtccattcgtctaggtctgaatactggatctactaacgcgagagccactgagccgcaactgctatgctcgccattactgcaagctgtgttccgtctaagctcaattatgcttgcgctacatctgatccagctaagtggctagccatcattacacaactgcgtgaccaagactcaggagagatataccagggggagtacctagctgatctcgtgcgacaaatcgtggtcggaattgatccaaacatggagacgccgctgctgctgctccacctcatcatgtacatcatcgctatctgcttccaaggctggaacctgaaccactgtctcaaccgtgagaccaactaccccattcacgtccggcaacggagcgacgttctacttactggagttctccgtcctgaccgttgggctggtcgctgagctccttctggcggacgtgcaccacctgcgcccctgggttcgcgacggactggccaccaaagacgccgcctggctcatggcctgggcaataacgaattcgcattactgctggactgcaacgagatcctcctcgaccccaaaccgcagatggcgcctgaac

SEQ ID NO: 20521 - DNA, 633 bp, Zea mays
  misc_feature: Ceres CLONE 1388999-F
  misc_feature: Encodes the peptide sequence at SEQ ID NO. 20522
tggagctccccgcggtggcggccgctctagaactagtggatcccccgggctgcaggaattcgcacgagaccattacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgcccgcaggcagcgacctggacccgcctctgcttgcaggctgcgccaagatcgtcccaggcatacgacaacgcgccggaagaccggagagaaataggggacaagtacaaggacgcggcggaggaggcgaaggacgccaccggtgacgccaaggagcacgccaagaggatggccggggagacgaagagcagggcgcaggacaaggtcggccgcgtggtggaccaggcgtcgtgcatgaccgagcgtgccaaggaccattagaagggcgtggcggaggacgcctcgtatacggcgtcccgggcga

SEQ ID NO: 20522 - protein, 128 aa, Zea mays
  misc_feature: Ceres CLONE 1388999-F
MSRLMAAMLLGGARVAGAAKLTGNGNAAGMQALPMPACFLPPRPQAATWTRLCLQAAPRSSQAYDNAPEDRREIGDKYKDAAEEAKDATGDAKEHAKRMAGETKSRAQDKVGRVVDQASCMTERAKDH

SEQ ID NO: 20523 - DNA, 633 bp, Zea mays
  misc_feature: Ceres CLONE 1389001-F
  misc_feature: Encodes the peptide sequence at SEQ ID NO. 20524
  misc_feature (427)..(427): n is a, c, t, g, unknown, or other
  misc_feature (548)..(548): n is a, c, t, g, unknown, or other
  misc_feature (550)..(550): n is a, c, t, g, unknown, or other
  misc_feature (592)..(592): n is a, c, t, g, unknown, or other
tggagctccccgcggtggcggccgctctataactagtggatcccccgggctgcaggaattcgcacgagaccattacctagaacatcctaatcgaaaaaagatccaccaccccaccaaccaactactctcacagtctcacctcccgctcctgccccctccctctcgttctcttcctaaatggcggccgagtccgccaggccgccctcgccgccgcgcgactccggctgccccgcgggcgcgggagactccaccagctcccagctgaccgcgacctacctcggcgtcagcttcgcgctcttcctcgccacgctcccgtcgggaaccgcggggcgccacgtggactcgatccagtcgcggggacgcgtcctcgactcgcgcctgctgggcgccgaggaccctgtgcggtaactgcatgcgggccgtcgtnaggattccctttccgaagccggaccctgaaaattttttttcggggccaacaccaactaccccggggggggccaagaacggccgggaaggtccaaatccccgggggttggcaatctgggccnantaggcggggccggtggccccaaatggcggggggggaccccangccggggcaggggccccacaaaacctaggccaccccccccg

SEQ ID NO: 20524 - protein, 76 aa, Zea mays
  misc_feature: Ceres CLONE 1389001-F
MAAESARPPSPPRDSGCPAGAGDSTSSQLTATYLGVSFALFLATLPSGTAGRHVDSIQSRGRVLDSRLLGAEDPVR

SEQ ID NO: 20525 - DNA, 634 bp, Zea mays
  misc_feature: Ceres CLONE 1389012-F
  misc_feature: Encodes the peptide sequence at SEQ ID NO. 20526
  misc_feature (387)..(387): n is a, c, t, g, unknown, or other
  misc_feature (393)..(393): n is a, c, t, g, unknown, or other
  misc_feature (554)..(554): n is a, c, t, g, unknown, or other
  misc_feature (561)..(561): n is a, c, t, g, unknown, or other
  misc_feature (583)..(583): n is a, c, t, g, unknown, or other
  misc_feature (586)..(586): n is a, c, t, g, unknown, or other
  misc_feature (614)..(614): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
aaagctggagctccccgcggtggcggccgctctagaactagtggatcccccgggctgcaggaattcgcacgagaccattacctagaacatcctaatcgaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcgggcggcctggagtactcgncggctngaggtcttggagctcgccggcaacgctgccaagggacacaagaagacgcgcatcgtccccgcgcacgtggctggctggcgatccgcaaacgacgaagggagctcgggaagctggctggaccggcgtgaccatcgccccacgggggcggcgtgttgcccaancatcaancccggtcctggtgccccagaanacncggggggggagaagggcgttccagcggncgnnnaaggcaaggaagggc

SEQ ID NO: 20526 - protein, 116 aa, Zea mays
  misc_feature: Ceres CLONE 1389012-F
  misc_feature (73)..(73): Xaa is any aa, unknown, or other
  misc_feature (75)..(75): Xaa is any aa, unknown, or other
MDATGTGAGGKAKKGAAGRKAGGPRKKSVTRSVKAGLQFPVGRIGRYLKKGRYAQRVGSGAPVYLAGGLEYSXAXGLGARRQRCQGTQEDAHRPRARGWLAIRKRRRELGKLAGPA

SEQ ID NO: 20527 - DNA, 609 bp, Zea mays
  misc_feature: Ceres CLONE 1389026-F
  misc_feature: Translation starting site: 178
  misc_feature (487)..(487): n is a, c, t, g, unknown, or other
  misc_feature (508)..(508): n is a, c, t, g, unknown, or other
  misc_feature (518)..(518): n is a, c, t, g, unknown, or other
tccccgcggtggcggccgctctagaactagtggatcccccgggctgcaggaattcgcacgagaccattacctagaacatcctaatcgaaaaatcacaattcactccactcatcttttctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctctccgtcgcttcagtcatggcaggaatggcacctgagggttctcagttcgatgctaagcactatgattctaagatgcaggagctgctgagcaccggtgagnactgaggagttcttcacttantatgatgagntttttgagagttttgatgatatgggcctccaagagaatcttctgagaggcatttatgcttataattttgagaagccatctgcaatcagcag

SEQ ID NO: 20528 - DNA, 712 bp, Zea mays
  misc_feature: Ceres CLONE 1389029-F
  misc_feature: Encodes the peptide sequence at SEQ ID NO. 20529
  misc_feature (1)..(1): n is a, c, t, g, unknown, or other
  misc_feature (9)..(9): n is a, c, t, g, unknown, or other
  misc_feature (30)..(30): n is a, c, t, g, unknown, or other
  misc_feature (44)..(44): n is a, c, t, g, unknown, or other
ntttggggnccccccccccccccgcaccanaaaaaaaaaaaaangttgggcgttcttccaactggagctccccgcggtggcggccgctctagaactagtggatcccccgggctgcaggaattcgcacgagaccattacctagaacatcctaatcgaaaaataaagattactcatagattaaagtagggtttggacgtctgcctgtccatttcggcgtctgttcttagcggccgacaagcggaatctggatcaagtcccctgcttcaacccatcccctctcatcgattcattgccacaaggcagctgattgctcacagcgttggatgtgagaattggattcggacccaccgatcgatatgccgttcggccacacgcggctcgatgtccggcgtccgccgcagtcgtcctacctctgctgctccacaaccaccgtcgccgtattcgtcgcgctctgcctggtggctgtgtggcatggcgtcgtccatgctcgtcaccccctgccgagttccctccatttcagtccaaagtgcgtccactgaggcctcatgactctcctcctgccaccgggaacttaaccagcggctggatcagggcgatgggcatcacccccccaggatgatccaccacctggctaccacaacaatggcctcccgggaaagaacgcgcaggggaaggggggaaattcggctaccaaggacctttttccctaagg

SEQ ID NO: 20529 - protein, 60 aa, Zea mays
  misc_feature: Ceres CLONE 1389029-F
MPFGHTRLDVRRPPQSSYLCCSTTTVAVFVALCLVAVWHGVVHARHPLPSSLHFSPKCVH

SEQ ID NO: 20530 - DNA, 662 bp, Zea mays
  misc_feature: Ceres CLONE 1389031-F
  misc_feature: Encodes the peptide sequence at SEQ ID NO. 20531
  misc_feature (443)..(443): n is a, c, t, g, unknown, or other
  misc_feature (516)..(516): n is a, c, t, g, unknown, or other
  misc_feature (517)..(517): n is a, c, t, g, unknown, or other
tccccgcggtggcggccgctctagaactagtggatcccccgggctgcaggaattcgcacgagaccattacctagaacatcctaatcgaaaaaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtagtccgctcctacatcgccctcggctcctaccagctggtgatcagcgagatcgactcgtcagccgctacctcgctgcaggccgtgaagctgctcgcgctgtacctcactggagacnaggaaggtgctatctccagtctcaaggaatgggttgagtgattcagcaattggaagcaatcctggtctggggnntgattgctgaatctctctccccaaactacccctcggcagcggcccggggatgtggccaacggaaccccgatagccctggccagggcgccgccggctccggcgaaaaaaactgggcgggaaggaagcccggggccacctgctccgt

SEQ ID NO: 20531 - protein, 94 aa, Zea mays
  misc_feature: Ceres CLONE 1389031-F
  misc_feature (82)..(82): Xaa is any aa, unknown, or other
MASPDLLFNLRNLFYLGAYQAAINNSDVPGLDADAAAERDAIVVRSYIALGSYQLVISEIDSSAATSLQAVKLLALYLTGDXEGAISSLKEWVE

SEQ ID NO: 20532 - DNA, 676 bp, Zea mays
  misc_feature: Ceres CLONE 1389032-F
  misc_feature (437)..(437): n is a, c, t, g, unknown, or other
  misc_feature (466)..(466): n is a, c, t, g, unknown, or other
  misc_feature (533)..(533): n is a, c, t, g, unknown, or other
  misc_feature (676)..(676): n is a, c, t, g, unknown, or other
tccccgcggtggcggccgctctagaactagtggatcccccgggctgcaggaattcgcacgagaccattacctagaacatcctaatcgaaaagtcttctttctcggcttctcgcttccttctccttttcttcctctcctccccactctcaattccttcctcgttcggttgttccttcccacttcctctctctcgcgcgcctgtactacttttgaagccgcaaggtcagaagagaggatccacctctcagttcgattttcggtggctgaagtccttctacctcggggggtttgagcgttttccttgataaatttgtgtttcttcgagagtttattttttgtgttttctcttgagagattcgtgcgaaggacgtcgtcttcggtccattttcttgggtagtcgaattgctcttatacagcgtcaaagcatccaactttgnacttctccgtggtggcttcttctactaanctctgtgttgtcgaggagacaatttaatctttattttaattggggttggatggcttgtttcaagttngcagttgaaagggtagcagaagacaccattaatcctgggtggatttttggtgcttatctgctgaaataattggagggtcaaagaaaccatttgcagttctttactttctcgtttcttgggaaagattttggtggaatttcgtn

SEQ ID NO: 20533 - DNA, 653 bp, Zea mays
  misc_feature: Ceres CLONE 1389038-F
  misc_feature: Encodes the peptide sequence at SEQ ID NO. 20534
  misc_feature (449)..(449): n is a, c, t, g, unknown, or other
  misc_feature (500)..(500): n is a, c, t, g, unknown, or other
tccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcggagtggcagcgcggcgtgcggcgccggatccaccagcacccggagctggccttccaggagcaccgcaccagcgcgctcgtgcgcgccgagctcgacgcgatcggcgtcccgtacgcctggcccgtcgcgcagacgggcgtcgtgnccaccatcaccggccccgccgcgggccccgtgttcgcgctccgcgccgacntggacgcgctccccatccaggaaatggtagaatgggacgacaagagcaaggaagacgggaatatgcatgcgtggcgccatgacgcccacgtggcgatgcttcctggaagacataagttgcttccccctcggaggcccgatccaaaggcagggc

SEQ ID NO: 20534 - protein, 137 aa, Zea mays
  misc_feature: Ceres CLONE 1389038-F
  misc_feature: SWISSPROT Homolog: EC 3.5.1.14 Aminoacylase
  misc_feature (70)..(70): Xaa is any aa, unknown, or other
  misc_feature (87)..(87): Xaa is any aa, unknown, or other
MAAAPALARELLDAAREPEFAEWQRGVRRRIHQHPELAFQEHRTSALVRAELDAIGVPYAWPVAQTGVVXTITGPAAGPVFALRADXDALPIQEMVEWDDKSKEDGNMHAWRHDAHVAMLPGRHKLLPPRRPDPKAG

SEQ ID NO: 20535 - DNA, 633 bp, Zea mays
  misc_feature: Ceres CLONE 1389064-F
  misc_feature: Encodes the peptide sequence at SEQ ID NO. 20536
  misc_feature (393)..(393): n is a, c, t, g, unknown, or other
  misc_feature (447)..(447): n is a, c, t, g, unknown, or other
  misc_feature (448)..(448): n is a, c, t, g, unknown, or other
  misc_feature (503)..(503): n is a, c, t, g, unknown, or other
  misc_feature (518)..(518): n is a, c, t, g, unknown, or other
  misc_feature (527)..(527): n is a, c, t, g, unknown, or other
  misc_feature (551)..(551): n is a, c, t, g, unknown, or other
  misc_feature (574)..(574): n is a, c, t, g, unknown, or other
aagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttccctcaacaatcatcangcctatttacacagttacctttgggtgcatttatggggcacaaacatcaggcanncacactaaccacacttgtgctaacaaaccttggctgctactctcagcaacagcangttcttccattcaanccactaagntcattgaactctgcttcttaattngacacaccacactaccattcagncagctacctgctggctacccccagcaatttcttccatttcacccactagcagcattgaa

SEQ ID NO: 20536 - protein, 129 aa, Zea mays
  misc_feature: Ceres CLONE 1389064-F
  misc_feature (79)..(79): Xaa is any aa, unknown, or other
  misc_feature (97)..(97): Xaa is any aa, unknown, or other
  misc_feature (115)..(115): Xaa is any aa, unknown, or other
  misc_feature (120)..(120): Xaa is any aa, unknown, or other
  misc_feature (123)..(123): Xaa is any aa, unknown, or other
MAAKIFCLLMLLGLSASAATATIFPQCSQAPIASLLPPYLSPAVSSVCENPILQPYRIQQAIAAGILPLSPLFPQQSSXLFTQLPLGAFMGHKHQAXTLTTLVLTNLGCYSQQQXVLPFXPLXSLNSAS

SEQ ID NO: 20537 - DNA, 668 bp, Zea mays
  misc_feature: Ceres CLONE 1389079-F
  misc_feature: Translation starting site: 496
  misc_feature (373)..(373): n is a, c, t, g, unknown, or other
  misc_feature (387)..(387): n is a, c, t, g, unknown, or other
  misc_feature (393)..(393): n is a, c, t, g, unknown, or other
  misc_feature (519)..(519): n is a, c, t, g, unknown, or other
  misc_feature (543)..(543): n is a, c, t, g, unknown, or other
  misc_feature (544)..(544): n is a, c, t, g, unknown, or other
  misc_feature (546)..(546): n is a, c, t, g, unknown, or other
  misc_feature (547)..(547): n is a, c, t, g, unknown, or other
  misc_feature (549)..(549): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (560)..(560): n is a, c, t, g, unknown, or other
  misc_feature (562)..(562): n is a, c, t, g, unknown, or other
  misc_feature (563)..(563): n is a, c, t, g, unknown, or other
  misc_feature (565)..(565): n is a, c, t, g, unknown, or other
  misc_feature (568)..(568): n is a, c, t, g, unknown, or other
  misc_feature (569)..(569): n is a, c, t, g, unknown, or other
  misc_feature (571)..(571): n is a, c, t, g, unknown, or other
  misc_feature (575)..(575): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (585)..(585): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (597)..(597): n is a, c, t, g, unknown, or other
  misc_feature (598)..(598): n is a, c, t, g, unknown, or other
  misc_feature (601)..(601): n is a, c, t, g, unknown, or other
  misc_feature (603)..(603): n is a, c, t, g, unknown, or other
  misc_feature (606)..(606): n is a, c, t, g, unknown, or other
  misc_feature (607)..(607): n is a, c, t, g, unknown, or other
  misc_feature (614)..(614): n is a, c, t, g, unknown, or other
  misc_feature (618)..(618): n is a, c, t, g, unknown, or other
  misc_feature (626)..(626): n is a, c, t, g, unknown, or other
  misc_feature (636)..(636): n is a, c, t, g, unknown, or other
  misc_feature (645)..(645): n is a, c, t, g, unknown, or other
  misc_feature (646)..(646): n is a, c, t, g, unknown, or other
  misc_feature (648)..(648): n is a, c, t, g, unknown, or other
  misc_feature (654)..(654): n is a, c, t, g, unknown, or other
  misc_feature (659)..(659): n is a, c, t, g, unknown, or other
  misc_feature (663)..(663): n is a, c, t, g, unknown, or other
tggagctccccgcggtggcggccgctctagaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctctgcttcgtctccctctcggccctgcgccacgcgatgcgtgagcggcggcaacgcgcccccctgagctggcctgtggtgggcatggctcccgttcgtgctcgccaacctcgggcgcctctacgacgccatcaccgacgccctccacggggtccgggtgcacgtcnttggtcccgcgggnccgtgnctcgcccgcgcggacttcctgctgacgtgcgacccggcggccgtccagcactgcctggcgtccaaccacaggggctacgacaggggccgagactttgcggagatgttcgacctcctgggcgacggnctgctggttgcggacgccgcgccnngnncnccccnnnnncncnncnccnncncccnccccnnnncnccggcggnnncnngcngnggnncgggggngccngcgcgcgnccgcggggcngggcggcgnngngcgcgngggcncgcngcgcg

SEQ ID NO: 20538 - DNA, 623 bp, Zea mays
  misc_feature: Ceres CLONE 1389080-F
  misc_feature: Encodes the peptide sequence at SEQ ID NO. 20539
gctctagaactagtggatcccccgggctgcaggaattcgcacgagaccattacctagaacatcctaatcgaaaaacttttccggcctcccattcctcgcgcggcgaccacccgattcgaagcgtgcggagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctcaccgctaccgccctggaactgttgccctccgtgagatccgcaagtatcagaagagcactgagctgctgatcaggaagctgcccttccagaggctcgtcagggaaattgcacaggacttcaaaacctgatttgcgtttccgaagccaatgcggtgcttgccctccaggaggctgctgaggattaccttggtggccctgtttgaggacaccaacctgtgcgccatccatggctaagcgtgtgaccatcatgccaaaggacattcagctgggcaagaaggatccggcggcgagagggcctaatcgccacctcaaacatcgtgacaaaaactgaagggcctgtggggttattgtttatc

SEQ ID NO: 20539 - protein, 81 aa, Zea mays
  misc_feature: Ceres CLONE 1389080-F
MARTKQTARKSTGGKAPRKQLATKAARKSAPTTGGVKKPHRYRPGTVALREIRKYQKSTELLIRKLPFQRLVREIAQDFKT

SEQ ID NO: 20540 - DNA, 674 bp, Zea mays
  misc_feature: Ceres CLONE 1389084-F
  misc_feature: Encodes the peptide sequence at SEQ ID NO. 20541
  misc_feature (383)..(383): n is a, c, t, g, unknown, or other
  misc_feature (403)..(403): n is a, c, t, g, unknown, or other
  misc_feature (433)..(433): n is a, c, t, g, unknown, or other
  misc_feature (453)..(453): n is a, c, t, g, unknown, or other
  misc_feature (494)..(494): n is a, c, t, g, unknown, or other
  misc_feature (643)..(643): n is a, c, t, g, unknown, or other
  misc_feature (644)..(644): n is a, c, t, g, unknown, or other
tggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcgtgaggggggaaatcgggaaaggaggaggtgagggagtatganagcgacatgaggaagctggnagagctgctttctaagctgaacccctcggncggaggagttcgtgccgcantcccgccgccgcgtggacggcggcgctccccgccttttcgncgacgcgcccggggttcgtgcccccggggatgattatttagcggggcaccaccaggtccccgcccccgaaattttttgaaaaaaaaaaccaatggccgggttgaattttttgggggggcccccccggttttcatatgggggggcccccnnggttttgttcccccagggaggggacccccc

SEQ ID NO: 20541 - protein, 48 aa, Zea mays
  misc_feature: Ceres CLONE 1389084-F
MVAVAVDGLIRGADAVPAAEREAVRAAAAEAAAKGVRGEIGKGGGEGV

SEQ ID NO: 20542 - DNA, 622 bp, Zea mays
  misc_feature: Ceres CLONE 1389086-F
gctctagaactagtggatcccccgggctgcaggaattcgcacgagaccattacctagaacatcctaatcgaaaaaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattctcctataaagttgtggccaccaagtgaaagcacacggatcaatgcttgtctgacaggatgacaaacaatctgtctacagagtccattttctctcgcaatattcgcctttttgggaaagcaagaggctcatgagaatgcaaaaaagattgaagaactttgctttgccttggctgaggagcattttcagagaggagccagaggggtggaggggaagttcctgttgtccagctattggcaaggaaaagagccagagggaggggggg

SEQ ID NO: 20543 - DNA, 647 bp, Zea mays
  misc_feature: Ceres CLONE 1389089-F
  misc_feature: Encodes the peptide sequence at SEQ ID NO. 20544
  misc_feature (348)..(348): n is a, c, t, g, unknown, or other
  misc_feature (377)..(377): n is a, c, t, g, unknown, or other
  misc_feature (378)..(378): n is a, c, t, g, unknown, or other
  misc_feature (467)..(467): n is a, c, t, g, unknown, or other
  misc_feature (468)..(468): n is a, c, t, g, unknown, or other
  misc_feature (481)..(481): n is a, c, t, g, unknown, or other
  misc_feature (482)..(482): n is a, c, t, g, unknown, or other
  misc_feature (485)..(485): n is a, c, t, g, unknown, or other
  misc_feature (486)..(486): n is a, c, t, g, unknown, or other
  misc_feature (488)..(488): n is a, c, t, g, unknown, or other
  misc_feature (489)..(489): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (496)..(496): n is a, c, t, g, unknown, or other
  misc_feature (509)..(509): n is a, c, t, g, unknown, or other
  misc_feature (550)..(550): n is a, c, t, g, unknown, or other
  misc_feature (585)..(585): n is a, c, t, g, unknown, or other
  misc_feature (628)..(628): n is a, c, t, g, unknown, or other
tccccgcggtggcggccgctctagaattagtggatcccccgggctgcaggaattcgcacgagaccattacctagaacatcctaatcgaaaaatctcctttctctctctacacatactcagacgagcagaagcagctagggacaccataggcaaactacttcagcaagaaattaaactatctcctacgcaagatcagaagaaactgtgtatggagcaagaagaggttggcctcgccctgggcctctccctcggctccggccaccaccaccaggagctcaagccccaacatccgtcgcatccgtggtgcggcgttgttggagccttctctgtcgctcagcggcccggcgnaccaaggatgatggcccgaccgcccgggnntgaggaggttcgctggccgtgaagagggagctggcagacgatggaggggaacgacgacgaggccaccgggcagggtattgctactccanngggggggggccgnnggnngnngnnnacnggccggacgacgncgaaagggggcaacagcaagccgggaagaagcggaggcggncccaaggagcagccgggggcggcgggagggacacnccagggagcacagcaccccccaccccaaagcagaaggcgggcngggccagacaaacgaaccg

SEQ ID NO: 20544 - protein, 63 aa, Zea mays
  misc_feature: Ceres CLONE 1389089-F
  misc_feature (47)..(47): Xaa is any aa, unknown, or other
  misc_feature (57)..(57): Xaa is any aa, unknown, or other
MEQEEVGLALGLSLGSGHHHQELKPQHPSHPWCGVVGAFSVAQRPGXPRMMARPPGXEEVRWP

SEQ ID NO: 20545 - DNA, 581 bp, Zea mays
  misc_feature: Ceres CLONE 1389090-F
  misc_feature (129)..(129): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (496)..(496): n is a, c, t, g, unknown, or other
  misc_feature (498)..(498): n is a, c, t, g, unknown, or other
  misc_feature (500)..(500): n is a, c, t, g, unknown, or other
  misc_feature (507)..(507): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (516)..(516): n is a, c, t, g, unknown, or other
  misc_feature (517)..(517): n is a, c, t, g, unknown, or other
  misc_feature (545)..(545): n is a, c, t, g, unknown, or other
  misc_feature (555)..(555): n is a, c, t, g, unknown, or other
gctctagaactagtggatcccccgggctgcaggaattcgcacgagaccattacctagaacatcctaatcgaaaaattttctcgagaatattattcttttaatggattagaaaatcaatctacaactacnactaagcaggcgtagaatcactctttcgtcttcttcttcatcatcatctgcttcttattttttttctgattgaccttggggagattcgcttaaccttgtaataatggcgggaatagctatagttttagatctactcaataaatctcataacaaacacgctttccactcatcgtcttctctgtcttccgccgccgccgtatctgctttcgccagtgctcccttcgcgtctaggtttctctttcggttcctttgggagcctcgaggtttgcggtaatttgggtggacggcgggcaggctggcaataagaacggaggggtttacccttggggggggggttaaaaaaaaannnnnnnnnnnnnnngnnnanananaaaaggnannnnagcnnggggagggggcggcagggggggcctcgnccgggacggngggggggggggggggggggggggggg

SEQ ID NO: 20546 - DNA, 683 bp, Zea mays
  misc_feature: Ceres CLONE 1389091-F
  misc_feature: Translation starting site: 176
  misc_feature: Pfam Name: Acid_phosphat_A Pfam Description: Histidine acid phosphatase
  misc_feature (264)..(264): n is a, c, t, g, unknown, or other
  misc_feature (286)..(286): n is a, c, t, g, unknown, or other
tccccgcggtggcggccgctctagaactagtggatcccccgggctgcaggaattcgcacgagaccattacctagaacatcctaatcgaaaaaacccaacccaaccgcgctttttgtcacctctcacctggaaagggaagacaagtcgagattcgagaaggcaaatcgaattcgccatgggcatggctgctccgcgcgcgccgctgcctctcccccaactgctgctcctcctcgttgctgcgctcctcgccgccgctcccctccnagggcgggccgggggcggacgnagttcgacgtccgccgccacctctccaccgtcacccaggtatgatgggggccagggagctccagtagtgtcatctccatgccggcgatcccagaccgggctgccgtgtcattcacctcaatctagtggcaagacatggggactcgtgctcctaccaagaagcgcatccaggagctggattaggattggcagttcgactggaagcccttctgaaagagcgaaaccaggccccttgatagggaattctctgaagaaaattccatccgtggattaaaggctggcaatcaccctggaaaaggtcggagctaagggggggtggcctgggtcagggcacgcgggagcaggaggctgaccaacatgagccaccagcatcgagccgagccggtgcgcgggtgcgg

SEQ ID NO: 20547 - DNA, 633 bp, Zea mays
  misc_feature: Ceres CLONE 1389094-F
  misc_feature: Encodes the peptide sequence at SEQ ID NO. 20548
aagctggagctccccgcggtggcggccgctctagaactagtggatcccccgggctgcaggaattcgcacgagaccattacctagaacatcctaatcgaaaagcactccgatcctgccctctaataacagcagcagcagccgccatggaaggcagcagcaagaagctccagccgttcctcctcacgctgctgatggtgctctccaccgacgtgacgcccatcctctcgctgtcagtgccagacgacgaggtagcctgcgactgcgacaaacccaaggtacccaagccgtcgcacccgcccaagaccaagccctcccacccgtcgccgaagcccaagaaccccaagccacccaagggcggcaccggatacccggcgacagcgcaccaaccgcccaagagcccctcctaccccccggtcgtcgggcctcacaagggccccgccacgcgcccgccagacacacgtccgccggtcgtcgtccctcccaatgctcccgccacgcgcccggcggtcacgcgtccgccgactgtcggaccaccgctgacctagccgacgatcagcgagcctccgactacgccgactgttgaaggaccatcggtgacctacccgacgataaccgaccctgccacaacggagt

SEQ ID NO: 20548 - protein, 133 aa, Zea mays
  misc_feature: Ceres CLONE 1389094-F
MEGSSKKLQPFLLTLLMVLSTDVTPILSLSVPDDEVACDCDKPKVPKPSHPPKTKPSHPSPKPKNPKPPKGGTGYPATAHQPPKSPSYPPVVGPHKGPATRPPDTRPPVVVPPNAPATRPAVTRPPTVGPPLT

SEQ ID NO: 20549 - DNA, 687 bp, Zea mays
  misc_feature: Ceres CLONE 1389104-F
  misc_feature: Encodes the peptide sequence at SEQ ID NO. 20550
  misc_feature (687)..(687): n is a, c, t, g, unknown, or other
gctctagaactagtggatcccccgggctgcaggaattcgcacgagaccattacctagaacatcctaatcgaaaatttttttccccgctctgctctgcacgcccctctcctccctagtccctccccctacccccgcccgtcaaagcgagagcgccgtatcacctgtctctccgtccaccgccgtctcgatccgcgcccaaagatacctttcccccaccccttcctcgcgccgccgttttggtgcgaccatgacggcggagggggaggccaagaacccgtcggccggtggcggaggggataacccccagcaccaggcaggttgcgccccgggggccggggggcccggaaacaggggggaaaaagggggggccccccagtttgtctttttgtctcgtctgcgcggcgccccggccccgaacccaccctagcgggcggggggcggggcgggggtggggggtgttcgaacgccggggcccgcctccggggcgccgggggggcgcgacgaagaagaaaaataaagaacggctcgcaccgcgacgcagcagacggggggccggttgccggtgtggtgggccggaggcccgccgtgagtgcgcgcccctggcctgaggggcgccgcccaacgggtaaagccggagggggctgtgacaggtggggagcgcgggtggcgtgtgggatcccgtgtgtn

SEQ ID NO: 20550 - protein, 59 aa, Zea mays
  misc_feature: Ceres CLONE 1389104-F
MTAEGEAKNPSAGGGGDNPQHQAGCAPGAGGPGNRGEKGGAPQFVFLSRLRGAPAPNPP

SEQ ID NO: 20551 - DNA, 571 bp, Zea mays
  misc_feature: Ceres CLONE 1389107-F
  misc_feature (90)..(90): n is a, c, t, g, unknown, or other
  misc_feature (177)..(177): n is a, c, t, g, unknown, or other
  misc_feature (188)..(188): n is a, c, t, g, unknown, or other
  misc_feature (189)..(189): n is a, c, t, g, unknown, or other
  misc_feature (204)..(204): n is a, c, t, g, unknown, or other
tccccgcggtggcggccgctctagaactagtggatcccccgggctgcaggaattcgcacgagaccattacctagaacatcctaatcgaanagtctcttttccagttccagacctgaagaaactccgaccggtggcggcaggatctgtgccgcgatggcgacgtcgaacaccgctcgnatggaggacgnncgcggtgaactgcgnagcaccattcagaagtggacatcatctaccctggctaaactcactccaaaaaacggtcgccgaaggccgccgcatcccccttgccagggctggcggaaccactgggattgaaaacgttgaatggtgttcccacctcagatcccccagcttcgaattggaaagggggaccctcgggattctcacgggggggagggcccggggcccctttaaaaaaaagaagggtccccccggaaatttgtttattaaaaaaaaaaactgttggtgtcccagaaaaaaaattttttctccaaatccccggggggggaaaaaaaaaaaaaatttttttttttgggaaacccccccccccccccccaagaaagtgggtcct

SEQ ID NO: 20552 - DNA, 708 bp, Zea mays
  misc_feature: Ceres CLONE 1389108-F
  misc_feature: Encodes the peptide sequence at SEQ ID NO. 20553
  misc_feature (708)..(708): n is a, c, t, g, unknown, or other
tggagctccccgcggtggcggccgctctagaactagtggatcccccgggctgcaggaattcgcacgagaccattacctagaacatcctaatcaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccagcgaccccgccgccgccgcggccatggtggaccgcatgctccgcctgctcgcctcctacgacgtcgtccggtgccagatggaggaccgggacggccggtacgagcgccgctactccgccgcgcccgtctgcaagtggctcacccccaacgaggacggcgtgtccatggccgccctcgcgctcatgaaccaggacaaggtcctcatggagagctggtactatctcaaggacgcggtgctggacggcggcatcccgttcaacaaggcgtacgggatgacggcgttcgagtaccacgggacggacccgcgcttcaaccgcgtgttcan

SEQ ID NO: 20553 - protein, 177 aa, Zea mays
  misc_feature: Ceres CLONE 1389108-F
  misc_feature (31)..(87): Pfam Name: Dimerisation Pfam Description: Dimerisation domain
  misc_feature: SWISSPROT Homolog: EC 2.1.1.68 Caffeate O-methyltransferase
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFNRVF

SEQ ID NO: 20554 - DNA, 638 bp, Zea mays
  misc_feature: Ceres CLONE 1389115-F
  misc_feature: Translation starting site: 210
tccccgcggtggcggccgctctagaactagtggatcccccgggctgcaggaattcgcacgagaccattacctagaacatcctaatcgaaaatctgggccccatgtgctaactgcctgtaaaccctaatcccgaatccctcccggcctcctccgtctcgcgctcgattcgaatccgagctccctatcctgctcctgctgttcccgctgcaatggaggacaacgcggtcgaagagcccgagttgagcggtgcggcggagttcgcgcccggcgctcgtcgccgcccacccacacgggcacttccgtcggcgtcgccatcgggccgagctccgcgtgtttgatctcaggtctggtcatccagtttccttggcagaagattgggggtggccattctcattcagaaccaataaaagctatttggttccggggggggggagctttgtttgctttccctgggggaagcaacccttggggagggttggaaaaactgttttctgggcgtggcctcccaaataaaaattctggagaaaaagggggccccggggccctctggtttttataccacgctggagcccttggtggggatccttttggccaacaaacatctttcgccgtagggtcttcgtgcggtctacgcctcc

SEQ ID NO: 20555 - DNA, 677 bp, Zea mays
  misc_feature: Ceres CLONE 1389117-F
  misc_feature (378)..(378): n is a, c, t, g, unknown, or other
  misc_feature (387)..(387): n is a, c, t, g, unknown, or other
  misc_feature (447)..(447): n is a, c, t, g, unknown, or other
  misc_feature (467)..(467): n is a, c, t, g, unknown, or other
  misc_feature (519)..(519): n is a, c, t, g, unknown, or other
tggagctccccgcggtggcggccgctctagaactagtggatcccccgggctgcaggaattcgcacgagaccattacctagaacatcctaaccaaaaaaacgagaaggaagccaccgctccccaatcgcctgcttgccttcccatcctcctcgtagatctccggcaccgggcaccatgagctcctactccggcgaccgctcctcctcctcctccttgcgccccaccaacacctccttcgactcctacaagttcgacttcggcatcaactcctcccgctcctccggctctcgccccctccgcgaccagcggccgggcgcggctaccaaccctccaacgaggcccgccaccggcgccacgtggatgcaccagcccgccagncgccaaggnccgtcgtggacccaccagcctccccccgccgcgggcgtcggcgcccacccatgggcgggncctgggatccgggccaaccntccatggtcggcgacatctttgggccggagctggtcctccgccgcgccctcnttctgggttcggcatccctcaggccaacaaccccggcctcttcagcgatctcctcggctccgcgctcggctcctcccgctcccagtccaacgcgccgctcagatccgccgccgcgccacaggcatccaggccagccggtgagaagcccaatgtcaacg

SEQ ID NO: 20556 - DNA, 686 bp, Zea mays
  misc_feature: Ceres CLONE 1389119-R
cgaattgggtaccgggccccccctcgaggtcgacggtatcgataagcttttttttttttttttttggatatcccttcaaaattagtgtgtcgacagtaggctgcaaatatgcagatgcaccttaaagctaacaatgcaaaattacaggacctttaccagttgtacctcaaacactagtggctctttggcatgagacagtagacttcatctcagtctaaactacaatttgaccccaaaacgaataaaagagtaatcgtgaaataagttgtactgtaaaccatcggaattatgcaaaatttacattttgcaaatattgtactattgttccttcgaatagaatctagataaagagtacaacatcgcgatcatgtacctcttctgacatgggctccaatgtctcattggtgtagccttacctcagaagggattagaaacctccgcttgcctgcacagtgcacaccaaggtgctgtttggttcaagaaatgtaacgcaaagggtaatgtaatggtttacattcgattactatcggtaacaagtttgaatagtacggtattaatttttagtatggtatctgattacggtgagactaaaacaaacatgatttaacgttatcacttacccattacgttacaaatatctgaaccaaacggtacccaagtgaaaccataataattgtcctaaaacc

SEQ ID NO: 20557 - DNA, 681 bp, Zea mays
  misc_feature: Ceres CLONE 1389119-F
  misc_feature: Encodes the peptide sequence at SEQ ID NO. 20558
  misc_feature (476)..(476): n is a, c, t, g, unknown, or other
  misc_feature (505)..(505): n is a, c, t, g, unknown, or other
tggagctccccgcggtggcggccgctctagaactagtggatcccccgggctgcaggaattcgcacgagaccattacctagaacatcctaatcgaaaagattgattcacaagacgtcgatcccaaaccctaaccctttcaacggttccactccaccaccaacctcatgtgtcggcgcccgccgccgcacccaacccctccctcctccgtctgctcccggtcctcgcgtagccgcaacctccctcgttgccccacactacccacgtccctagcgtcatgcagatcaaaaccaaggggcaggcggcgacagtggttcagagtccgccgctgacggccctgcgaggaacgggtagattcgcttggtgtccgggcggctccgcgtcgccgaatccgatagcattgtgggatctggaggtaggaaaaggggcttgggtggtagacgtggagggacgatgggcgttcatgggtcctagaagtnaagcgcgatggtctcctcaggcatcggcnttcgtgggaacggctggttcttcccatcatagaatcagaagaagactcgagtcataaaaaagttcatcattgttgcttgaatcccacgaaatggccgctggttcttctcatttcgttgtagcatgcctagatctgtggaaatggtttgtttccttcgcttcgcttgaatccacgag

SEQ ID NO: 20558 - protein, 95 aa, Zea mays
  misc_feature: Ceres CLONE 1389119-F
  misc_feature (68)..(68): Xaa is any aa, unknown, or other
MQIKTKGQAATVVQSPPLTALRGTGRFAWCPGGSASPNPIALWDLEVGKGAWVVDVEGRWAFMGPRSXARWSPQASAFVGTAGSSHHRIRRRLES

SEQ ID NO: 20559 - DNA, 792 bp, Zea mays
  misc_feature: Ceres CLONE 1389122-F
  misc_feature: Encodes the peptide sequence at SEQ ID NO. 20560
  misc_feature (19)..(19): n is a, c, t, g, unknown, or other
  misc_feature (46)..(46): n is a, c, t, g, unknown, or other
  misc_feature (50)..(50): n is a, c, t, g, unknown, or other
ttttttttccccccccccntccccccccccctctcccccctcccanaaanacaggagaaagctggagctccccgcggtggcggccgctctagaactagtggatcccccgggctgcaggaattcgcacgagaccattacctagaacatcctaatcaaaaaacgacgtcactagtagagccgtagagggcaagaggcgacggaatgacggagcggcaggtggcggagctgggtcccgggacggcgtgctgcggctggaaccactgtggccgccgcctcgccgctggcgccgtcgatggctccgtctccgtctatgactcccagccgccaccctcgctcaggtggcagggccgtgagcaagttattgtgaatgtggcgctggctcgcccccgacgcacggcctctgtcatcgccccgagctgtaccgtgagggcccggatgggcggggggcgcaccccgcgccctagccggtgggtgggccttctgtgccggggacaacccgaggccgtagctcccccgccagggccgatatcacgcaccccctccaccgctttcccccgctcccattccccccctcgataccaatcctatcgcggtttactcggagacggggtgggggcaatatccccccccccctctctccctttgccatactgccataagtcagaggctagggctgcaagaccggttgagcgaccaagcagggtcgtacagtagctaataactgaggtcttggagagcgagcgtgtcgggtgggtgtggggacgcgcgcgcggagtgactgtcccccttgct

SEQ ID NO: 20560 - protein, 170 aa, Zea mays
  misc_feature: Ceres CLONE 1389122-F
MTERQVAELGPGTACCGWNHCGRRLAAGAVDGSVSVYDSQPPPSLRWQGREQVIVNVALARPRRTASVIAPSCTVRARMGGGRTPRPSRWVGLLCRGQPEAVAPPPGPISRTPSTAFPRSHSPPRYQSYRGLLGDGVGAISPPPSLPLPYCHKSEARAARPVERPSRVVQ

SEQ ID NO: 20561 - DNA, 744 bp, Zea mays
  misc_feature: Ceres CLONE 1389127-F
  misc_feature: Encodes the peptide sequence at SEQ ID NO. 20562
aaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagtcagggccccccctgggggggagggaaaaaacagcgtttcatattcgggggacctcgctcggaacctgcgcttcgcctccaacttcgacgctcttcaaggctgctgccggccgaatggcgcgacagccttttcctggggaggaggctcctaactcgctttcggggggatggagctgctggactctatcaggaaacgggttcctgctatgcctcagctcttggatcgaaaattggtgg

SEQ ID NO: 20562 - protein, 199 aa, Zea mays
  misc_feature: Ceres CLONE 1389127-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQSGPPLGGREKTAFHIRGTSLGTCASPPTSTLFKAAAGRMARQPFPGEEAPNSLSGGWSCWTLSGNGFLLCLSSWIENWW

SEQ ID NO: 20563 - DNA, 802 bp, Zea mays
  misc_feature: Ceres CLONE 1389130-F
  misc_feature (36)..(36): n is a, c, t, g, unknown, or other
ttgtggggcgggccgcgcgccgctctaaattatatntaataatatgtgcgaaagctggagctccccgcggtggcggccgctctagaactagtggatcccccgggctgcaggaattcgcacgagaccattacctagaacatcctaatcgaaaagtcatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggagccgctgcccgccgacctccactttctccgcggagctccccctacgacatatactacctctcccaatttccgcgctgtatcgatgggtgggcgtaggctatacgatggttgctcgcacccccgtccgcttcgcgggggccggccgcgcggcgcgcgccggctgcagacgcgctacggcgcccctcgtcgccttagtacctcccactgggcgcgcgggcgccggcgccacacaggaccgcctcgcccgaccccgaacccccaggaacagcgccgggcgctctccccggtgctagaggcgttcatgtctgactgtcgatgtcggcccccgcccgccggcgcgccagagcggcccgggggtggtgggcatggccggtcctatgggcgg

SEQ ID NO: 20564 - DNA, 672 bp, Zea mays
  misc_feature: Ceres CLONE 1389139-F
  misc_feature: Encodes the peptide sequence at SEQ ID NO. 20565
  misc_feature (596)..(596): n is a, c, t, g, unknown, or other
tccccgcggtggcggccgctctagaactagtggatcccccgggctgcaggaattcgcacgagaccattacctagaacatcctaatcaaaaaaagttttgagagcggcaaagcgttaggcgttagggcatccacctcgtcgtaggcggcggtctccatgtctaccgcatccggcaacggcaacggcggctcctcctcttccatgttatacgacttgtacggccctaatgcaaagcctgatgtggtttttaaggaggctgctttaaactctacgttaaatctgcaggatgttcagggtctagttacttgggttattggtgatggcatgctgccttctttgggtgtttgttaagaacaaacctcttataccaaaagttgtcctactatatgttcctggccttgatgcaactttatatatgtcacacactcgacttctttcttctctgaaagaattatgtggcaatccaaaacctgttttagcttcaagccgtatggccggataagaggcacaccattgatgcgctcctaacctgcagagtaaagagaaaagcgtgatgtaaaaacatcaaatgagtcatctaaacctgacatagatggnaaactataaaggtctgggatggatcttggggacataccattccctgttacatattacacactctcagagaaaggat

SEQ ID NO: 20565 - protein, 64 aa, Zea mays
  misc_feature: Ceres CLONE 1389139-F
MSTASGNGNGGSSSSMLYDLYGPNAKPDVVFKEAALNSTLNLQDVQGLVTWVIGDGMLPSLGVC

SEQ ID NO: 20566 - DNA, 738 bp, Zea mays
  misc_feature: Ceres CLONE 1389152-F
  misc_feature: Encodes the peptide sequence at SEQ ID NO. 20567
  misc_feature (724)..(724): n is a, c, t, g, unknown, or other
tggagctccccgcggtggcggccgctctagaactagtggatcccccgggctgcaggaattcgcacgagaccattacctagaacatcctaatcgaaaaattccctccactcctcccagccgcattaccgttgccgttgcgattctcgagtcctccccacactacattagccaggggctcggcgacccggtgcggcggtgccagcagccgcagccggcaggcagcatctcggcctcggcgtggcccggtggccgcgtgggcaggcagcagactgagccctgcaaaccgcacgcacgcacgccgcaggcaggctagcaagcagtcagctctgtattgattgtgcttttggagtggcattagacgtggaaatcgacgggctccgctactggtagccgttgccgtagatggcgaggggcatcaccaccatggaggtgcgcgccgacggcgtggccgtcatcaccatcatcaacccgcccgtcaacgccctctcgctcgacgtcatagctagtttgcagaggaactatgcagaggctctaagcaggaacgatatcaaggcaatcgtcctcactggttccaaaggaaggttttgtggtggattcgatatagccgcgtttgaaaataagccaaaaaatgagaagcctggatccatgtctattgattttttgactgacatagtcgaagatgctcacaaaccgtcagtggctgctatagatggcattgctctangtggtggattggag

SEQ ID NO: 20567 - protein, 112 aa, Zea mays
  misc_feature: Ceres CLONE 1389152-F
  misc_feature: SWISSPROT Homolog: EC 4.2.1.55 3-hydroxybutyryl-CoA dehydratase
  misc_feature (108)..(108): Xaa is any aa, unknown, or other
MARGITTMEVRADGVAVITIINPPVNALSLDVIASLQRNYAEALSRNDIKAIVLTGSKGRFCGGFDIAAFENKPKNEKPGSMSIDFLTDIVEDAHKPSVAAIDGIALXGGLE

SEQ ID NO: 20568 - DNA, 640 bp, Zea mays
  misc_feature: Ceres CLONE 1389153-F
  misc_feature (8)..(8): n is a, c, t, g, unknown, or other
  misc_feature (15)..(15): n is a, c, t, g, unknown, or other
  misc_feature (20)..(20): n is a, c, t, g, unknown, or other
  misc_feature (22)..(22): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (90)..(90): n is a, c, t, g, unknown, or other
  misc_feature (286)..(286): n is a, c, t, g, unknown, or other
  misc_feature (294)..(294): n is a, c, t, g, unknown, or other
gtccccgnggggggncggtntnaaaannnnnnnncnnnnnnnnnnnnnnnnnnnnnnnnnnnnnnaaagctggggctccccgcggggggncggccgctctagaactagtgggatcccccggggctgcaggaattcgcacgagaccattacctagaacatcctaatcgaaacagctccgcctccctttcctacttcttcctccgtctccagctcgcgcagcaggcgacacagcgacgctaaaaacctagagcgaggagcgtggcagggccagcggtttgcgatgacngcacccgncgacaagggggaaaaggccaaaaccgattccaacggcgggaaggaaaaacaacaaatcgacgggggccttggcttttccctcgagaaagctccggggaaattcgggacgggtttccaaaaggttattggggaaacaaggggccacggtttttggggggggggggaaaaaaaccggggggattttccaaacccggtgtttttttcggggggggggggttataaataaaaccccccccggctttttttgtccacaggggttttttttgacccccccccctcaaaaaagggggttttcttgggggggggggggcccaaaaaatatttcccgcgccggggcgccccccct

SEQ ID NO: 20569 - DNA, 684 bp, Zea mays
  misc_feature: Ceres CLONE 1389154-F
  misc_feature (331)..(331): n is a, c, t, g, unknown, or other
  misc_feature (336)..(336): n is a, c, t, g, unknown, or other
  misc_feature (345)..(345): n is a, c, t, g, unknown, or other
  misc_feature (346)..(346): n is a, c, t, g, unknown, or other
  misc_feature (443)..(443): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
tggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggagcggtgaggggcgcagctttgcgagcggcgnccaangggcgtgannggggaaatcgggaaggaggaggtggagggagtatgaaagcgacatgagggacctggaggagctgctttctaagctgaacccctcgcgggaggattcngtgccgcatccccgccccccgtgggaagggggggggtcccccctttttggcgaagggcccggggtttcggttccccgggaattaaataaaaaaggggggcaccaccaagtcccccgcgccccaaattttttgtaaaaaaaaaaacccaaaggcgggggttgtgaattttttgtgggggggggcccccccggggttttttctatggggggggggcgccnnngggggtgataacccccacaaa

SEQ ID NO: 20570 - DNA, 754 bp, Zea mays
  misc_feature: Ceres CLONE 1389156-F
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (27)..(27): n is a, c, t, g, unknown, or other
aaaacccaccaacacacannnnnnacnacacccccgacggcccgccccccccaaaaaactggtgctccccgcggtggcggccgctctagaactagtggatcccccgggctgcaggaattcgcacgagaccattacctagaacatcctaatcgaaaaacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaagttcccgagcagctcgaggaccgcggtgtcggtaagacttgctttgaagatcttgatcaccacaagagatttgctgaatttccggtcactgtactttttccactggacatgtcctttcgcagcatacgtccgtgatgttaggggaaagctttggtagcttatcaagacgaagccttgaagtcaggaatttctgatttcgcctggtctggtcaaatcgtgccggaatctgtaagtgacctgcgccgaccgaaccatacatgacttgatctaacgagactcgccttgcttacctccccccgccataacaatcaacaccccacagctaaacacttgctccaacctacccctctccccgcccccccatccacgcgcccccgcccc

SEQ ID NO: 20571 - DNA, 676 bp, Zea mays
  misc_feature: Ceres CLONE 1389158-F
  misc_feature: Encodes the peptide sequence at SEQ ID NO. 20572
  misc_feature (409)..(409): n is a, c, t, g, unknown, or other
tccccgcggtggcggccgctctagaactagtggatcccccgggctgcaggaattcgcacgagaccattacctagaacatcctaatcgaaaaatgtgaggagaccgcggtgggttgctttgatgcttgtcaattaacgcacgctatgggcacttccgctgccgtcgtgcggcgcgcctgcaactgcaacgctaccacctcgactcgcccctgctagcagcatccgggaagctgccctgccactgccaggctgccacaccgaggtgctcccttgactccctctcctctcctcttctcgcgcacgtggtctgtgcccggtaccgcgggcggcgctgccgctcaccagaccggccgccgccacgtctgcttccgcgcctccccgcctcctcaccgtccgcccccttttacctngcctgatcattttattataaatgtgggggcgagagaactcatcataagcactggcatcaaggtcatggtaccctcggggaattccaacaacaaaaagcatgataagcggcagccaaaatttataccagacattatagctccggtcgatgaggttactactgctctggcgagaagctggcctcgaatcgtcaatctaatcctcccggtattgatttcaccaaaagcaatgagtgggtcaggcaggcatttcctttagaagaaaatctc

SEQ ID NO: 20572 - protein, 63 aa, Zea mays
  misc_feature: Ceres CLONE 1389158-F
MVPSGNSNNKKHDKRQPKFIPDIIAPVDEVTTALARSWPRIVNLILPVLISPKAMSGSGRHFL

SEQ ID NO: 20573 - DNA, 628 bp, Zea mays
  misc_feature: Ceres CLONE 1389161-F
  misc_feature (273)..(273): n is a, c, t, g, unknown, or other
  misc_feature (302)..(302): n is a, c, t, g, unknown, or other
aagctggagctccccgcggtggcggccgctctagaactagtggatcccccgggctgcaggaattcgcacgagaccattacctagaacatcctaatcgaaaaccccgtccctccactcctcccgtcgagcacttggcactgccaatggcggcagccgcccacaccccttcgatgcgtgcaagccgcctcctttccctctgagatcgacgcacctcctcctctcgtactcattcccgcttccagtttgtttcttcggaccgaagcatcgcacggncgcccccgaatttccggctggtctcaggncctgggctccgccggtcttcaacaagggggcgacaccggggccccttccgcgaaaatcgaggccctcctgcagggtccggagggggggaaagatccctcacggggcggaggggaaggaagcgcccccaaaacttaagagggggggaaatgggggccccgggaagacccccccttgacccggggtcctttgccccgtggtttttttcgcggttttggccccccaaaaagaacaacgttaatccttttcttgcccccggggaaaacgggggcttggggggggggtttatgtttctggcaaaggcccgccccttcgggggggcgggggg

SEQ ID NO: 20574 - DNA, 763 bp, Zea mays
  misc_feature: Ceres CLONE 1389171-F
  misc_feature: Encodes the peptide sequence at SEQ ID NO. 20575
  misc_feature (1)..(1): n is a, c, t, g, unknown, or other
  misc_feature (12)..(12): n is a, c, t, g, unknown, or other
  misc_feature (18)..(18): n is a, c, t, g, unknown, or other
  misc_feature (19)..(19): n is a, c, t, g, unknown, or other
  misc_feature (763)..(763): n is a, c, t, g, unknown, or other
nttttttttttnttttcnntttttttcctctctcccccctactctcatccccccccgcggaccaatggagctccccgcggtggcggccgctctagaactagtggatcccccgggctgcaggaattcgcacgagaccattacctagaacatcctaatcgaaaaagcctgcctcggtgcgccgccgccacacctccaccatggctgcgaccacgccggccaccgacccgccggatgccttgcttgcagtaacagctgatgctcccactcctgctcgtcccaccccggcggagctggtagcccgcgccgtcgcccccgtcaagcccgccttcctctgcccgcctcccgtccgtgaggcacccaaggaggagggtaaagccgccggcgcgcggggccgccgtaaagggggagaagaagtccaagcgccagctcaggcgcgagcggcagcaggaacaaaaatctacttctcacctttgtatcgaagcagggaaaagggggaatgtgcactctcgcacatatggcaccttcttgtcccttcccccgctgagataaacgggctaatttggggccgcgacacccccctggaccgtgaaggggtgcccgcgccattttaacagcgcaacggggaaaaatttgcgagataactacggaacctagacttggacccagtagcccttaagccgtctactaagcggtcacacacacctggcctgccgtgctgtctctttgcgctcacggcgggcgctagaaggccgcggcccacccn

SEQ ID NO: 20575 - protein, 137 aa, Zea mays
  misc_feature: Ceres CLONE 1389171-F
MAATTPATDPPDALLAVTADAPTPARPTPAELVARAVAPVKPAFLCPPPVREAPKEEGKAAGARGRRKGGEEVQAPAQARAAAGTKIYFSPLYRSREKGECALSHIWHLLVPSPAEINGLIWGRDTPLDREGVPAPF

SEQ ID NO: 20576 - DNA, 588 bp, Zea mays
  misc_feature: Ceres CLONE 1389180-F
  misc_feature (233)..(233): n is a, c, t, g, unknown, or other
  misc_feature (254)..(254): n is a, c, t, g, unknown, or other
  misc_feature (300)..(300): n is a, c, t, g, unknown, or other
  misc_feature (301)..(301): n is a, c, t, g, unknown, or other
  misc_feature (303)..(303): n is a, c, t, g, unknown, or other
  misc_feature (309)..(309): n is a, c, t, g, unknown, or other
  misc_feature (339)..(339): n is a, c, t, g, unknown, or other
  misc_feature (350)..(350): n is a, c, t, g, unknown, or other
  misc_feature (395)..(395): n is a, c, t, g, unknown, or other
  misc_feature (396)..(396): n is a, c, t, g, unknown, or other
  misc_feature (404)..(404): n is a, c, t, g, unknown, or other
  misc_feature (427)..(427): n is a, c, t, g, unknown, or other
  misc_feature (437)..(437): n is a, c, t, g, unknown, or other
  misc_feature (438)..(438): n is a, c, t, g, unknown, or other
aaagctggagctccccgcggtggcggccgctctagaactagtggatcccccgggctgcaggaattcgcacgagaccattacctagaacatcctaatcgaaaaagatcaaatcaggacaggcatgctgaactaggcgaggtggactgggcgagcgagcgagatggagtggacgacggtggagacgagggacggcgcgaagctgagcgtgcggctggtcagccccccgcgtccgnaacgggtttgagcccgacccnaggaggatgtggcggtggtgctggtgcatccctacacatcctcggnngngtgcanggcctgcttgcgggaatggcgagggcgtcncgcgggggggntacacccggccgtcacttcgaatgggcggggcgggccggccaccnngggggggngtccctcacggctccacgagaanggggaagtanntcgccgctggcgagggggctcaaaaaaaatcatggccgggggatctcctccgcgggaccccagggggggacccattgccggactgcgatgataaaaggaggaaaaggattggtaccctttcaccccggaccccttgggccgagggcccac

SEQ ID NO: 20577 - DNA, 634 bp, Zea mays
  misc_feature: Ceres CLONE 1389181-F
  misc_feature: Encodes the peptide sequence at SEQ ID NO. 20578
  misc_feature (185)..(185): n is a, c, t, g, unknown, or other
  misc_feature (195)..(195): n is a, c, t, g, unknown, or other
  misc_feature (239)..(239): n is a, c, t, g, unknown, or other
  misc_feature (285)..(285): n is a, c, t, g, unknown, or other
tggagctccccgcggtggcggccgctctagaatagtggatcccccgggctgcaggaattccacgagaccattacctagaacatcctaatcgaaaaatcgacccagccatctcctcaccctcgttcaccacacagtccgccactcctttagtagcttgtgatttgtacgtcgacgagatcactggntcggtggcgnacgacgaccatggggaaaggtagtgtgggtgcatcatggtgggncgttcctcctgctcgccggggtgctgcttgtcctaacaaccaccgnccgggcggaagcacggattggcccaaacggaacccaaggaggacctggggggggtcaaaaaaggggggcaaggggaaaaacggaaaggaacccccccgaaaaaagtaaatggaaaaaaaagtggcccaagggcccccaaaaatttacccgggggaaaaaaggaaaaggggggtggaagcccaaatttcccccccccggggggggggagaggggggggccaaatatgcttggcccccccaaaaggagcaacgggggggaaaaacacggggggttgtgggggggggccccccccccccgtgttgggcccaaaaaaaagaaaaaaaaaaaaacccccccccaaaaaaaaagg

SEQ ID NO: 20578 - protein, 62 aa, Zea mays
  misc_feature: Ceres CLONE 1389181-F
  misc_feature (12)..(12): Xaa is any aa, unknown, or other
MGKGSVGASWWXVPPARRGAACPNNHRPGGSTDWPKRNPRRTWGGSKKGGKGKNGKEPPRKK

SEQ ID NO: 20579 - DNA, 644 bp, Zea mays
  misc_feature: Ceres CLONE 1389183-F
  misc_feature: Encodes the peptide sequence at SEQ ID NO. 20580
  misc_feature (322)..(322): n is a, c, t, g, unknown, or other
aaagctggagctccccgcggtggcggccgctctagaactagtggatcccccgggctgcaggaattcgcacgagaccattacctagaacatcctaatcgaaaagcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggnaccgtccccttctacccgtccgcggagtccgccgccgccgcgcactgcgacggcacgctgtacccggagctctgcctgtcgacactcgcggacatcccggacctacacaagaagccgctcccggacgtcatctgcgcgggcgagacccgcaccgaggacgtgatggtctccacgtccagtaactgctcgtactacctgcatgacaggtccctgtcgaagggggaaccactgaccatcaacgactggctggtactgctgtccaccacaatggacgacctcctgcgcagcaacgtcgaccttggggccccaacggcatgttgga

SEQ ID NO: 20580 - protein, 135 aa, Zea mays
  misc_feature: Ceres CLONE 1389183-F
  misc_feature: SWISSPROT Homolog: EC 3.1.1.11 Pectinesterase
MPPIPKRGEHLLVLLIVACAATAATAAGTVPFYPSAESAAAAHCDGTLYPELCLSTLADIPDLHKKPLPDVICAGETRTEDVMVSTSSNCSYYLHDRSLSKGEPLTINDWLVLLSTTMDDLLRSNVDLGAPTACW

SEQ ID NO: 20581 - DNA, 675 bp, Zea mays
  misc_feature: Ceres CLONE 1389184-F
  misc_feature: Encodes the peptide sequence at SEQ ID NO. 20582
  misc_feature (517)..(517): n is a, c, t, g, unknown, or other
  misc_feature (518)..(518): n is a, c, t, g, unknown, or other
  misc_feature (522)..(522): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (547)..(547): n is a, c, t, g, unknown, or other
  misc_feature (560)..(560): n is a, c, t, g, unknown, or other
aagctggagctccccgcggtggcggccgctctagaactagtggatcccccgggctgcaggaattcgcacgagaccattacctagaacatcctaatcgaaaaactgccctggtcccccattcaattcttccaactccgccgcttcgcctcgttccgtccgccgcccccatggcgtccgccgccgccacgaccacctccgcccccgcccagaacctcaatccccttagtatcaacatcaagctccccccatggctcagcgggctgcgctgccccttcaccttcgtctgcccgcccccgcccccgcctccgccgccgccgccgcctcctcccccgctgccacctacggaacccgtggtcccacggtcgcggaggttaccaagcctgcgggtgaccacggagtacgatagcgaagagggcgtgtttgtgaacaaggtgtcgtgcaagcttgcgggggacctcgccaaactgcggctctccttccagagcgacccgcaggggcaggccaaaaggggggcggnnaagnaannnnaacccgctacagcagctcnttccccgcgccgntggggggggctccatcacccaagcgtttctccgtgctctaccaacgtcaaggaacggaaacgcgctgctccgcagaaaactgtttcgcttcccggaaggcgccggtcaagcttcc

SEQ ID NO: 20582 - protein, 169 aa, Zea mays
  misc_feature: Ceres CLONE 1389184-F
  misc_feature (117)..(117): Xaa is any aa, unknown, or other
  misc_feature (119)..(119): Xaa is any aa, unknown, or other
  misc_feature (120)..(120): Xaa is any aa, unknown, or other
  misc_feature (121)..(121): Xaa is any aa, unknown, or other
  misc_feature (127)..(127): Xaa is any aa, unknown, or other
MASAAATTTSAPAQNLNPLSINIKLPPWLSGLRCPFTFVCPPPPPPPPPPPPPPPLPPTEPVVPRSRRLPSLRVTTEYDSEEGVFVNKVSCKLAGDLAKLRLSFQSDPQGQAKRGAXKXXXPATAAXSPRRWGGLHHPSVSPCSTNVKERKRAAPQKTVSLPGRRRSSF

SEQ ID NO: 20583 - DNA, 678 bp, Zea mays
  misc_feature: Ceres CLONE 1389187-F
  misc_feature: Translation starting site: 322
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nggggggnnnnnncccccccacccccaccccccccaagggggggnnnnnatgcggcggccaaaagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggagggaagatgagggaagtggatctccgtccacatcggggagggcgggaatccagtcggaaacgggtgctggggactttactggccccagaacgggatcccgcccgatggccaagtgccgggagagaagggcggggggacattcacgaaggaggccttcgggaaactttcttcagcccgaaagggggggttgggaaaaaaacggtccccccggggaaaggctttcgggtgggtactaaaaaacccccctggggggactccgaatgggggggggggccccttgggaaaatgaaacgggcccagggttttttcccacccccgggggaggaggggttcacaccgggggcggaaagagggggggggggg

SEQ ID NO: 20584 - DNA, 684 bp, Zea mays
  misc_feature: Ceres CLONE 1389188-F
  misc_feature (263)..(263): n is a, c, t, g, unknown, or other
  misc_feature (346)..(346): n is a, c, t, g, unknown, or other
  misc_feature (684)..(684): n is a, c, t, g, unknown, or other
cgcggtggcggccgctctagaactagtggatcccccgggctgcaggaattcgcacgagaccattacctagaacatcctaatcgaaaaaatcgacccagccatctcctcaccctcgttcaccacacagtccgccactcctttagaaacttgtgatttgtacgtcgacgacgatcactggacgtgtggctcacgatcacactgcgacaaggccatagagactgcatcatgctggtcgttcctcctgttcgccgccgtgctgctgnccttaacacccacccccgcgcctcaggacggagtgcaccaccggcaccgcaaggatgacctgctccgtggcagcacacgttcnaatcgacagtagggagagggcaccccccgtaatagggaatgcgagagcgagtgccccgagcggcaccataagctgacgcgggcgaggacggcgacagcggcgtggacgcctacgtctcccgcttccggaagggaggaagtgcccgccgcaaggtcctgggcccccaaaaaggtccagcccgtgggaaaaccccgaagtgtctatgaggcggcgcccccccccccgggtatggtccctccacattggagcaagaagtaacggccggggtacgtgaacgagcccgagaaaccggcaccggcaagagtatacttatcctccccactccccttataaattcn

SEQ ID NO: 20585 - DNA, 661 bp, Zea mays
  misc_feature: Ceres CLONE 1389189-F
  misc_feature: Encodes the peptide sequence at SEQ ID NO. 20586
  misc_feature (401)..(401): n is a, c, t, g, unknown, or other
  misc_feature (472)..(472): n is a, c, t, g, unknown, or other
tggagctccccgcggtggcggccgctctagaactagtggatcccccgggctgcaggaattcgcacgagaccattacctagaacatcctaatcgaaaaacacgaagcctagaatagccctcccctgctccgccacctcctcggatcccgaccaccccacccccaccccagacaacaggttgatggaggctaagatgggacgcttcttcgagtccgtgagcaatttcttcaccggaggcgaccacatcccctggtgcgaccgcgacctcatcgccggctgtgaaggagagcttgtcaatgctgtaaatgaggaacaaaggaatgaaagccttatgaggttgtcatgggcccttgtgcactccaggcagacagacgatggtagaccgtggaatcagcatgcttncagcttctttgggataatctgccagtcctctgcagactagggaaaagctgtactttggtggctggtggatnctacgggattggcgactactcaaaaaggaggcaacttgcagatcgtttgttgggagattccagcggattggcggcaggccatatccgtgaaggaggcaatagagataaaattgccaaggtgggcctgattggaataggaatgggaacaatggggtcggatttcgggtggggggaattgcagctgctgtt

SEQ ID NO: 20586 - protein, 86 aa, Zea mays
  misc_feature: Ceres CLONE 1389189-F
  misc_feature (74)..(74): Xaa is any aa, unknown, or other
MEAKMGRFFESVSNFFTGGDHIPWCDRDLIAGCEGELVNAVNEEQRNESLMRLSWALVHSRQTDDGRPWNQHAXSFFGIICQSSAD

SEQ ID NO: 20587 - DNA, 673 bp, Zea mays
  misc_feature: Ceres CLONE 1389190-F
  misc_feature: Encodes the peptide sequence at SEQ ID NO. 20588
  misc_feature (517)..(517): n is a, c, t, g, unknown, or other
  misc_feature (521)..(521): n is a, c, t, g, unknown, or other
  misc_feature (522)..(522): n is a, c, t, g, unknown, or other
aagctggagctccccgcggtggcggccgctctagaactagtggatcccccgggctgcaggaattcgcacgagaccattacctagaacatcctaatcgaaaaaaggaaacagtcacgtctcccagatctaactgccccccgactcacgaatcccaaagcctccatggcgacgcaccgccactgcctcccactcctcctcctcgtggccgccgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgcctctacgtcgacgccgccgaccccgccggccgcaccgtgccctacgtcgccgtcgtgtacgagcaggtctggacccgcacccgccagntcgnnctctttcaacccggggggcccccggccccatgaaacaaaccaaagggggggccaaaaaaactttcccccaataacgggcgaggaaaaccaaaaagggggcccaaaaaaaaaaaaaaaggtttcccccggtccccaagagaccaaaaaaaaa

SEQ ID NO: 20588 - protein, 130 aa, Zea mays
  misc_feature: Ceres CLONE 1389190-F
  misc_feature (119)..(119): Xaa is any aa, unknown, or other
  misc_feature (120)..(120): Xaa is any aa, unknown, or other
MATHRHCLPLLLLVAAALAAVPARAALGGGRGPLLGGWNPIPDVSDSHIQELGGWALGQAKHQKLAADGLRFRRVVRGEQQVVSGMNYRLYVDAADPAGRTVPYVAVVYEQVWTRTRQXXLFQPGGPPAP

SEQ ID NO: 20589 - DNA, 651 bp, Zea mays
  misc_feature: Ceres CLONE 1389194-F
  misc_feature: Encodes the peptide sequence at SEQ ID NO. 20590
  misc_feature (166)..(166): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (239)..(239): n is a, c, t, g, unknown, or other
  misc_feature (240)..(240): n is a, c, t, g, unknown, or other
  misc_feature (242)..(242): n is a, c, t, g, unknown, or other
  misc_feature (243)..(243): n is a, c, t, g, unknown, or other
  misc_feature (260)..(260): n is a, c, t, g, unknown, or other
  misc_feature (283)..(283): n is a, c, t, g, unknown, or other
cgctctaagaactagtggatcccccgggctgcaggaattcgcacgagaccattacctagaacatcctaatcgaaaaaagactcaagggccaaggcagggcactgcactgcacgcatgcactgacctgacgacgcgcgccacagtccactccacactcaggcatggncgatggcgccgcttccatcctactgatgatggtttcgctgaagggcctgcttctcgccgccgccggcgnnngnngnnacatccgtctgcccagngatgtcggagacctgtcaccgcnatggcgagggccagggcaggccaaagcatcagcttccggacgagaaaggcccgggggggcatgctgcgagctgggcgtatgcccagaaactacccgtaattgtccgggttttaaagggtaaagcctcctccaccctgaaaagaggcgggaaaagagaattcccccccttttgggaaaaggaaccggggaccccggccagtggccaaagaaggggggggggggggggcccccccaacacccctttggggaaaaccccccccccgcggtgtttttaaaaaaaaaaaagagggggggggcaacaaaaaaaaaaaagagaggggggaaaaatgcccgcgcgcccttctctccccggggttctcgcggggggg

SEQ ID NO: 20590 - protein, 80 aa, Zea mays
  misc_feature: Ceres CLONE 1389194-F
  misc_feature (2)..(2): Xaa is any aa, unknown, or other
  misc_feature (25)..(25): Xaa is any aa, unknown, or other
  misc_feature (26)..(26): Xaa is any aa, unknown, or other
  misc_feature (27)..(27): Xaa is any aa, unknown, or other
  misc_feature (28)..(28): Xaa is any aa, unknown, or other
  misc_feature (33)..(33): Xaa is any aa, unknown, or other
  misc_feature (41)..(41): Xaa is any aa, unknown, or other
MXDGAASILLMMVSLKGLLLAAAGXXXXIRLPXDVGDLSPXWRGPGQAKASASGRERPGGACCELGVCPETTRNCPGFKG

SEQ ID NO: 20591 - DNA, 626 bp, Zea mays
  misc_feature: Ceres CLONE 1389201-F
  misc_feature: Encodes the peptide sequence at SEQ ID NO. 20592
  misc_feature (305)..(305): n is a, c, t, g, unknown, or other
  misc_feature (433)..(433): n is a, c, t, g, unknown, or other
  misc_feature (538)..(538): n is a, c, t, g, unknown, or other
  misc_feature (608)..(608): n is a, c, t, g, unknown, or other
tggagctcaccgcggtggcggccgctctagaactagtggatcccccgggctgcaggaattcgcacgagaccattacctagaacatcctaatcgaaaaatcacccacgcgacgcgagccaaacccgaaaaaacagtaggcgaggcagggaaacggaaaccagactaccgcccccgaaaccgcgacgaccccacacctcgtccgcccctcctcccttcccgactcctactggctatccatcgcccgtctcccccgcgatcaagctgaccagagccggcaaccgatggtggtggtggcggtggaaggnggcggaggcggcggctgggggacgtgggaagagctggtgctgggcggcgcagtgctccggcacgggggcgccgcgtgggccaccgtcgccgaggagctccggacccgttccccgtgcaccttctcggncgaggaatgtgaagcaaaatttgcagagatacagttgcggtactccgcatggcatgcttggtttgaagagcttcgtaagcagagagttgctgaactgaaaagggnaaatggagaagtcggaaaattctatcggatccctccaatctgtgattcaaagctcagcatagcaactggnttgacggggagtctgata

SEQ ID NO: 20592 - protein, 115 aa, Zea mays
  misc_feature: Ceres CLONE 1389201-F
  misc_feature (51)..(51): Xaa is any aa, unknown, or other
  misc_feature (86)..(86): Xaa is any aa, unknown, or other
MVVVAVEGGGGGGWGTWEELVLGGAVLRHGGAAWATVAEELRTRSPCTFSXEECEAKFAEIQLRYSAWHAWFEELRKQRVAELKRXNGEVGKFYRIPPICDSKLSIATGLTGSLI

SEQ ID NO: 20593 - DNA, 777 bp, Zea mays
  misc_feature: Ceres CLONE 1389202-F
  misc_feature: Translation starting site: 217
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (23)..(23): n is a, c, t, g, unknown, or other
  misc_feature (24)..(24): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
nnncccccccccccccccccccnnccccccccgcggggggtatnnnttntcaaagctggagctccccgcggtggcggccgctctagaactagtggatcccccgggctgcaggaattcgcacgagaccattacctagaacatcctaatcgaaaacaccaccactggacgtcagcctagcaattagctcatcgactccagattggagaactcggcaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagggcggatcctgcggcgtcggcagcgtcggcagcccgttcctgggcccagtgcgtcgagttcctgaggcaccagtgcagccccggcggcgacgccctacggctcgccacagtgccaggcgctggcagcagcagtgctgccaccaagatccgggcagggtggagccggctgcaccgggaccagggggagattaggggggggggtccctggcaggtcctttccttgccgccagcaggccgggaggggggaggttcgccgggcggggttgacgtgggggtgccccacggggcgggcgggggtggggtgtgggggagggggggggaatgtggtgggggggccccgttcgcggcctggcc

SEQ ID NO: 20594 - DNA, 685 bp, Zea mays
  misc_feature: Ceres CLONE 1389203-F
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (287)..(287): n is a, c, t, g, unknown, or other
  misc_feature (290)..(290): n is a, c, t, g, unknown, or other
  misc_feature (291)..(291): n is a, c, t, g, unknown, or other
  misc_feature (293)..(293): n is a, c, t, g, unknown, or other
  misc_feature (294)..(294): n is a, c, t, g, unknown, or other
  misc_feature (296)..(296): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (306)..(306): n is a, c, t, g, unknown, or other
  misc_feature (307)..(307): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (313)..(313): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (324)..(324): n is a, c, t, g, unknown, or other
  misc_feature (327)..(327): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (335)..(335): n is a, c, t, g, unknown, or other
  misc_feature (336)..(336): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (344)..(344): n is a, c, t, g, unknown, or other
  misc_feature (346)..(346): n is a, c, t, g, unknown, or other
  misc_feature (348)..(348): n is a, c, t, g, unknown, or other
  misc_feature (356)..(356): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (385)..(385): n is a, c, t, g, unknown, or other
  misc_feature (400)..(400): n is a, c, t, g, unknown, or other
  misc_feature (403)..(403): n is a, c, t, g, unknown, or other
  misc_feature (470)..(470): n is a, c, t, g, unknown, or other
  misc_feature (508)..(508): n is a, c, t, g, unknown, or other
  misc_feature (509)..(509): n is a, c, t, g, unknown, or other
  misc_feature (523)..(523): n is a, c, t, g, unknown, or other
  misc_feature (527)..(527): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (543)..(543): n is a, c, t, g, unknown, or other
  misc_feature (548)..(548): n is a, c, t, g, unknown, or other
  misc_feature (549)..(549): n is a, c, t, g, unknown, or other
  misc_feature (551)..(551): n is a, c, t, g, unknown, or other
  misc_feature (586)..(586): n is a, c, t, g, unknown, or other
  misc_feature (595)..(595): n is a, c, t, g, unknown, or other
  misc_feature (596)..(596): n is a, c, t, g, unknown, or other
  misc_feature (648)..(648): n is a, c, t, g, unknown, or other
  misc_feature (652)..(652): n is a, c, t, g, unknown, or other
aagctggagctccccgcggtggcggccgctctagaactagtggatcccccgggctgcaggaattcgcacgagaccattacctagaacatcctaatcgaaaaacgccaacgcctcatccacctgtgctgtgacctcatatttgtcctccgttccttcgtctcatgatctctgcgcctctgcggctgtcggcgccgagggctgccgtcgggggatcgttcctgctcggcgcgtccaagtccaagcccagcaggatccgctgcgcccgggggggtgggggaggnnnnncnccnncnncncnnntnnncnnannngntnnnnnctgcnccnccnnnncnncnnnnccncncnaacccccnccccccccccnnnccccccgcccccgggnggggggggggcgggncgncggggggcgggggcccggcgcccgccgccccggggcccggcccccccccccccgccggccgggggcncgcccccccccgcggccggggcccccccgccccgccgnncccgcccccccccncggngnnngggcgcgggggnggcgnncngggggcccccccgggcgcggggcgggcgcggccgnccggggcgnnggcggcggccccgccccccgcccccgggggggccgcccgcggccgcgcgggnccgncccccccccgcggcccgggcgcccgcgggcgcc

SEQ ID NO: 20595 - DNA, 684 bp, Zea mays
  misc_feature: Ceres CLONE 1389207-F
  misc_feature: Encodes the peptide sequence at SEQ ID NO. 20596
  misc_feature (436)..(436): n is a, c, t, g, unknown, or other
  misc_feature (448)..(448): n is a, c, t, g, unknown, or other
tccccgcggtggcggccgctctagaactagtggatcccccgggctgcaggaattcgcacgagaccattacctagaacatcctaatcgaaaactcgccctcgcccgcctgtttaaacctgactgtctataacttaccgccggtccgcacccgcccaccgtccctgtccccttccccgtctaagcactcggatcctctgccgccgcgatgagctactacggccagcagcagccgcccgtcagcgcgccgccggcgcaaggttatcccgggaaggacgcgtacccgccgccgggctacccgcccgcgggatatcctccgccggcgcagggctacccaccgcagggctacccgccgcagggctaccctccgcaggaggggtatccgcagcagggaaccccgccgcagtactcgcagccgccgccgccgccccgccgcagnaagagcagcggncctcttttccttggaggggatgcttggcccgccctttgttgctgctgccctattggaagcctggcttctgagatctaagctgcgcacaacttgttctagaaaaccacttcattttggcacggttgaataaaaccgggggaattgggtttgttagcgaagaacgagaaaaccccagggggttctatgccaaatcacaggttctccaaggctcttttaagcgggcccggagtggcccg

SEQ ID NO: 20596 - protein, 106 aa, Zea mays
  misc_feature: Ceres CLONE 1389207-F
  misc_feature (77)..(77): Xaa is any aa, unknown, or other
MSYYGQQQPPVSAPPAQGYPGKDAYPPPGYPPAGYPPPAQGYPPQGYPPQGYPPQEGYPQQGTPPQYSQPPPPPRRXKSSGPLFLGGDAWPALCCCCPIGSLASEI

SEQ ID NO: 20597 - DNA, 636 bp, Zea mays
  misc_feature: Ceres CLONE 1389215-F
  misc_feature: Encodes the peptide sequence at SEQ ID NO. 20598
  misc_feature (276)..(276): n is a, c, t, g, unknown, or other
  misc_feature (291)..(291): n is a, c, t, g, unknown, or other
  misc_feature (354)..(354): n is a, c, t, g, unknown, or other
  misc_feature (372)..(372): n is a, c, t, g, unknown, or other
  misc_feature (373)..(373): n is a, c, t, g, unknown, or other
gggcggccgctctagaactagtggatcccccgggctgcaggaattcgcacgagaccattacctagaacatcctaatcgaaaacccacattccctttacgcgaagaagcatcaccgcgagtcgtcctcctctctgtcttcgctcggcgatctatcaaggaggccaggagggtgagggggagatggcggagaacccgcagctgtttgggaacgggatgccggtgccgttctacggcgagatgttcgtcctcgtccgggacggcgtcgagttcacgtcngacagatcccgcagnctcctggaggtcatgtgaaaacaaaagcacaatttactgtcaatataagggatggtgggttgntgccagcaagcctggtgnncacttctttggctttgaattgccactggtggttgggcatgggtggaaagttcaatcaggcccatatttcactgaaacaacatctcggggattcgttggaaccagggcggtcccagacaatcaagaaaaggggcccgggaaatcaattcaaccctttcaggaacttgggtccagggaaagggggggggggggaaatttttcggtcccccccctcccttaaccgggggggggattgggggggggggggtaaaaaggggagtttga

SEQ ID NO: 20598 - protein, 42 aa, Zea mays
  misc_feature: Ceres CLONE 1389215-F
  misc_feature (37)..(37): Xaa is any aa, unknown, or other
MAENPQLFGNGMPVPFYGEMFVLVRDGVEFTSDRSRXLLEVM

SEQ ID NO: 20599 - DNA, 717 bp, Zea mays
  misc_feature: Ceres CLONE 1389221-F
  misc_feature: Encodes the peptide sequence at SEQ ID NO. 20600
  misc_feature (428)..(428): n is a, c, t, g, unknown, or other
agagctggagctccccgcggtggcggccgctctagaactagtggatcccccgggctgcaggaattcgcacgagaccattacctagaacatcctaatcgaaaaatcagtcatcacccatcgcctccgccgacgacattagcgtagtgtagagtagttccggagagggttggggagagtagtagtgatccgcaatgtcgactcacgaggctgttgtggctgaggtcccggtgaccgaggtgccagcggaggtcccggtggcccaggtggccgaggcgcccaaggtgaagaatgcgctccaaggagaagaatgcgcctatggagaagaagccgtccgcggcgaagaagccggcggcgcaccctccctacgctgagatgattgtagaggcgatcgctgccctcaaggagaggaaggtgtcgagctcggtggncatcagcaagtacgtcgaggggaatcacggcgtccagctccccaccaacttccgcaagcagctcaccgtgcaactgaagaagctcgctgccgtccggcagctgacgagggatgagaactcctttcagctgacggacactgacgccatgcccaagtcgcccagcccaaggcaccctaggtcgcgcctgagcccaagccctcgctgaggcggaggtcaagaccgctgctaagccccaggcggcgtcccccaaggcccatggccaaggccaaggccaggtcaagggccatcc

SEQ ID NO: 20600 - protein, 114 aa, Zea mays
  misc_feature: Ceres CLONE 1389221-F
  misc_feature (22)..(92): Pfam Name: Linker_histone Pfam Description: linker histone H1 and H5 family
  misc_feature (47)..(47): Xaa is any aa, unknown, or other
MRSKEKNAPMEKKPSAAKKPAAHPPYAEMIVEAIAALKERKVSSSVXISKYVEGNHGVQLPTNFRKQLTVQLKKLAAVRQLTRDENSFQLTDTDAMPKSPSPRHPRSRLSPSPR

SEQ ID NO: 20601 - DNA, 678 bp, Zea mays
  misc_feature: Ceres CLONE 1389228-F
  misc_feature: Encodes the peptide sequence at SEQ ID NO. 20602
  misc_feature (519)..(519): n is a, c, t, g, unknown, or other
  misc_feature (537)..(537): n is a, c, t, g, unknown, or other
  misc_feature (591)..(591): n is a, c, t, g, unknown, or other
  misc_feature (660)..(660): n is a, c, t, g, unknown, or other
  misc_feature (673)..(673): n is a, c, t, g, unknown, or other
tggagctccccgcggtggcggccgctctagaactagtggatcccccgggctgcaggaattcgcacgagaccattacctagaacatcctaatcgaaaagcttggcttgctcgctttcctttcccgtctcgactctcgagtctcgactcctcgcattcgccgctgcgtcaacgtgtcttccttcccgcggtctctccgccgcctcccagatccggcggccatggcaaggaacccgggctgcaccgtcttcataggtaacttggatgacaaggttcctgagagggttctgtatgaaattcttattcaggtaggtcgtgttgtagacctacacatacctcgtgacaaggaaactagccgaccaaaaggctatgcttttgctgagtatgaaacagaggagattgcccaatatgctgttaagctattttctggtcttgttcgacttcataataaaacgcttagatttgcgatctctgggcaagacaaaccctcattaaatgggcatatccctgtaactcctaggntaaactctgtaccacagnccaagcctcatcaacctatgaggtctagtgatactcctttgccacagcatgcancagtgaatggcaagaatgcccggtatggtatccccacaaatcattcatacgacccgcaccctcaagggnaacccgggggggntcccg

SEQ ID NO: 20602 - protein, 153 aa, Zea mays
  misc_feature: Ceres CLONE 1389228-F
  misc_feature (9)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (101)..(101): Xaa is any aa, unknown, or other
  misc_feature (107)..(107): Xaa is any aa, unknown, or other
  misc_feature (125)..(125): Xaa is any aa, unknown, or other
  misc_feature (148)..(148): Xaa is any aa, unknown, or other
  misc_feature (152)..(152): Xaa is any aa, unknown, or other
MARNPGCTVFIGNLDDKVPERVLYEILIQVGRVVDLHIPRDKETSRPKGYAFAEYETEEIAQYAVKLFSGLVRLHNKTLRFAISGQDKPSLNGHIPVTPRXNSVPQXKPHQPMRSSDTPLPQHAXVNGKNARYGIPTNHSYDPHPQGXPGGXP

SEQ ID NO: 20603 - DNA, 702 bp, Zea mays
  misc_feature: Ceres CLONE 1389229-F
  misc_feature: Encodes the peptide sequence at SEQ ID NO. 20604
  misc_feature (702)..(702): n is a, c, t, g, unknown, or other
tggagctccccgcggtggcggccgctctagaactagtggatcccccgggctgcaggaattcgcacgagaccattacctagaacatcctaatcgaaaaagaccaccactgcgccattggccagctagagccaaccagaagagcttgcagttactgagagtgtgtgtgagagagaggatgggtggcagcggcagggctgctctgctgctggccctggtggtggtggccgtgagcctggccgtggagatccaggccgacgccgggtacggttacggcggcgggtacaccccgacgccgacgccggccaccccgaccccgaagcccgagaagccccccaccaaggggccgaagccggacaagccgcccaaggagcacgggcccaagccggagaagccgcccaaggagcacaagccgacgccgcccacgtacaccccgagccccaaacccacgccgccgacgtacactcccaccccgacgccccccaagccgacgccacccacatacactcccgcccctacgccccacaaacccacaccaaaacccactcccactcctccgacgtacaccccgacccccaagcctccgacacctaagccgaccccgccgacgtacactccaagccccaaacctccgacgcccaagccgaccccaccgacgtacaccccttccccaagcctccgacacctaagccgaccccgcctacn

SEQ ID NO: 20604 - protein, 175 aa, Zea mays
  misc_feature: Ceres CLONE 1389229-F
MGGSGRAALLLALVVVAVSLAVEIQADAGYGYGGGYTPTPTPATPTPKPEKPPTKGPKPDKPPKEHGPKPEKPPKEHKPTPPTYTPSPKPTPPTYTPTPTPPKPTPPTYTPAPTPHKPTPKPTPTPPTYTPTPKPPTPKPTPPTYTPSPKPPTPKPTPPTYTPSPSLRHLSRPRL

SEQ ID NO: 20605 - DNA, 671 bp, Zea mays
  misc_feature: Ceres CLONE 1389240-F
  misc_feature: Encodes the peptide sequence at SEQ ID NO. 20606
  misc_feature (399)..(399): n is a, c, t, g, unknown, or other
  misc_feature (400)..(400): n is a, c, t, g, unknown, or other
  misc_feature (415)..(415): n is a, c, t, g, unknown, or other
tccccgcggtggcggccgctctagaactagtggatcccccgggctgcaggaattcgcacgagaccattacctagaacatcctaatcgaaaaagatctagggttctctcgtgctctgttctcatcttctgctcgctggtgtcccctccctctcacccatggcttcggcggcggcggcaactcaggtggggacttacttcctgcggaactactacaacctgctgcaacaaacccccgatgtcgtccaccagttctacagcgaagccagcaccatggtccgcgtcgacgacctcaccggcacgaccgcggctgccaacaacatgatggacatacactcactcatcatgtctttgaacttcacccaaattgagatcaagactgccaattttgtgactcatggnngcgatggggtgctangtatggtctctggtctagtgcagaccaaggagtacagccaccaaaggaattttatccagatggtcttccttgcccctcagggagaggggtaactttgccctcaacggatactttcaccttcgtggaccaggaaattgggagcctggcgccagggattggctaggaaaaaaaccgaaggcaatttgggcccccaccacggggggggaaaccgctcccggggaccttccccggggaaaaaaccccccaaaaaggcccg

SEQ ID NO: 20606 - protein, 116 aa, Zea mays
  misc_feature: Ceres CLONE 1389240-F
  misc_feature (10)..(114): Pfam Name: NTF2 Pfam Description: Nuclear transport factor 2 (NTF2) domain
  misc_feature (82)..(82): Xaa is any aa, unknown, or other
  misc_feature (87)..(87): Xaa is any aa, unknown, or other
MASAAAATQVGTYFLRNYYNLLQQTPDVVHQFYSEASTMVRVDDLTGTTAAANNMMDIHSLIMSLNFTQIEIKTANFVTHGXDGVLXMVSGLVQTKEYSHQRNFIQMVFLAPQGEG

SEQ ID NO: 20607 - DNA, 687 bp, Zea mays
  misc_feature: Ceres CLONE 1389244-F
  misc_feature: Encodes the peptide sequence at SEQ ID NO. 20608
  misc_feature (405)..(405): n is a, c, t, g, unknown, or other
  misc_feature (427)..(427): n is a, c, t, g, unknown, or other
aaagctggagctccccgcggtggcggccgctctagaactagtggatcccccgggctgcaggaattcgcacgagaccattacctagaacatcctaatcgaaaaatcacactcgccaaccccgtcatcgatctcgtttcaaatccatccatcctcgtttcctccgtcccgcagcatctcaaccccatggccaagatcaagatcgggatcaatgggttcggcaggatcggaaggctggtggccagggtggctctgcagagtgacgatgtcgagctcgtcgccgtgaacgaccccttcatcagcaccgactacatgacctacatgttcaagtacgacactgtacacggacagtggaagcaccatgaagtcaaggtgaaggactccaaaacccttctctttggtgagaangaggttgctgtgtttggctgcnagaaccctgaggagacccgtggggggtcggttggggctgaataggttgttgaggccactggggttttccctgaccaggaaaaggctgcagctcaccttgaagggtggggccaaaaaagtttgcatttccgggtcctaagaagggatgcccccatggttttcccttgggggcacacccaaaaaggagaaacaagctgaaattaaaattgggcccccgggggaggggggaaaaaccaatggggttgtggcccctttggaaag

SEQ ID NO: 20608 - protein, 95 aa, Zea mays
  misc_feature: Ceres CLONE 1389244-F
  misc_feature (4)..(90): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (74)..(74): Xaa is any aa, unknown, or other
  misc_feature (82)..(82): Xaa is any aa, unknown, or other
MAKIKIGINGFGRIGRLVARVALQSDDVELVAVNDPFISTDYMTYMFKYDTVHGQWKHHEVKVKDSKTLLFGEXEVAVFGCXNPEETRGGSVGAE

SEQ ID NO: 20609 - DNA, 689 bp, Zea mays
  misc_feature: Ceres CLONE 1389246-F
  misc_feature: Encodes the peptide sequence at SEQ ID NO. 20610
  misc_feature (143)..(143): n is a, c, t, g, unknown, or other
  misc_feature (144)..(144): n is a, c, t, g, unknown, or other
  misc_feature (160)..(160): n is a, c, t, g, unknown, or other
  misc_feature (166)..(166): n is a, c, t, g, unknown, or other
  misc_feature (264)..(264): n is a, c, t, g, unknown, or other
  misc_feature (289)..(289): n is a, c, t, g, unknown, or other
  misc_feature (290)..(290): n is a, c, t, g, unknown, or other
  misc_feature (355)..(355): n is a, c, t, g, unknown, or other
  misc_feature (415)..(415): n is a, c, t, g, unknown, or other
  misc_feature (417)..(417): n is a, c, t, g, unknown, or other
  misc_feature (422)..(422): n is a, c, t, g, unknown, or other
  misc_feature (615)..(615): n is a, c, t, g, unknown, or other
  misc_feature (632)..(632): n is a, c, t, g, unknown, or other
  misc_feature (633)..(633): n is a, c, t, g, unknown, or other
  misc_feature (641)..(641): n is a, c, t, g, unknown, or other
  misc_feature (642)..(642): n is a, c, t, g, unknown, or other
aagctggagctccccgcggtggcggccgctctagaactagtggatcccccgggctgcaggaattcgcacgagaccattacctagaacatcctaatcgaaaatcccacctcccaactccagaagtcctccctaagaacgccgcnncagccgcgcgcacacnccaccngagagctcctcgggctttctttctccgttcctccctcgcgcgctcagggtttcacgatggaggccgaggcggcggccaagagggcgcgggagggcggngaggacgccaccgcgccggtggcgnnggccgaggcggtggtcgccggtgctggcgagcaggcgggaatctccgccgtcatcccaggatggntctccgagatcagccccatggtggccggtggaggcgcactcctttgaggggggagaaggntnctggntccagggcaagtcagacttaacaaaaaggggatgggtttttccaggcctccacggaccggaaagggggttgggccctccaccggagttatttcggggcacaaaaagggtagaggtggcgctaacaaaaaaagagaaaacccccgggccccttggcccccaaaaaacccccaaaaagggttgttattggggggnaaaaagtgggggggggnntttttttnnaaaaattttacaaaaaatactttcggggggaggaaatattattttta

SEQ ID NO: 20610 - protein, 59 aa, Zea mays
  misc_feature: Ceres CLONE 1389246-F
  misc_feature (23)..(23): Xaa is any aa, unknown, or other
  misc_feature (45)..(45): Xaa is any aa, unknown, or other
MEAEAAAKRAREGGEDATAPVAXAEAVVAGAGEQAGISAVIPGWXSEISPMVAGGGALL

SEQ ID NO: 20611 - DNA, 694 bp, Zea mays
  misc_feature: Ceres CLONE 1389252-R
ccaattgggtaccgggccccccctcgaggtcgacggtatcgataagcttttttttttttttttttgcgtcataaaataaaattattagtatggagccagtgtgatttttcatattgataaatgattgctctgtttcctaactaaaaatcatcttcgctagacctgagaaggaaaaaagatcataatgtaagatacagaaaaaatgcccaacaattttttttacaaatggcaatagctttgacatctgttgtgtgcttgtatacttcagtactggctgtactgaatgtggattccaatcaaaaagctagacaaggggaaccattagtatgggaaaacaacagtgtagagtcctaataatagtgcattccaaactaacagaaacatatcaacagacatcttactcctttctcattgcctctggatgcaagctggaattgtcataagaccacttgagtccacaaaccatagtgccttccaaatacgattgttaaagtggcttcttgaattagatcaatagtgacactaaagttctccatatgtatatccttaacagttggaccaccatcattaccgtgatttacataaacaggaagcattgcaacgctaactgcctccatctccgcgacatgcaattgatattgagccttatcatcacgcttaagtgatgcttcatgcttgaacatggaagtcgcct

SEQ ID NO: 20612 - DNA, 621 bp, Zea mays
  misc_feature: Ceres CLONE 1389255-F
  misc_feature: Encodes the peptide sequence at SEQ ID NO. 20613
tcaccgcggtggcggccgctctagaactagtggatcccccgggctgcaggaattcgcacgagaccattacctagaacatcctaatcaaaaaacacacaaacacatcagcattcagcagtagctaatggagtatcgtcgacttagctcctctccgcttctctccgtcggcgtggaacttctctccgccggctgccatataaaggagaagaagagaacagcaacgctagctagtcggccggcctccatcgccgccggcgtcgactaactagataactctcgatctccagttcctgccccccaactccgtcgacagcgatggcaggaggcctcttctccatggctcatccggtcatcaccgtctccgggatcgcaggaaacatcatctccttcctggtgttccttgcaccagaggcgacgttcctgcaggtgtaccgaaagaagtcgacgggagctttcagctcggtgccgtacgtggagccgctcttaagctcggtgctgtggatcttctacgcgatggtgaagaccaactcgaggccgctgctgaccatcaacagcttcgagtgcggcgtgaagggcgcctacatagtcgtctatctggcgtacgcgacgtgttggacgcgc

SEQ ID NO: 20613 - protein, 102 aa, Zea mays
  misc_feature: Ceres CLONE 1389255-F
  misc_feature (14)..(101): Pfam Name: MtN3_slv Pfam Description: MtN3/saliva family
MAGGLFSMAHPVITVSGIAGNIISFLVFLAPEATFLQVYRKKSTGAFSSVPYVEPLLSSVLWIFYAMVKTNSRPLLTINSFECGVKGAYIVVYLAYATCWTR

SEQ ID NO: 20614 - DNA, 674 bp, Zea mays
  misc_feature: Ceres CLONE 1389265-F
  misc_feature: Encodes the peptide sequence at SEQ ID NO. 20615
  misc_feature (512)..(512): n is a, c, t, g, unknown, or other
  misc_feature (541)..(541): n is a, c, t, g, unknown, or other
  misc_feature (542)..(542): n is a, c, t, g, unknown, or other
  misc_feature (544)..(544): n is a, c, t, g, unknown, or other
  misc_feature (545)..(545): n is a, c, t, g, unknown, or other
  misc_feature (547)..(547): n is a, c, t, g, unknown, or other
  misc_feature (548)..(548): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (563)..(563): n is a, c, t, g, unknown, or other
  misc_feature (569)..(569): n is a, c, t, g, unknown, or other
aaagtggagctccccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggttcggtccttcttctcgcgctcccgcagcggcaagcgcggcagcgcccggagagcaggctcgtcctcgccgcactcctccgcggccagcgcgccgccgtccccgtccccactcccgaggaggtcaccgtcgtcgtcgtcaaccacaaccagggacgagacggagcgcgtgttccgcaagttcgacgcgaacggcgacgggcagatctcgcggtccgagctggcggcgctgttcgagggcgtgggccacgccgtgaccgacgacnagggtccgatgatgggaaaggaagggcgnncnncnnannnnnnnnnnnttncatcanccctgccccgagtttcgcccgcgctcatgggagtcccgcgttccggccgaacgcccgccgcccgtccgaggaaggaccctgccgcccacgcccttcaattggccg

SEQ ID NO: 20615 - protein, 145 aa, Zea mays
  misc_feature: Ceres CLONE 1389265-F
  misc_feature (56)..(84): Pfam Name: efhand Pfam Description: EF hand
  misc_feature (92)..(92): Xaa is any aa, unknown, or other
  misc_feature (102)..(102): Xaa is any aa, unknown, or other
  misc_feature (103)..(103): Xaa is any aa, unknown, or other
  misc_feature (104)..(104): Xaa is any aa, unknown, or other
  misc_feature (105)..(105): Xaa is any aa, unknown, or other
  misc_feature (106)..(106): Xaa is any aa, unknown, or other
  misc_feature (107)..(107): Xaa is any aa, unknown, or other
  misc_feature (108)..(108): Xaa is any aa, unknown, or other
  misc_feature (109)..(109): Xaa is any aa, unknown, or other
  misc_feature (111)..(111): Xaa is any aa, unknown, or other
MGKVRSFFSRSRSGKRGSARRAGSSSPHSSAASAPPSPSPLPRRSPSSSSTTTRDETERVFRKFDANGDGQISRSELAALFEGVGHAVTDDXGPMMGKEGRXXXXXXXXSXLPRVSPALMGVPRSGRTPAARPRKDPAAHALQLA

SEQ ID NO: 20616 - DNA, 638 bp, Zea mays
  misc_feature: Ceres CLONE 1389267-F
  misc_feature: Translation starting site: 212
  misc_feature (415)..(415): n is a, c, t, g, unknown, or other
  misc_feature (557)..(557): n is a, c, t, g, unknown, or other
  misc_feature (638)..(638): n is a, c, t, g, unknown, or other
aaagctggagctccccgcggtggcggccgctctagaactagtggatcccccgggctgcaggaattcgcacgagaccattacctagaacatcctaattgaaaaacacaccacagttagcttcctttcaattattgtatttcagtcgagttgctaaacaacacgaactcctcagtcgtttgagttttgaggaggcaagcaagaggacccatcgatggcctccttgaaggaccactgtgccgtggtggcagttgtagtggcgatctgcttcgtcgtcctcgccgccgccctcccttcgcacgcgtcgacggcggtggacgagccggcgaagtataagcccagcagagcgccagcgccgtcccctgcatctgcatcatcctacgtcccgccgccggtccagcccgtgatcgtcgtccanggcgtcatctactggcagtccctgcagctcaggggctacaacagcggcatggacgcgtcccctctccccatgcgacggcgagcctggtgtgctacggcgacgcggagagcaagtaccgggtgctgaaccagacgagcacggncaccgacacgaacggctacttcatcgtgatggtgtacgacgtgggcatggtcgacccgcgcagctgcagctgtactcgtcn

SEQ ID NO: 20617 - DNA, 688 bp, Zea mays
  misc_feature: Ceres CLONE 1389283-F
  misc_feature: Encodes the peptide sequence at SEQ ID NO. 20618
  misc_feature (261)..(261): n is a, c, t, g, unknown, or other
tggagctccccgcggtggcggccgctctagaactagtggatcccccgggctgcaggaattcgcacaagaccattacctagaacatcctaatcgaaaagtctgtctgtctgcctccctccgctcacctcctctgcttcttctcgctttcttccatcttggtccagcctccactcttcctgctgagccatggcggctgccgaagaagggccagagccactcaggtatcagactctggccctgagggtgagcatccactgcganggttgcaagaagaaggtgaaagaggtgctccacagcatagaagggggtgtacaagacggacatagacacgcagcagcagaaaggtggtgggtcatagagcacgtctctgcagacgggctcgtcaagaaactcctcaaggtcgggaagcacgcgcgaggcctgggcccggaacctggtccaggcccaaacgggcggcgacaggcccgccgggggcccaaagggatctcccggggagggccaggggaaaaaaaaaaaaaaaaaaagaaaggggcaacccgaagaccccggggggggggggaaaaaaaaaaccccgcccaatttcgggggccccggggcccgcggcccgcggccgggggggagaggaaaaaggggggggccccaaccccccgggggaagcaacgaaaaagggtgtagcggggggcggccc

SEQ ID NO: 20618 - protein, 162 aa, Zea mays
  misc_feature: Ceres CLONE 1389283-F
  misc_feature (25)..(25): Xaa is any aa, unknown, or other
MAAAEEGPEPLRYQTLALRVSIHCXGCKKKVKEVLHSIEGGVQDGHRHAAAERWWVIEHVSADGLVKKLLKVGKHARGLGPEPGPGPNGRRQARRGPKGISRGGPGEKKKKKKKGATRRPRGGGEKKNPAQFRGPRGPRPAAGGERKKGGAPTPRGKQRKRV

SEQ ID NO: 20619 - DNA, 686 bp, Zea mays
  misc_feature: Ceres CLONE 1389289-F
  misc_feature: Encodes the peptide sequence at SEQ ID NO. 20620
gctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgacgacgagatcactggtcggttggcgtacgacgacacatgggtaagggtagtgtgggtgcatcatggtgggcgttcctcctgctcgccggcgtgctgctggtcgtagcagccacgcacggagagcagcgacgtcagaggacgatcgtcaccgagagcttgtacctgcgaggactacatacaggcacgtcacctggcgatgacgattgaggcacctaccgcgactacagtgaatcgtcacagcgtaatgatcgtgacctgccaccactcaagtatgactcgccaggagcgactgcggacgtgccattttgggatcgtggacctcctgggggatcgggacagagtgggaccctgtgtccgttttgaagacaggagccaagggtttggaggacaggggttgaatacccggggagggcccttcggggggttcccgggggacttttgtggcccacaaaagggggacctccccggtgaacgcccccattcttgtcgggcgtgatcggccaaggacgtggtctatgccccccctcgcccatgtc

SEQ ID NO: 20620 - protein, 56 aa, Zea mays
  misc_feature: Ceres CLONE 1389289-F
MGKGSVGASWWAFLLLAGVLLVVAATHGEQRRQRTIVTESLYLRGLHTGTSPGDDD

SEQ ID NO: 20621 - DNA, 674 bp, Zea mays
  misc_feature: Ceres CLONE 1389292-F
  misc_feature: Translation starting site: 336
  misc_feature: SWISSPROT Homolog: EC 6.3.2.19 Ubiquitin--protein ligase
  misc_feature (664)..(664): n is a, c, t, g, unknown, or other
ggagctccccgcggtggcggccgctctagaactagtggatcccccgggctgcaggaattcgcacgagaccattacctagaacatcctaatcgaaaaaccgccgcctcttccgccttgcacggttcccccaactcccttctccgacggccactgcccaccgtcacagcagaagctcctccggtcctcccttctctccgtagaaacatttcccgacgggtgtttcccacgccggaatggaccagccggcaccataagcccaagattcgtttgcattcagtaatgcctttgcctaaatcagacctggggtcataactctttagtagagaaccaagaagatgcaggcatctagggcaaggcttttcaaggagtacaaggaggtacagcgagagaagtcagctgaccctgatatccaattaatatgtgatgattctaacatattcaagtggactgctcttatcaagggcccttctgaacaccttatgagaagggtggtgtgtttcaacttgcattcgcatttccagagcagtatcctctgtggcctcctccaggtttcgatttttgaccaaaactttccacccaaatgtgcatttcaagaaagggtggaagatttgtcctgattattattggaagaatgcatggagccctaatgggacccctttccagncctggtttga

SEQ ID NO: 20622 - DNA, 638 bp, Zea mays
  misc_feature: Ceres CLONE 1389294-F
  misc_feature: Translation starting site: 208
  misc_feature: Pfam Name: OTU Pfam Description: OTU-like cysteine protease
  misc_feature (330)..(330): n is a, c, t, g, unknown, or other
  misc_feature (638)..(638): n is a, c, t, g, unknown, or other
gctctagaactagtggatcccccgggctgcaggaattcgcacgagaccattacctagaacatcctaatcgaaaactccgctgccctcctcgcctccctcgattcaggattcagcgaattcggacagaacccggcgtgtccgtgtcgaccgacccctccccctgcgagtctgcgacgagtctcctgccgctcttcccggccgggcgaaatggacggtgtcgttgtcaggagggtcattccttcggataacagttgcctcttcaacgctgtgggctacgtgatggagcacaaccgaaataaggcttctgagctcagacaggtcatagcagcnaacagtcgctggtgatcctgagaaattcaatggaggtgtttcttggcaaacaaatgaagcgtattgtgcttgggattttggatcctgaaaagtggggaggagccattgagctctctattctatccgaatactacgggcgtgaaatcgcagcatatgacattcagaccaccccgctgtgatctctatggtcaggagaaagattacaggtgaaagggcatgctcaatttaatgatggttgggtttatggtgctctccctatgtctcccgggtgagggggcacctggaaaaatttgacccagacatccttn

SEQ ID NO: 20623 - DNA, 619 bp, Zea mays
  misc_feature: Ceres CLONE 1389298-F
  misc_feature: Encodes the peptide sequence at SEQ ID NO. 20624
  misc_feature (135)..(135): n is a, c, t, g, unknown, or other
  misc_feature (316)..(316): n is a, c, t, g, unknown, or other
  misc_feature (383)..(383): n is a, c, t, g, unknown, or other
ccccgcggtggcggccgctctagaactagtggatcccccgggctgcaggaattcgcacgagaccattacctagaacatcctaatcgaaaaacatcccaattggaagggcagctaataaggtaaggggcgacgaanatggctccaacgaccgccaccaaggacgacagtggctacggcgacgagcgccggcgcgagctgcaggcgttcgacgacacgaagctgggggtgaaaggtctgggtggactccggcgtcaagtccatcccggtccatcttccaccacccgccggaagccctgagcgacataatttctccggngcctctggcgccgtcgccgcccctccggggccgcaatccccgggggtggaactctgcggggacccgncggccaggacctagtcgagcaagtggaggaaggcggccggggacgggggtccttctccggggggggagaaccccgggggggcggggggggctgacgggccccaacgcttccgggtggcacggaaagggacccggcggcccggagggtgtggttgccctcgccggcgcgcccgaggcgccggggggcaaaccggaatggcgaccggcccgagcagcgttgtgccgcgcggcgggggg

SEQ ID NO: 20624 - protein, 53 aa, Zea mays
  misc_feature: Ceres CLONE 1389298-F
MAPTTATKDDSGYGDERRRELQAFDDTKLGVKGLGGLRRQVHPGPSSTTRRKP

SEQ ID NO: 20625 - DNA, 726 bp, Zea mays
  misc_feature: Ceres CLONE 1389300-F
  misc_feature (124)..(124): n is a, c, t, g, unknown, or other
  misc_feature (378)..(378): n is a, c, t, g, unknown, or other
  misc_feature (381)..(381): n is a, c, t, g, unknown, or other
  misc_feature (385)..(385): n is a, c, t, g, unknown, or other
  misc_feature (387)..(387): n is a, c, t, g, unknown, or other
  misc_feature (388)..(388): n is a, c, t, g, unknown, or other
  misc_feature (401)..(401): n is a, c, t, g, unknown, or other
  misc_feature (402)..(402): n is a, c, t, g, unknown, or other
  misc_feature (419)..(419): n is a, c, t, g, unknown, or other
  misc_feature (420)..(420): n is a, c, t, g, unknown, or other
  misc_feature (424)..(424): n is a, c, t, g, unknown, or other
  misc_feature (432)..(432): n is a, c, t, g, unknown, or other
  misc_feature (433)..(433): n is a, c, t, g, unknown, or other
  misc_feature (439)..(439): n is a, c, t, g, unknown, or other
  misc_feature (452)..(452): n is a, c, t, g, unknown, or other
  misc_feature (466)..(466): n is a, c, t, g, unknown, or other
  misc_feature (508)..(508): n is a, c, t, g, unknown, or other
tggagctccccgcggtggcggccgctctagaactagtggatcccccgggctgcaggaattcgcacgagaccattacctagaacatcctaatcgaaaaccccgtccgtccgtccgtccctcaccntcggcccgcctccctcatcaggtagccgtagcgagcagtatagcacgcacagccgccgccctgccctgccctgctcggcgtaggcacaggcacagcccagagcgagcgagacagagggaaagagacagagccagccaggtaaaaggcaaaagcacagcacattaaaagagaggccggaagcagcggcagagcggagagagagagagagaactagaagcatatatggcgatgccctttgcctccctgtctccggnagncgancnnacgcccctcctcnnctctcccctaatggcgnngcgnccctctcnntcgggntgggagaggacgnccgccgcgccaggncgcaggcgcaacaccagaagcacgcttaaacgggaggtgggncaacaaagccccccccgcctcttcaaagggggggaaataagagggagttggagcacccggggctttatataaaaaaacccctgtcccccggggggggcccgttcccgccgaacccccctccccccctaaaagggaagggtttgtttaaaccaaaacccgcgcgatttgtgtataaagggggggaaaattctttgtgggaaagaaaacccacccttttt

SEQ ID NO: 20626 - DNA, 723 bp, Zea mays
  misc_feature: Ceres CLONE 1389304-F
  misc_feature: Encodes the peptide sequence at SEQ ID NO. 20627
  misc_feature (485)..(485): n is a, c, t, g, unknown, or other
  misc_feature (580)..(580): n is a, c, t, g, unknown, or other
  misc_feature (593)..(593): n is a, c, t, g, unknown, or other
  misc_feature (635)..(635): n is a, c, t, g, unknown, or other
  misc_feature (663)..(663): n is a, c, t, g, unknown, or other
  misc_feature (664)..(664): n is a, c, t, g, unknown, or other
  misc_feature (700)..(700): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccggnaggggcgagtgccggcgccagtgcctgcgccgccacgagggccagccgtgggagacccaggagtgcatgaggcggtgccgccgccgcggactggncgtcgacatggangcaagagtacggtcgcggcagcgagagcgcgggcagtggccngggagaggtgcgagcgccccaccgcggnngacttggtgggagaggcagcgctgcctgatgactgnaaaaaaccgggaaccggaaagga

SEQ ID NO: 20627 - protein, 171 aa, Zea mays
  misc_feature: Ceres CLONE 1389304-F
  misc_feature (124)..(124): Xaa is any aa, unknown, or other
  misc_feature (128)..(128): Xaa is any aa, unknown, or other
  misc_feature (152)..(152): Xaa is any aa, unknown, or other
  misc_feature (164)..(164): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETQECMRRCRRRGLXVDMXARVRSRQRERGQWPGRGASAPPRXTWWERQRCLMTXKNREPER

SEQ ID NO: 20628 - DNA, 742 bp, Zea mays
  misc_feature: Ceres CLONE 1389305-F
  misc_feature: Pfam Name: Malic_M Pfam Description: Malic enzyme, NAD binding domain
  misc_feature: SWISSPROT Homolog: EC 1.1.1.40 Malate dehydrogenase (oxaloacetate-decarboxylating) (NADP(+))
  misc_feature (314)..(314): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
cacccgcggtggcggccgctctagaactagtggatcccccgggctgcaggaattcgcacgagaccattacctagaacatcctaatcgaaaaagttctgattgggacgtctggagttggaagaacattcacaaaagaagttgttgaggccatggcttccttcaatgagaggcctatcatcttttcactgtcaaatccaacctctcattctgaatgtactgctgaagaacatataactggactcagggtcgtgtaatattttgccagtggcagtccatttgaccctgtggaggacgatggggaaggttttttggtnttnnnccccccccctcctcggtttttggtgggggcgcggccccaaaaccccccagcgggggggcccccccccgtccaaaaaaaaaaaagaaacgggccccctaaaaaattttttttttccccccggggggaatttgttggggcccccctccggggggtccttttgggcaaaaaaaccccccccggggggaagggccccaattaccccccggtggggctcccctccccccgggagaggggacaacgtgtggtttttttttttgtgggccgcgcccgccccccgcgggaaaaaagcaaaaataaaaagcttttgtgcggcttcacgggggggccccaccaacccagagggggggaaaaaaatttttttccaaaacaaaaaggggggggaaaacaaaaaaattttttttctcccgccgcgcccctcttttt

SEQ ID NO: 20629 - DNA, 726 bp, Zea mays
  misc_feature: Ceres CLONE 1389309-F
  misc_feature: Encodes the peptide sequence at SEQ ID NO. 20630
  misc_feature (703)..(703): n is a, c, t, g, unknown, or other
ggagctccccgcggtggcggccgctctagaactagtggatcccccgggctgcaggaattcgcacgagaccattacctagaacatcctaatcgaaaaatctccagcagcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatggagaggaggatcatattgaaggcttttggtgctgaacttgtccttactgacccactcctgggaatgaaaggagctgtcaagaaagcggaagagatacaagcaaagacacccaactcttacatccttcaacaatttgaaaatccagctaacccaaagattcactatgagactactgggcctgaaatctnggaagtacagcagaaaaattgat

SEQ ID NO: 20630 - protein, 175 aa, Zea mays
  misc_feature: Ceres CLONE 1389309-F
  misc_feature (12)..(176): Pfam Name: PALP Pfam Description: Pyridoxal-phosphate dependent enzyme
  misc_feature: SWISSPROT Homolog: EC 2.5.1.47 Cysteine synthase
  misc_feature (169)..(169): Xaa is any aa, unknown, or other
MGEASPSIAKDVTELIGNTPLVYLNKVTEGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIXEVQQKN

SEQ ID NO: 20631 - DNA, 563 bp, Zea mays
  misc_feature: Ceres CLONE 1389311-F
  misc_feature (370)..(370): n is a, c, t, g, unknown, or other
  misc_feature (375)..(375): n is a, c, t, g, unknown, or other
  misc_feature (396)..(396): n is a, c, t, g, unknown, or other
  misc_feature (400)..(400): n is a, c, t, g, unknown, or other
  misc_feature (402)..(402): n is a, c, t, g, unknown, or other
  misc_feature (404)..(404): n is a, c, t, g, unknown, or other
  misc_feature (405)..(405): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (440)..(440): n is a, c, t, g, unknown, or other
aagctggagctccccgcggtggcggccgctctagaactagtggatcccccgggctgcaggaattcgcacgagaccattacctagaacatcctaatcgaaaaaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaaaacaaacccgcgttggatcctgtatcggttagtccttgccttncaggntcatggttgttttgtttttgnggtncnannatcnnnatgttctgcttctggttccagatctgganaaaaatttctaggccggcgtccggccgcggcggttcgggttcggaagcggaatttgaaggccaccaatgccttgcaagcccgcgggcacttgcgggggggggggcgggccgggcttccccccg

SEQ ID NO: 20632 - DNA, 776 bp, Zea mays
  misc_feature: Ceres CLONE 1389313-F
  misc_feature: Translation starting site: 171
  misc_feature (336)..(336): n is a, c, t, g, unknown, or other
  misc_feature (337)..(337): n is a, c, t, g, unknown, or other
  misc_feature (358)..(358): n is a, c, t, g, unknown, or other
ggagctccccgcggtggcggccgctctagaactagtggatcccccgggctgcaggaattcgcacgagaccattacctagaacatcctaatcgaatacccagcaacagccaacatatctcctcgcattttccttgcaaccgattgcctatccccctcccaacccaagaccgatggcgcccaaggccgagaagaagcccgcggcgaagaagccggcggaggaggagcccgcggcggagaagacgaccgccgggaagaagcccaggcggagaaagcggtccccgcgggcaagtccgcccggcaggagggcgccgagggcaagcgtggcaagaagaaggnncagaagagcgtggagacgtancagatctacttcttcaagtgctgaagcaggtggacccggacatcggcatctccttcaaggccatgtccatcatgaacttctttatttaagaaattttcaaaaacctggccgggaaaacccccaaagttccccggttaaaaaaaaaagccccccctcccgttgcgcggaaaaacaaaacctcgggggcctttggggtccccggggggttctcccaaaaacccctttttggagggcaaagggcgcccccaaagttccccccccccaaaggggggcgcccccccttttggaggttcccgggggggggggccccccccgggggaagaaaaaaagggggggggtttttcgggggggggtgttttttttttggaggaggcggtgtgggacaccaccaggagtggtgttttttttgggaccccac

SEQ ID NO: 20633 - DNA, 732 bp, Zea mays
  misc_feature: Ceres CLONE 1389319-F
  misc_feature: Encodes the peptide sequence at SEQ ID NO. 20634
  misc_feature (635)..(635): n is a, c, t, g, unknown, or other
  misc_feature (654)..(654): n is a, c, t, g, unknown, or other
aaagctggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcttctcctccttcccccgggcgctcccgccgccgccgccctgggcgcgcatcacctcgccagcctccacctccggggccctacctacctctgagatcgaggagcggctcgccggggtgcccgtgtacgcgctcgccaacgccgcccaggagttcgtgcttgtgtcgtccacacgcgtgggagggcaagggggcgagagcgtgagtccaacgccggcgctcgggctgctctgcttccggaaggaagatgctgacgcgctgctggaggcagatggatggcgatatgcgcgccgccctctggntgtcgttcctgtcgcgctngaacaggtatccaatggaagtcggattgggtgtgggcgtttaagattccctcctgattcatctcaggtggtaaaaggg

SEQ ID NO: 20634 - protein, 176 aa, Zea mays
  misc_feature: Ceres CLONE 1389319-F
  misc_feature (144)..(144): Xaa is any aa, unknown, or other
MPFRFQFPWLKNPTTNGGTSNIDTNPSPRFPNPFLPIQAHVTSFFSSFPRALPPPPPWARITSPASTSGALPTSEIEERLAGVPVYALANAAQEFVLVSSTRVGGQGGESVSPTPALGLLCFRKEDADALLEADGWRYARRPLXVVPVALEQVSNGSRIGCGRLRFPPDSSQVVKG

SEQ ID NO: 20635 - DNA, 727 bp, Zea mays
  misc_feature: Ceres CLONE 1389320-F
  misc_feature: Encodes the peptide sequence at SEQ ID NO. 20636
  misc_feature (448)..(448): n is a, c, t, g, unknown, or other
tggagctccccgcggtggcggccgctctagaactagtggatcccccgggctgcaggaattcgcacgagaccattacctagaacatcttaatcgaaaaaacaccgccctcttgtgctctccctgtccctgccctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcaccgtgacgaagaaggccaccacgcccttcgacggccagaagcccggcacctccggcctccgcaagaaggttactgtattccagcagccccattatctgcagaactttgtccaatcaacattcaatgcccttcctgtgnatcaagtaagaggtgcaacaaatgttgtctctggtgatggccgctattcctcaaagatgctgttcagatcaaaccaaaaatgctgctgccatggagaaaaacggggttgggttggaaaaaaaagccccatgccacccctggtggatccgctggcatccggaaaaaattggggaaaaaggaataaagggtacgggggcccttccttttggagggggcccaaaaccccagggggcccaaaggggggactccgggaacaaaaaacaagggggaaaaaggggg

SEQ ID NO: 20636 - protein, 143 aa, Zea mays
  misc_feature: Ceres CLONE 1389320-F
  misc_feature: SWISSPROT Homolog: EC 5.4.2.2 Phosphoglucomutase
  misc_feature (51)..(51): Xaa is any aa, unknown, or other
MGLFTVTKKATTPFDGQKPGTSGLRKKVTVFQQPHYLQNFVQSTFNALPVXQVRGATNVVSGDGRYSSKMLFRSNQKCCCHGEKRGWVGKKSPMPPLVDPLASGKNWGKRNKGYGGPSFWRGPKTPGGPKGGLREQKTRGKKG

SEQ ID NO: 20637 - DNA, 738 bp, Zea mays
  misc_feature: Ceres CLONE 1389325-F
  misc_feature: Encodes the peptide sequence at SEQ ID NO. 20638
  misc_feature (623)..(623): n is a, c, t, g, unknown, or other
  misc_feature (649)..(649): n is a, c, t, g, unknown, or other
  misc_feature (701)..(701): n is a, c, t, g, unknown, or other
  misc_feature (738)..(738): n is a, c, t, g, unknown, or other
ggagctccccgcggtggcggccgctctagaactagtggatcccccgggctgcaggaattcgcacgagaccattacctagaacatcctaatcgaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacgtacccgctaacttgctcgtgctttgatcgggttgagcgctgctccgacgcctgtaaggagtgcgtggaaacggaggactcgcgccacgtctgcgtcgacaggtaccgtggcgaccccgggcccaggtgcccacgacgagacgggaggagcgtcggacccgctgacgacgacgctggtgggcaagcgacgccgacggcagtgatggcagatgacnagaaagcagccggcggcgacgagacnagaagaagagggcgtgaaaatgctgcgacgtgccatctgcacagtctggggncctcccggtggccgctgcgcgaaaccccggggaacgn

SEQ ID NO: 20638 - protein, 185 aa, Zea mays
  misc_feature: Ceres CLONE 1389325-F
  misc_feature (148)..(148): Xaa is any aa, unknown, or other
  misc_feature (174)..(174): Xaa is any aa, unknown, or other
MAMGAASILLMMVSLEALLLAAAAGGGTIRLPSDVGGVAADLVTAMARARARAKHQLRDEERPWGECCDLAVCVKTYPLTCSCFDRVERCSDACKECVETEDSRHVCVDRYRGDPGPRCPRRDGRSVGPADDDAGGQATPTAVMADDXKAAGGDETRRRGRENAATCHLHSLGXSRWPLRETPGN

SEQ ID NO: 20639 - DNA, 719 bp, Zea mays
  misc_feature: Ceres CLONE 1389327-F
  misc_feature: Translation starting site: 210
  misc_feature: Pfam Name: A1pp Pfam Description: Appr-1-p processing enzyme family
  misc_feature (453)..(453): n is a, c, t, g, unknown, or other
tccccgcggtggcggccgctctagaactagtggatcccccgggctgcaggaattcgcacgagaccattacctagaacatcctaatcgaaaaaatgtcgcgtgcggccactagatttttcctgacgcggtgtctgctcccacttcccctcctctcccccaggtggcggcagcggcggcggggtagcatttgtgctacgagggcttttgcaatggcggcttcggggttcggcggcggcgaggcgttccggctctcggccgcgccgggggccggcttactgaagctgcacaagggcgacatcaccctctggtccgtcgactgcgccaccgacgccatcgttaatgctgctaatgagcgaatgttaggtgggcggaggtgttgatggagctatacatcaagctgctggaccagagctagtgcaagcatgccggaaagttccagaggtcaaaccaggnagtccgttgtcctactggagaagctaggattactcctgcttttgagcttctggcctctcgggtgattcacactgttggccctatatatgatttggacagcattcctggagtgtcattaaagaaggctatgaaaatagccttgagcttgctaggataatggcatcaggacctcgcatcctggaataactgtggggggggttatcggtatcccccaaggagatccaaaaatagtgttctaccgcacaaaatttttcgggggatatccg

SEQ ID NO: 20640 - DNA, 822 bp, Zea mays
  misc_feature: Ceres CLONE 1389329-F
  misc_feature: Encodes the peptide sequence at SEQ ID NO. 20641
  misc_feature (239)..(239): n is a, c, t, g, unknown, or other
  misc_feature (240)..(240): n is a, c, t, g, unknown, or other
  misc_feature (268)..(268): n is a, c, t, g, unknown, or other
  misc_feature (484)..(484): n is a, c, t, g, unknown, or other
  misc_feature (485)..(485): n is a, c, t, g, unknown, or other
  misc_feature (562)..(562): n is a, c, t, g, unknown, or other
  misc_feature (567)..(567): n is a, c, t, g, unknown, or other
  misc_feature (569)..(569): n is a, c, t, g, unknown, or other
  misc_feature (573)..(573): n is a, c, t, g, unknown, or other
  misc_feature (575)..(575): n is a, c, t, g, unknown, or other
  misc_feature (578)..(578): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (586)..(586): n is a, c, t, g, unknown, or other
  misc_feature (601)..(601): n is a, c, t, g, unknown, or other
  misc_feature (806)..(806): n is a, c, t, g, unknown, or other
  misc_feature (807)..(807): n is a, c, t, g, unknown, or other
aaagctggagctccccgcggtggcggccgctctagaactagtggatcccccgggctgcaggaattcgcacgagaccattacctagaacatcctaatcgaaaaatcacactcgcgaaccccgtcatcgatctcgtttcaaatccatccatcctcgtttcctccgtcccgcagcatctcaaccccatggccaagatcaagatcgggatcaatgggttcggcaggatcggaaggctggtggnncaggtggccctgcagagtgacgatgtcnagctcgtcgccggggacgaccccttcatcagcacggactacatgacctacttgttcaaggacgaacctgtggacgggaagggggaaagcccatgaagtccaggggaaggggctcccaaacccttttcttttggagaaaaaggaggtttcttgtttttttttttcaaaaaacccgaagggaaaccccggggtcccctaggtcacaaaaaaaattttnnttccagaaattgggcctttttcggagtaaggacaagagagccggcacgtctggggggtctggtctcagttatgcgcnttctncntaananccntnnnnngncgggccacaccctangctacatcaaaaaaggaggagaatccgagaagaccgatatggggcaaggaccaccccccgcccagcaacgcaagcttggatgacggatatgccgtagccccctcacgaggtgacacagcgccggtcggcgcgcgccagagaagtgagcgaagggagtatatgaactttcctcccccccccccagtaaggcgtatcgcggcagggnnagaagggtcgtgcgc

SEQ ID NO: 20641 - protein, 59 aa, Zea mays
  misc_feature: Ceres CLONE 1389329-F
  misc_feature: SWISSPROT Homolog: EC 1.2.1.12 Glyceraldehyde-3-phosphate dehydrogenase (phosphorylating)
  misc_feature (19)..(19): Xaa is any aa, unknown, or other
  misc_feature (29)..(29): Xaa is any aa, unknown, or other
MAKIKIGINGFGRIGRLVXQVALQSDDVXLVAGDDPFISTDYMTYLFKDEPVDGKGESP

SEQ ID NO: 20642 - DNA, 639 bp, Zea mays
  misc_feature: Ceres CLONE 1389330-F
ggagctccccgcggtggcggccgctctagaactagtggatcccccgggctgcaggaattcgcacgagaccattacctagaacatcctaatcgaaaactccactcctcctcctctctctctccacatttcctctcccgataagagtgaggcctcggctaagcttgagcttcccctccctcccctccagcgctccagctcccctccatcctcggccaaaaattctgcggcgagctccgatccggtccgactactaacccacgccgcagaagccgcgcgacctgatcgcgcgggggtcgaggagaggggaagcgcggcgccgcggttgcctgccaccgtaccgccgcaggagaaggaagaggagcccgtatccctccgccccgctgcccgccggaccgatggactccgagcactggatctcgcgcctgggccccccccgaaaccgtttttaaaggggggggaaatttggggcccaaaaaaaaaaaaaggccccccagggtggggaaaagtttggttagagattaagggggggggggggccgaattcccccccccccctttgtaagaaaacaaaccaggtttcccccccccccccccccggggggggaaagaaaacccttaaaaaaaaaaagggggggggggg

SEQ ID NO: 20643 - DNA, 719 bp, Zea mays
  misc_feature: Ceres CLONE 1389331-F
  misc_feature: Encodes the peptide sequence at SEQ ID NO. 20644
  misc_feature (480)..(480): n is a, c, t, g, unknown, or other
  misc_feature (481)..(481): n is a, c, t, g, unknown, or other
  misc_feature (567)..(567): n is a, c, t, g, unknown, or other
tggagctccccgcggtggcggccgctctagaactagtggatcccccgggctgcaggaattcgcacgagaccattacctagaacatcctaatcaaaaaagactcaagggccaaggcagggcactgcactgcacgcatgcactgacctgacgacgcgcgccacagtccactccacactcaggcatggcaatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtgggggggaatgctgcgacttggccgtatgcgtcaagacgtacccgctaacttgctcgtgcttttgaatcgggttgagcgctgctccgacgcctgtaaaggagtgcgtgnnaaacggaggactcgcgccacgtctgcgtcgacaggtaccgtggcgaccccgggcccaggtgccacgacgaggacgggaaggagcgncgaacccgctgacgacgaacgctggtgtgcaagcgacgccgacgggcagtgatggcagatgaccagaaagcaggcggcggcgacgacgacaaaaagaagaggccgtggaaaatgctgcgacgtgccattctgcacaggtctgggggcctcgg

SEQ ID NO: 20644 - protein, 145 aa, Zea mays
  misc_feature: Ceres CLONE 1389331-F
  misc_feature (100)..(100): Xaa is any aa, unknown, or other
  misc_feature (129)..(129): Xaa is any aa, unknown, or other
MAMGAASILLMMVSLEALLLAAAAGGGTIRLPSDVGGVAADLVTAMARARARAKHQLRDEERPWGGMLRLGRMRQDVPANLLVLLNRVERCSDACKGVRXKRRTRATSASTGTVATPGPGATTRTGRSXEPADDERWCASDADGQ

SEQ ID NO: 20645 - DNA, 706 bp, Zea mays
  misc_feature: Ceres CLONE 1389334-F
  misc_feature (376)..(376): n is a, c, t, g, unknown, or other
  misc_feature (384)..(384): n is a, c, t, g, unknown, or other
  misc_feature (395)..(395): n is a, c, t, g, unknown, or other
  misc_feature (431)..(431): n is a, c, t, g, unknown, or other
  misc_feature (458)..(458): n is a, c, t, g, unknown, or other
aaagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgntccctccnacatcatcagncctattacatcagttacctttggtgcatttattggncacaaacatcagggcacaacaactacnacaacttgtgctagcaaaaccttgctgcctactctcaagaaaaaggaagtttcttcccatttcaaccaactaagctggcatggaactctgctccttatttgaaacaacacaattacatttcagcaggtaccgggttgctacccccagaaatttcttccattcaacaattggaaacatggaactcccctgtttttttccgggggaaaaaattataccctttccccccttttgtgggggggacccccctc

SEQ ID NO: 20646 - DNA, 725 bp, Zea mays
  misc_feature: Ceres CLONE 1389335-F
  misc_feature (234)..(234): n is a, c, t, g, unknown, or other
  misc_feature (235)..(235): n is a, c, t, g, unknown, or other
  misc_feature (241)..(241): n is a, c, t, g, unknown, or other
  misc_feature (242)..(242): n is a, c, t, g, unknown, or other
  misc_feature (249)..(249): n is a, c, t, g, unknown, or other
tggagctccccgcggtggcggccgctctagaactagtggatcccccgggctgcaggaattcgcacgagaccattacctagaacatcctaatcgaaaaatcagaggccacaaacctcaccccacctatattatcccgtgccccttgtctttcttcctccacaagcagcgaaatccaatctagaagcgcccctctccctctctctctctctcttcgccgtccgaagctccgcaccnnccaatnnctaaatncgggaaacaacccccctcggccgaaaaagggggcccgcaaagggtcttttcccccgggggggggaaactgggggaaaaagggggcgggggggggacaccccccccgagttttcgggggggggggggggaaaaaagtattttttttccccccccaccaaagacacatcctgggggcccccacctggtgggccgcgtgccggcggcccagtgggggttgtcgggcgggggggcacggggggaggggggattcggccgggggacgcgggtgggccgtaacgcccgggggaccagggggggacgacgaccggacgcgggggggagcggcggggggtggcggggcgagggtggggcggaatggggttggccggctgcgggtgttaggtgggggcatggcggggcgggggtaacgcgggcggggcgcgccggtccgtgacaacaaggatggggcggggtggcgagtgggatggagtctggtg

SEQ ID NO: 20647 - DNA, 732 bp, Zea mays
  misc_feature: Ceres CLONE 1389337-F
  misc_feature: Encodes the peptide sequence at SEQ ID NO. 20648
tggagctccccgcggtggcggccgctctagaactagtggatcccccgggctgcaggaattcgcacgagaccattacctagaacatcctaatcgaaaaaactaatccagatctcgaaatcggccgcgctcaaataggcattatcgaacagaacagtatgaagatgcccatcgttctcctcgtgtgcctgactctgtcagctgccaacgcctctgctgtgcagatgccctgcccctgtgcgcagctgcaggactatgtacggggctgacgacggcctgacgacgatgatggtcgcgcccgtgctgtacccctacgcggattacatgacgcagcccaagtgcactgcgatgttgctcacgccctactacgccttctgtgatgagatgagcgccatgtaccagccgatccgggagacgcgctgactccagcagaagaggatggatgatctgaatgccatactgcagatgctgcagataatgatgatgattgatcgtgcaatgaccgcagcagtatcctgtacgagcccgctctgttgatgaagatgctgcagctggtgacggtccagagactcaccccatgcccatgattgtgggccacaaatgacggtcatgtctggactctaccaggacaggtacagttgccagcttacgaacgaaccctgtgtgacgtcgtgtgcatgcgacctactatggattcatacattgtggaaaacgctctatgctccctacctgcta

SEQ ID NO: 20648 - protein, 55 aa, Zea mays
  misc_feature: Ceres CLONE 1389337-F
MYGADDGLTTMMVAPVLYPYADYMTQPKCTAMLLTPYYAFCDEMSAMYQPIRETR

SEQ ID NO: 20649 - DNA, 922 bp, Zea mays
  misc_feature: Ceres CLONE 1389337-R
  misc_feature: Encodes the peptide sequence at SEQ ID NO. 20650
ttgagcacactttattatgatgcatatattattggtcataccacacatgataatgtgtgtcgtcttactgcattattacatatatagatagagagggatggatagaggagatttcccaaatatcatgaatcagtagtatggcggaatggcagcggagacgccacaggggttggtgcggtagctgggcagctggtactggtactggtatagtccacattatggacggcatgttctgccccatcatcatggacatggggctgagaccctgcgctgccatcaacagctgttgccgccgcatcaaagcaggcttcaacaggctgctgctggaggcagcggcgcactccacctgcagcagtatctgtatctgctgcgagaccgactgcacgtccattatcctcgtctgaccctggacaggactgttgccgagagcggctagtacatgggacgtagtatgcccacgcccctgggtactagaggtggcgaatccagcgggctgaactgacggctcgctcaagtactccgcggtaggggtatccttgcagcagcgccaattacttttatgtctggccatgcgccagctttgttccaaagccctggactccccgcgtcgggggctcggctacctggattgcagaagcggcggggggggattaaaaagaccggtgctgcagctaaaacgaaaaggaggggtcggggggggtacaagttcgacaaaccttttttatccaattgcggcgtttgatgattctgggaatggattttttcggttagggaggttctagggtaagggggttagtgggaaattccttgaggcccggggggaacaaccaattttatgatgcggccgccaccgcgggtgggggccttcaggttttttttccccttaacaaaagggtaaattgaacgccttctcgtcaaccac

SEQ ID NO: 20650 - protein, 88 aa, Zea mays
  misc_feature: Ceres CLONE 1389337-R
MAEWQRRRHRGWCGSWAAGTGTGIVHIMDGMFCPIIMDMGLRPCAAINSCCRRIKAGFNRLLLEAAAHSTCSSICICCETDCTSIILV

SEQ ID NO: 20651 - DNA, 734 bp, Zea mays
  misc_feature: Ceres CLONE 1389341-F
  misc_feature: Translation starting site: 163
aagctggagctccccgcggtggcggccgctctagaactagtggatcccccgggctgcaggaattcgcacgagaccattacctagaacatcctaattgaaaactcgcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccggttcaaggacgaggaaggcatgccggcgttcgcgctcgtcaacaaggccacggggctcgcaatcaagcactccctcggccagtcccacccggtcaagctcgcgcctttcagcccggacaggaggacgcgtcagtgctgtggacggagagcacggacgtgggcaagggcttccgctgcatccgcatgggcaacaacacccggctcaacttccacgccttccacggcgaacaggaccacggcggcgtgcacgacggaaccgccgccctgctctgggagtggtggcagggctacgaagccaaactggaagaatctggcgggggaggccccgaggcccaatgcttccgggggaccacgggggaaggggccgcacccccttgt

SEQ ID NO: 20652 - DNA, 758 bp, Zea mays
  misc_feature: Ceres CLONE 1389343-F
  misc_feature: Translation starting site: 247
  misc_feature (494)..(494): n is a, c, t, g, unknown, or other
  misc_feature (521)..(521): n is a, c, t, g, unknown, or other
  misc_feature (541)..(541): n is a, c, t, g, unknown, or other
  misc_feature (554)..(554): n is a, c, t, g, unknown, or other
  misc_feature (637)..(637): n is a, c, t, g, unknown, or other
ggagctccccgcggtggcggccgctctagaactagtggatcccccgggctgcaggaattcgcacgagaccattacctagaacatcctaatcgagaagagtatccgacagttcgccttcccgtctttccctctccccccacacccggtcgtcgtcgtcgcggcgtgagcgtctgagcgagcgtgcgagagcgagaggggggaacacaaaaccctagcaccgtcgccgacggacgccagagtagagagatggcggtggacgaggtgaattcggtctacgtcggcagccttccctacgaggccaacgaggagatgcttcgcgacgccttcgggtactacggcaccatcgtctccgtcaaggtgattaatgatcatactatcaaaggcaagtgtttatggttttgttactttcactcaccccagagctgctgagcaagcaattgcgggcatggacggcaagaaattaggcaatcgtattattcgagtaaatgagtgcngtacaagaggtccccgagattttggtncgagatggtttttagacagnatccaagaaggtnaatggtagagatccatacttgggacagaaagggatagggacagaagctatgattcggtgaaagagatccctacatggacaggntttaagtgatagatcccgcgagcatggatagagaaagagatatggagcatggtgtttttttaaaagaagaagtgactatccccatgggatgggaggatcttgaagagacgacatacttcca

SEQ ID NO: 20653 - DNA, 732 bp, Zea mays
  misc_feature: Ceres CLONE 1389345-F
  misc_feature: Encodes the peptide sequence at SEQ ID NO. 20654
  misc_feature (363)..(363): n is a, c, t, g, unknown, or other
  misc_feature (628)..(628): n is a, c, t, g, unknown, or other
  misc_feature (732)..(732): n is a, c, t, g, unknown, or other
ggagctccccgcggtggcggccgctctagaactagtggatcccccgggctgcaggaattcgcacgagaccattacctagaacatcctatcaaaaccttccgcctccacgctccccacgtgcaccgtgcacagcaccacacagccaggtccccatggcggcggcggcggcggttgcgtctgcgacgacggcggaagacgaagcgcgcctgctgcgcctggaggagcaggcggagcacggcggcggcggcgcctgggaatacctctgcctcgcccgccggctccgcgcccgccgccccgctcacgtcctccgcgtcggcctcgccctcctcaacaacgcctccgcgcgctccggccttgcctcanaacagtggacgctctacgagcaggtggccacggcggccatggattgccagcgtctcgatgtggcaaaggactgtattggagtcctttcaaaacaatttcctgggagcacacgggttgcccggctagaaagctcgtctgtttgaagcaaaagggtgaatgggctgaagctgaaagagcctacgcgctaatcctggaaaacatccatttgaccagattgtccacaagaggaaaatggctatcgcaaagcacaagggtggtatggccnatagtgattgattatctcaataagtatctgggaatggtttatgggtgatcctgatgctgggagagaattgttggaacatacgtttccttacaatgtacaggcan

SEQ ID NO: 20654 - protein, 117 aa, Zea mays
  misc_feature: Ceres CLONE 1389345-F
  misc_feature (71)..(71): Xaa is any aa, unknown, or other
MAAAAAVASATTAEDEARLLRLEEQAEHGGGGAWEYLCLARRLRARRPAHVLRVGLALLNNASARSGLASXQWTLYEQVATAAMDCQRLDVAKDCIGVLSKQFPGSTRVARLESSSV

SEQ ID NO: 20655 - DNA, 685 bp, Zea mays
  misc_feature: Ceres CLONE 1389355-F
  misc_feature: Encodes the peptide sequence at SEQ ID NO. 20656
  misc_feature (394)..(394): n is a, c, t, g, unknown, or other
  misc_feature (415)..(415): n is a, c, t, g, unknown, or other
  misc_feature (455)..(455): n is a, c, t, g, unknown, or other
  misc_feature (461)..(461): n is a, c, t, g, unknown, or other
  misc_feature (466)..(466): n is a, c, t, g, unknown, or other
aaagctggagctccccgcggtggcggccgctctagaactagtggatcccccgggctgcaggaattcgcacgagaccattacctagaacatcctaatcgaaaaaaagcttggctgctcgtctgctcctgctgctgtctttcttctgctcttccatcgcgccagtgttttgagaagctggtcggcgctcctagatcccttcgcctctctcgcgttcgaggctaggtagccgccaccatgagccgctcggggcagcctccggatctcaagaagtacatggacaagaagcttcagattaagctgaatgcaaaccgtgttgttattggcacacttcggggattcgaccagttcatgaatctggtgatcgacaacactgtggaggtcaatggaaatgacnagacagatattggaatggtgnttatcaggggaaacagtggtgtcatgatcgaggcactggnagcagntgccnagtcgcagggaatccttattttttcagctgatatagcgcagcatgaaaactgatggtaatgctatgagtggaccctggtgaacttcggactccggttttttgccagaaacatacttcgttaccagcaccctgtgttaaggggggctcattacggcctgggggtaaaattggaagggacttttcccattggtcccaaaaaaaaaaaagtttcgaccggcc

SEQ ID NO: 20656 - protein, 94 aa, Zea mays
  misc_feature: Ceres CLONE 1389355-F
  misc_feature (8)..(72): Pfam Name: LSM Pfam Description: LSM domain
  misc_feature (54)..(54): Xaa is any aa, unknown, or other
  misc_feature (61)..(61): Xaa is any aa, unknown, or other
  misc_feature (74)..(74): Xaa is any aa, unknown, or other
  misc_feature (76)..(76): Xaa is any aa, unknown, or other
  misc_feature (78)..(78): Xaa is any aa, unknown, or other
MSRSGQPPDLKKYMDKKLQIKLNANRVVIGTLRGFDQFMNLVIDNTVEVNGNDXTDIGMVXIRGNSGVMIEALXAXAXSQGILIFSADIAQHEN

SEQ ID NO: 20657 - DNA, 707 bp, Zea mays
  misc_feature: Ceres CLONE 1389357-F
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (235)..(235): n is a, c, t, g, unknown, or other
  misc_feature (236)..(236): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (250)..(250): n is a, c, t, g, unknown, or other
  misc_feature (252)..(252): n is a, c, t, g, unknown, or other
  misc_feature (256)..(256): n is a, c, t, g, unknown, or other
  misc_feature (257)..(257): n is a, c, t, g, unknown, or other
  misc_feature (259)..(259): n is a, c, t, g, unknown, or other
  misc_feature (262)..(262): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (268)..(268): n is a, c, t, g, unknown, or other
  misc_feature (270)..(270): n is a, c, t, g, unknown, or other
  misc_feature (272)..(272): n is a, c, t, g, unknown, or other
  misc_feature (275)..(275): n is a, c, t, g, unknown, or other
  misc_feature (278)..(278): n is a, c, t, g, unknown, or other
  misc_feature (280)..(280): n is a, c, t, g, unknown, or other
  misc_feature (281)..(281): n is a, c, t, g, unknown, or other
  misc_feature (283)..(283): n is a, c, t, g, unknown, or other
  misc_feature (284)..(284): n is a, c, t, g, unknown, or other
  misc_feature (286)..(286): n is a, c, t, g, unknown, or other
  misc_feature (287)..(287): n is a, c, t, g, unknown, or other
  misc_feature (289)..(289): n is a, c, t, g, unknown, or other
  misc_feature (291)..(291): n is a, c, t, g, unknown, or other
  misc_feature (293)..(293): n is a, c, t, g, unknown, or other
  misc_feature (295)..(295): n is a, c, t, g, unknown, or other
  misc_feature (296)..(296): n is a, c, t, g, unknown, or other
  misc_feature (299)..(299): n is a, c, t, g, unknown, or other
  misc_feature (301)..(301): n is a, c, t, g, unknown, or other
  misc_feature (306)..(306): n is a, c, t, g, unknown, or other
  misc_feature (309)..(309): n is a, c, t, g, unknown, or other
  misc_feature (311)..(311): n is a, c, t, g, unknown, or other
  misc_feature (313)..(313): n is a, c, t, g, unknown, or other
  misc_feature (314)..(314): n is a, c, t, g, unknown, or other
  misc_feature (320)..(320): n is a, c, t, g, unknown, or other
  misc_feature (326)..(326): n is a, c, t, g, unknown, or other
  misc_feature (360)..(360): n is a, c, t, g, unknown, or other
  misc_feature (387)..(387): n is a, c, t, g, unknown, or other
  misc_feature (388)..(388): n is a, c, t, g, unknown, or other
  misc_feature (393)..(393): n is a, c, t, g, unknown, or other
  misc_feature (394)..(394): n is a, c, t, g, unknown, or other
  misc_feature (406)..(406): n is a, c, t, g, unknown, or other
  misc_feature (433)..(433): n is a, c, t, g, unknown, or other
  misc_feature (452)..(452): n is a, c, t, g, unknown, or other
  misc_feature (454)..(454): n is a, c, t, g, unknown, or other
  misc_feature (476)..(476): n is a, c, t, g, unknown, or other
  misc_feature (494)..(494): n is a, c, t, g, unknown, or other
  misc_feature (576)..(576): n is a, c, t, g, unknown, or other
  misc_feature (628)..(628): n is a, c, t, g, unknown, or other
  misc_feature (629)..(629): n is a, c, t, g, unknown, or other
  misc_feature (694)..(694): n is a, c, t, g, unknown, or other
  misc_feature (706)..(706): n is a, c, t, g, unknown, or other
aaagctggagctccccgcggtggcggccgctctagaactagtggatcccccgggctgcaggaattcgcacgagaccattacctagaacatcctaatcgaaaagaggtggagagatcgcacgcgccctctgccgcttgttcgttcctcgcgcttgccaccaggcaccaccacacacatcccaatctcgcgaggcggcgagggcaagcagcaggggtctgcggcgnnnnnnnnnntnnccnnntccccttcncnttgnncnccncnnngncncnccnccncnncnncnncncncncnnccncnccccnccncncnncccccncccccncccccccccccccccccccccccccccccccccnccccccccccccccccccccccccccnnccccnncccccccccccnccccccccccccccccccccccccccnccccccccccccccccccncncccccccccccccccccccccncccccccccccccccccncccccccccccccccccccccccccccccccccccccccccccccccccccccccccccccccccccccccccccccccccncccccccccccccccccccccccccccccccccccccccccccccccccccnnccccccccccccccccccccccccccccccccccccccccccccccccccccccccccccccccncccccccccccnc

SEQ ID NO: 20658 - DNA, 665 bp, Zea mays
  misc_feature: Ceres CLONE 1389361-F
  misc_feature: Encodes the peptide sequence at SEQ ID NO. 20659
  misc_feature (607)..(607): n is a, c, t, g, unknown, or other
aaagctggagctccccgcggtggcggccgctctagaactagtggatcccccgggctgcaggaattcgcacgagaccattacctagaacatcctaatcgaaaactattcctcggagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctcgctcgcaagtacaaccaggacaagatgatctgccgcaaatgctatgcacggctgcaccctagggctgtcaactgccgcaagaagaagtgtggtcacagcaaccagctgagggccaagaagaagatcaagaactgaggtgttgctgctagtcagtttcatggacaatggttggggtgggntggttgaacccgtggttggttaacacctggaatttttttggttttgggtgtttgaacc

SEQ ID NO: 20659 - protein, 129 aa, Zea mays; identical to SEQ ID NO: 6241
  misc_feature: Ceres CLONE 1389361-F
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: SWISSPROT Homolog: EC 3.1.2.15 Ubiquitin thiolesterase

SEQ ID NO: 20660 - DNA, 714 bp, Zea mays
  misc_feature: Ceres CLONE 1389363-F
  misc_feature: Encodes the peptide sequence at SEQ ID NO. 20661
  misc_feature (529)..(529): n is a, c, t, g, unknown, or other
tccccgcggtggcggccgctctagaactagtggatcccccgggctgcaggaattcgcacgagaccattacctagaacatcctaatcaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccggggacgaaggagttcatggaagcccttgctgccggcgctgatgtgtccatgattggccagttccgncgtcggtttctactctgcctacctcgtcgccgatagaagtgtcgggacccccaagacaacgatgacggagcagaccgggtggaagcccaagggggcggctcgtccctggtacctctgacacgtatagcaaccccctgccccgtatactaaaattccatggtccttacccgccatatcgtgagtac

SEQ ID NO: 20661 - protein, 114 aa, Zea mays
  misc_feature: Ceres CLONE 1389363-F
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGDEGVHGSPCCRR

SEQ ID NO: 20662 - DNA, 645 bp, Zea mays
  misc_feature: Ceres CLONE 1389365-F
  misc_feature: Encodes the peptide sequence at SEQ ID NO. 20663
  misc_feature (515)..(515): n is a, c, t, g, unknown, or other
aaagctggagctccccgcggtggcggccgctctataactagtggatcccccgggctgcaggaattcgcacgagaccattacctagaacatcctaatcaaaaaaaaaaagtcttcacttccattccaccggctccgatcccaactgccatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggttcgcacccacgacggccacagtgagctcgtcgctgctgcttgggatcactgggctcccagacactaagttcaagagtgcgatagatactgcactggcagatggtgagtgcaacgcactggnagaagctgaggacagggatgtctggtaccctcaccagggttcttgccaatggttggggcttaaaatgggtcaacaaaggccctggggaaaagttccccccgaaaaaaaaggggcgcgggaaatttaaaaa

SEQ ID NO: 20663 - protein, 164 aa, Zea mays
  misc_feature: Ceres CLONE 1389365-F
  misc_feature (123)..(123): Xaa is any aa, unknown, or other
MALSIYTPTSSSLVPPSIQEVRLTSRPPKPATFSLRRPHLAARAAAGNAPTSPVREVVTELDAVAGFSEIVPDTVVFDDFERFAPTTATVSSSLLLGITGLPDTKFKSAIDTALADGECNALXEAEDRDVWYPHQGSCQWLGLKMGQQRPWGKVPPEKKGAREI

SEQ ID NO: 20664 - DNA, 712 bp, Zea mays
  misc_feature: Ceres CLONE 1389366-F
  misc_feature: Encodes the peptide sequence at SEQ ID NO. 20665
  misc_feature (712)..(712): n is a, c, t, g, unknown, or other
gctctagaactagtggatcccccgggctgcaggaattcgcacgagaccattacctagaacatcctaatcgaaaaagccgccacctcaccccccccatcggccgcctgcgtcccaccacccgctcctgctgccgggcctgccgcccgttgctctcgccactgaagccctcgccgccgcctccgcctccgcccgcttgcttgccctcctgccggctgcctcccggatgagaagcggcgcaacctgggcagcggaagcgtggtcggcctgagccttcgccggggtttctgccgagaaggatcctggagattaagcgcatgggttccttggaggcccggtacaggccggccggggcagctgaggacacagctaagagaaggacccaaaaaagcaaaagtttcaaagaggctgaaaaatttgatgcttttgggctggaagaaaagtcctggcagcaagttcccaatcgatggcacctttcctcctcagataaaatgactcctgaagttctaaccaacccatacaaaccactccgtgaacgccacaccacccggacacaaagttctcccttattcaaacgccatacaaacgacccccccatgacccctcaacacccgcattaacatctcagccataactttataattacacactactcctacctgctaaacacctgaactccccagactccaccccgtactcctatccacccaccctn

SEQ ID NO: 20665 - protein, 100 aa, Zea mays
  misc_feature: Ceres CLONE 1389366-F
MGSLEARYRPAGAAEDTAKRRTQKSKSFKEAEKFDAFGLEEKSWQQVPNRWHLSSSDKMTPEVLTNPYKPLRERHTTRTQSSPLFKRHTNDPPMTPQHPH

SEQ ID NO: 20666 - DNA, 742 bp, Zea mays
  misc_feature: Ceres CLONE 1389367-F
tccccgcggtggcggccgctctagaactagtggatcccccgggctgcaggaattcgcacgagaccattacctagaacatcctaatcgaaaaactagtcccaactcccaaccaccgccagccgtccgctctccgcaagcgcgaccttccggccagatccgccgcgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtgggacgccatcagtgctctgtctggggttcggtctcttcttcggctgcagatctggaagggtttcgtggtatccgtcgctacgatctgtcccagtcagagcacctgcatcatctcgggacgcgccctggagactctgttcttctcgtagtagggcaaacaccacttccccgatttcttcgtccgccataacaagtttttaattcagcgcgccttcgcccgctccgtttctcactgtcggaaccctgtcccgcccattatctctgtgtggcactggttaattctcgtttaccatagccagtagcaggccacaaccccgcacagcctctattttcttctatccttccacgcgcccccaatgtatcttccccttttctcccccctcttcttccctgcgcatccccagccctgcgcctcat

SEQ ID NO: 20667 - DNA, 675 bp, Zea mays
  misc_feature: Ceres CLONE 1389369-F
  misc_feature: Encodes the peptide sequence at SEQ ID NO. 20668
aaagctggagctccccgcggtggcggccgctctagaactagtggatcccccgggctgcaggaattcgcacgagaccattacctagaacatcctaatcgaaaaataggaaaaacgactccacacggtccacggcgtcgtctccggcgaaccttcgcgagccctcggctcccctctaccaccgctgccgcgaccccgcctacggagcatcctcgggtagcgctctggcttcccgggccggcggacgtcctgcaggaggtggcgccctccgaggtatgttgatgagggccgccgctgccctccctcgccgatcgtcgcggccctcggagccggagtcctcctcctcccgggctcccgcccctggggcctcctccagtcgggctcctgcccccgggatctccttcgaacccttcgatgtcgatgccgacacgccatcgcgggttgagctgactgcccgagcatatgggactctgcgttgatgcgcttctcgcattaccagcactaggcgaaatgccggcatgtgttggccgagaagtctgatgcctatctgcaatcgcaaataacattcatgaaagctagctgcggactacccccagctgtttcttccagttcacaacggggatatcgttgaactcatgctgcgtatttaccacagcaacggttaccaccattcagccg

SEQ ID NO: 20668 - protein, 67 aa, Zea mays
  misc_feature: Ceres CLONE 1389369-F
MLMRAAAALPRRSSRPSEPESSSSRAPAPGASSSRAPAPGISFEPFDVDADTPSRVELTARAYGTLR

SEQ ID NO: 20669 - DNA, 649 bp, Zea mays
  misc_feature: Ceres CLONE 1389370-F
  misc_feature: Encodes the peptide sequence at SEQ ID NO. 20670
aaagctggagctccccgcggtggcggccgctctacaactagtggatcccccgggctgcaggaattcgcacgagaccattacctagaacatcctaatcgaaaaattccactgtttctctctcgaaatcggccgtctctctcccgtccggcacttcctccgatcgactagcctgcggcggcgccggcgccggcgaccagcggccatgcgggtggcacccagggtgctcttcctcgtccgcgacgccgcgggctacggcgctgccctcgccgacgcgctccgcccgccgcccgggctaactagggagtcctcgcccttcgagctcccccttggaaagtacggcctcgacggagagaaggcgtgcgccgagctcctgagcttttccgattccagtggctctccacaggtgaccatttgtgttctgccagactataagccacctcttgcagcgtgtgttgtaaatggggtctttggaactgatttcttctgaagctacctccactgagcgaactctatttggcccatacctcacaagatcggcaaggtatcctccatggaagggaacatgcaacaaagggattcgactgaacttccctggggggggaaaaaaggggcaaacaactggatattcctccccgggtgggtggggggc

SEQ ID NO: 20670 - protein, 94 aa, Zea mays
  misc_feature: Ceres CLONE 1389370-F
MRVAPRVLFLVRDAAGYGAALADALRPPPGLTRESSPFELPLGKYGLDGEKACAELLSFSDSSGSPQVTICVLPDYKPPLAACVVNGVFGTDFF

SEQ ID NO: 20671 - DNA, 683 bp, Zea mays
  misc_feature: Ceres CLONE 1389371-F
  misc_feature (279)..(279): n is a, c, t, g, unknown, or other
  misc_feature (316)..(316): n is a, c, t, g, unknown, or other
  misc_feature (317)..(317): n is a, c, t, g, unknown, or other
  misc_feature (364)..(364): n is a, c, t, g, unknown, or other
  misc_feature (370)..(370): n is a, c, t, g, unknown, or other
tccccgcggtggcggccgctctagaactagtggatcccccgggctgcaggaattcgcacgagaccattacctagaacatcctaatcgaaaacccttggccccttctccctttctctctctcctcctctcccccctgtcttcccccattccccactcccccacctctccagctccgtcgctagggctccatttcccctgcacctccgccgccgccgccgcttcaacatcagaagcaccggattcggtggtgtttctcggctgcctcagcttccgccgccnggaggcccctggcggcgttcgccgccgcccctccggnncttgctgagtcctctagacttgacaaggctgctgctgagtatatggnatctgncggccattgtgctgtccatgcaagcggaaagcatgcgtggcagctgggcttccggggatggccctgaccaaagaactggcgaggctttcggggggttgacaaaggaatggtgggggttgtttgcccttttgggcccttttcggaatttccaatggggtaaatttaggggcaaaaaccgggaaagacccccccttcccccggctggggtaatttaaaggcccccggggggccccccgcccctcttgggtttaaaacacctggggggggaaaaagagggaggaaacaaaattaatatttttttaaaaaaaatact

SEQ ID NO: 20672 - DNA, 744 bp, Zea mays
  misc_feature: Ceres CLONE 1389373-F
  misc_feature: Translation starting site: 258
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (32)..(32): n is a, c, t, g, unknown, or other
ttttnnnnnnnnnnggggntttctatattatntcctgatctgactaaaaaagatggagctccccgcggaggcggccgctctacaactagtggatcccccgggctgcaggaattcgcacgagaccattacctagaacatcctaatcgaaaactcacaaaaccctcgccagcttatcccccttccctccctcacacgatctctcctcgacggctaacccggattgccgtctcaggctcgggatccgggcgctcgcggcgatggacggcggcggcggcgctggcggcgcggagggggagctcacggcgcaggagacagcgctctacgaccgccagatccgcggctggggcgtcgatgcccagaagagttctgcaagaatattgttctagctggagttggaagtttatccttgatggatgataatgtagtcacagaggaggatctgaatgcaaatttcttaattcctcctgatgagagcatatatggtggtagatctcgagcccaagtttgctgagaagctttgatagatttcaatcctatggccagagtttttgttgaaaagggtgatccatcattaaatgatggagaactccttgacaagcgcggacatcgatggactttagccgggcatcccttaaaaaaaaaggttgatggattaatcgaaaactgccgaaaagaacaaccaaaccatatggcaattccaataccaaaagaatcgcaagggacctcatgggggcagcaaaaaat

SEQ ID NO: 20673 - DNA, 749 bp, Zea mays
  misc_feature: Ceres CLONE 1389377-F
  misc_feature: Encodes the peptide sequence at SEQ ID NO. 20674
ttttttcccccccaccccccccccccccataattttttatatagctgcttcaaagctgggactccccgcggtggcggccgctctacaatagtggatcccccgggctgcaggaactcgcacgagaccattacctagaacatcctaatcgaaaaaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgcgtatcttcatcccggagttcctgaccaagatcggagtcctcaacacgcccttctggtaccccgcccgcgcgagccaccagtactttcaccgacgcccacccacccgtcttccatcatagaggctccatcctccatcggagtgcacccgaataccccgcccctatggccctgcacctcactcaaacaacagca

SEQ ID NO: 20674 - protein, 158 aa, Zea mays
  misc_feature: Ceres CLONE 1389377-F
  misc_feature (73)..(148): Pfam Name: Chloroa_b-bind Pfam Description: Chlorophyll A-B binding protein
MALVSASSSSTTAVAALPRNGQQRASSSLFSSSSSSSFLVGKTLLRQAEAARPSFAVRAAADSDRPIWFPGSTPPPWLDGSLPGDFGFDPWGLGSDPESLRWNVQAELVHCRWAMLGAARIFIPEFLTKIGVLNTPFWYPARASHQYFHRRPPTRLPS

SEQ ID NO: 20675 - DNA, 721 bp, Zea mays
  misc_feature: Ceres CLONE 1389378-F
  misc_feature: Encodes the peptide sequence at SEQ ID NO. 20676
acccgcggtggcggccgctctagaactagtggatcccccgggctgcaggaattcgcacgagaccattacctagaacatcctaatcaaaaactcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcggttaccactacctcatcagtcacggcgcgtacctggccaccatccccgtcatcgtgctgctgcgcggcccctaacccgagcaccccccgccgggaccgtcgtaccggccaccgctgtaccctttctacctccctccctattctcccaccttatgccccctcttgcacctatcgtgattaacactcccccgctgctctccgcccactcctcctctcttcgccgcttccatttcaccctgcccctcttccccctactctcctgcttctctacacacttgctacaccgttttttcctcctctcgcccgtccaccttagtacccccctttaaccccgctgtcgcatgttgctataaccgcatcctaccct

SEQ ID NO: 20676 - protein, 76 aa, Zea mays
  misc_feature: Ceres CLONE 1389378-F
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGAYLATIPVIVLLRGP

SEQ ID NO: 20677 - DNA, 731 bp, Zea mays
  misc_feature: Ceres CLONE 1389380-F
  misc_feature (478)..(478): n is a, c, t, g, unknown, or other
  misc_feature (539)..(539): n is a, c, t, g, unknown, or other
  misc_feature (639)..(639): n is a, c, t, g, unknown, or other
  misc_feature (641)..(641): n is a, c, t, g, unknown, or other
  misc_feature (655)..(655): n is a, c, t, g, unknown, or other
  misc_feature (674)..(674): n is a, c, t, g, unknown, or other
  misc_feature (676)..(676): n is a, c, t, g, unknown, or other
  misc_feature (687)..(687): n is a, c, t, g, unknown, or other
  misc_feature (692)..(692): n is a, c, t, g, unknown, or other
  misc_feature (704)..(704): n is a, c, t, g, unknown, or other
  misc_feature (711)..(711): n is a, c, t, g, unknown, or other
aagctggagctccccgcggtggcggccgctctagtatagtggatcccccgggctgcaggaattcgcacgagaccattacctagaacatcctaatcgaaaagatcccgacgtgaaatctctccctctgcatctccgccatcgccagcgaggtgtggcatgcacaagcatcgtcttcatgtcgctctcttcttccgctgccaccctcccagcaccgagggaaggtaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgtttcccacaatgggggntcgacggggcggctcaaccgtcttcttagacaccatctcggtggagaacggttgaagtctncacacccctctcgacctctttgctgtctcaattttttttttttactgtcaacggacaagcaagcgcaccttccgcgcggcacaccacccacccccgtacncnaccatacccccggncgccagacgcgcacagccncncacgggcccancgccnccccgccccacncacacgnacgcgcccgcccaacccgct

SEQ ID NO: 20678 - DNA, 665 bp, Zea mays
  misc_feature: Ceres CLONE 1389380-R
  misc_feature: Pfam Name: NmrA Pfam Description: NmrA-like family
  misc_feature: SWISSPROT Homolog: EC 1.3.1.45 2'-hydroxyisoflavone reductase
ccgattgggtaccgggccccccctcgaggtcgacggtatcgataagcttttttttttttttttttcgaaaaatttgtcagataatcaccccattccgcttgtcataacaaacatggcataggtgtccatcaatcccgcttcttttaatagctccattcgcaacaaaaaaaaaacattatttttgacttattacaaggaagatctaacccgaacaattttcctaaactagaggatcctagtactcgttcactggtgcataattcacaggggaatacagttgatttccttccgtcgacaagtcattttcaaaatacgtgtggtcacccttaacgaaccctgaatatcttaagtataaacccatcttcaacggaaatggaacatcctgaatttctttaacaagtcgctcttctgctacatataaccttttcaggaatttcttgagtttcgactcccagaggtcagccaactcattcattgacaagacctttgctggaggtctcatatacaacctcatggtcaaagttgtgggatcctcaatggagcatatagtcaatttaccaacatcattctctttaacaaaaacacctttcctatttccttcaccaaacattttgatttcatccctgggaggagcatctatcccatgctgcacctttgaaggaagc

SEQ ID NO: 20679 - DNA, 725 bp, Zea mays
  misc_feature: Ceres CLONE 1389386-F
  misc_feature: Encodes the peptide sequence at SEQ ID NO. 20680
  misc_feature (456)..(456): n is a, c, t, g, unknown, or other
aagctggagctccccgcggtggcggccgctctagaactagtggatcccccgggctgcaggaattcgcacgagaccattacctagaacatcctaatcgaaaaaagttagcgccgctaatccgctccctattcaccatccaatccaatcggcttcccccaggcacccatggcgacggcggtggaggttcccgtggaggcgccggtgaggacagtgaaggtcaccaatgtctctcttagtgcaactgtgcaagacattaaggagttcttttccttttcaggagatattgatcatgtggagatgcagagtggtgatgagtggtcccaagttgcatatgtcactttcaaagatgcacaaggcgcagaaacagcacttcttctttcgggtgccacaatagttgatctttctgtcatcattgcacctgctccagagtatcagccacctcctactgcctctgcntcaccaatgagtggaaacagagttccagttggtggggaagacaaccacggttgttcaaaagccgagaatgtttggaaccctattctttggaagggtttttgggttaagaaaaaacacggctggccaagcccaacctattcaacggaaacaatgggttacccaccccaggatggggtttacggtggtcccctttttcaaacaataacggcggctattaattaaaccaccaggggcttttcttggtttacccgccgggacacactactcct

SEQ ID NO: 20680 - protein, 170 aa, Zea mays
  misc_feature: Ceres CLONE 1389386-F
MATAVEVPVEAPVRTVKVTNVSLSATVQDIKEFFSFSGDIDHVEMQSGDEWSQVAYVTFKDAQGAETALLLSGATIVDLSVIIAPAPEYQPPPTASASPMSGNRVPVGGEDNHGCSKAENVWNPILWKGFWVKKKHGWPSPTYSTETMGYPPQDGVYGGPLFQTITAAIN

SEQ ID NO: 20681 - DNA, 691 bp, Zea mays
  misc_feature: Ceres CLONE 1389388-F
  misc_feature: Encodes the peptide sequence at SEQ ID NO. 20682
  misc_feature (691)..(691): n is a, c, t, g, unknown, or other
gctctagtactagtggatcccccgggctgcaggaattcgcacgagaccattacctagaacatcctaatcgaaaactctggcctggccggtctgcctcgtccgcttctctctcacccttcctccccctcctctcctgtgggtgctctccctccctctccggctctcccccgccccccaagcccaaatcaccgcgcctcgccccacagcaccggttgcgtaggaggaaggagggggtaatgacgagagagagcagaccattaaccagctcttgacggagatggatggcttcgctggcaacagcggtgtcattgtgcttgccgccaccaacaggcccgatgtgctggactccgcgctcctacgaccacggagatttgataggcaggtcaccgttgacaggccagatgttgccggacgcgtcaagattcttgaggtccactcccgaggaaaggctttggcgaaagatgttgattttgataaaattgctagaaggacccctggtttcaccggtgctgacctccaaaacctcatgaatgaggctgccatccttgctgctcgccgtgatcttaaggaaattagcaaggatgagatctctgatgctcttgagagaatcattgctggccctgagaagaaaaatgctgttgtttccgaggagaagaagagggtcgtcgcttaccatgagggttggcatgcn

SEQ ID NO: 20682 - protein, 138 aa, Zea mays
  misc_feature: Ceres CLONE 1389388-F
  misc_feature (1)..(93): Pfam Name: AAA Pfam Description: ATPase family associated with various cellular activities (AAA)
  misc_feature: SWISSPROT Homolog: EC 3.6.4.6 Vesicle-fusing ATPase
MDGFAGNSGVIVLAATNRPDVLDSALLRPRRFDRQVTVDRPDVAGRVKILEVHSRGKALAKDVDFDKIARRTPGFTGADLQNLMNEAAILAARRDLKEISKDEISDALERIIAGPEKKNAVVSEEKKRVVAYHEGWHA

SEQ ID NO: 20683 - DNA, 771 bp, Zea mays
  misc_feature: Ceres CLONE 1389391-F
  misc_feature (13)..(13): n is a, c, t, g, unknown, or other
  misc_feature (15)..(15): n is a, c, t, g, unknown, or other
  misc_feature (19)..(19): n is a, c, t, g, unknown, or other
  misc_feature (22)..(22): n is a, c, t, g, unknown, or other
tttttattttttntntccnttnctctccgcgcctcggacactccatagaccttcaaaattggagctccaccgcggtggaggccgctctccaactagtggatcccccgggctgcaggaattcgcacgagaccattacctagaacatcctaatcgaaaaatcaagaaaccatgagttctaggttagctgaaatctcccttattgtaatctgttcatctcctggcgtgagtctgtggcgctagtgtgatgccttctcctagctcatggcttccggttcgcaatccctaatcctgatctcacttaagcgctcgtgagctctctccagtggctaaagattgcagatttgagttatagtccaagaaacgggtggtggtccgccatggaggtgaggtccgagcaagggctgatgggcggggagggatctattcggtatgccaaagagcccgcccggcgcccggtttccgggcccgccggacgtccgccgccatggcagaagcgtgcgcatggcgtacacctcggaccggcaccggctgtgttcgcctccgatgagatcctcggcccgcgacgccgtcttaccaagccacaggggtgcagccccacggggctagcatggtccgcggccgcacatcattgagagccaatgcacgcgacaacctgccccgcagtctgagtaggagcccggtgccccagaaaaaagcgcgggacgcaaccaagggaaaggtgggtgcccgacggcgtccatggcatctgcgcacgtagtgccccgctaacaa

SEQ ID NO: 20684 - DNA, 699 bp, Zea mays
  misc_feature: Ceres CLONE 1389392-F
  misc_feature: Encodes the peptide sequence at SEQ ID NO. 20685
  misc_feature (682)..(682): n is a, c, t, g, unknown, or other
gctctagaactagtggatcccccgggctgcaggaattcgcacgagaccattacctagaacatcctaatcgaaaatcctgctcgccgccgggtctgggctgggtgacgctgcctcggatgaggccgcgctgaccggagccgtagccggaccacccgcccacccatggcgcgcccgcagcgcgtgtatgagtcttggaaagggaacaataaattcttctttggtgggaggctcatattcggacctgacgccaagtcactggatcctgtctgtttcgctcattgtggccccggtattggtcttctgcggattcgttgctcggcatcttcgccaccacttcccggcttacaatgctggatatgcgattcctgcggtagctgtagtgtttatgatttatgtgctagtcctgctcttgattacatcagcgcaggatcctgtgatcgttccccgcgcagtccacccgccggagaacgagtcccttatgtaaacgctttgtctgaggcgaccccctggtaggatacaactcccccggtgaaaaggaagtatcgcgtcatgcgccgccctggtcacactccatcttctctgtcacgatttgcattaattctgccccatctctcttggtttctattcttcctccctcccttacgttctaatatctataccttcacaaaaatcctgtgcatcngagtatatcccaataag

SEQ ID NO: 20685 - protein, 99 aa, Zea mays
  misc_feature: Ceres CLONE 1389392-F
MSLGKGTINSSLVGGSYSDLTPSHWILSVSLIVAPVLVFCGFVARHLRHHFPAYNAGYAIPAVAVVFMIYVLVLLLITSAQDPVIVPRAVHPPENESLM

SEQ ID NO: 20686 - DNA, 712 bp, Zea mays
  misc_feature: Ceres CLONE 1389396-F
  misc_feature: Encodes the peptide sequence at SEQ ID NO. 20687
  misc_feature (310)..(310): n is a, c, t, g, unknown, or other
  misc_feature (321)..(321): n is a, c, t, g, unknown, or other
  misc_feature (360)..(360): n is a, c, t, g, unknown, or other
  misc_feature (710)..(710): n is a, c, t, g, unknown, or other
tccccgcggtggcggccgctctagaactagtggatcccccgggctgcaggaattcgcacgagaccattacctagaacatcctaatcaaaaagggcaatgacgagattccaaatttctcacaaaatctccgccccggcccgacccgaccccggccgcctctatgcgtcctccgccgccgcttcgcgcgcccacctcccgctcgacgtaatgcggcaccgccccgccgcgggctgcatcgtgcaccttcccgcggctctcgcaggcttcgtccgtgcgcgcgccgctgggactgcatccgcgtcgtggtcgntctcttacggnaaggggtgggcggctggtgcaccgccttcggggcgttcngccttcggggaggaggtctactggggaagccggaaaggagggacctcccgggaaggggacatctggaacacccgggggggcccggccccccaaaaccggccccctgggaaaccccttggcggccttttaaagacagcaaaatatcgggaaagggggccccggggtaaaccgcattttccggggggggggcgcaaggggaaaaaccctcttggggcgcgcagttcccctccgaggggaaggcgttccacccgggcgggcacatttctcccgccataaccggcgattcccacgccgtgccctctgccgaacggcctccccgctctgtgccacgctctcctactacttgctcncc

SEQ ID NO: 20687 - protein, 142 aa, Zea mays
  misc_feature: Ceres CLONE 1389396-F
  misc_feature (35)..(35): Xaa is any aa, unknown, or other
MRHRPAAGCIVHLPAALAGFVRARAAGTASASWSXSYGKGWAAGAPPSGRSAFGEEVYWGSRKGGTSREGDIWNTRGGPAPQNRPPGKPLGGLLKTAKYRERGPRGKPHFPGGGRKGKNPLGARSSPPRGRRSTRAGTFLPP

SEQ ID NO: 20688 - DNA, 745 bp, Zea mays
  misc_feature: Ceres CLONE 1389398-F
  misc_feature: Encodes the peptide sequence at SEQ ID NO. 20689
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (12)..(12): n is a, c, t, g, unknown, or other
  misc_feature (19)..(19): n is a, c, t, g, unknown, or other
  misc_feature (21)..(21): n is a, c, t, g, unknown, or other
  misc_feature (35)..(35): n is a, c, t, g, unknown, or other
nnnncccccccnccccccncnaccccccacccccnttggtgagggttgagaaaaactggggctccccgcggtggcggccgctcttccaatagtggatcccccgggctgcaggatttcgcacgagaccattacctagaacatcctaatcgaaaaataggaaaaacgactccacacggtccacggcgtcgtctccggcgaaccttcgcgagccctcggctcccctctaccaccgctgccgcgaccccgcctacggagcatcctcgggtagcgctctggcttcccgtgccggcggacgtcctgcaggaggcggcggcctccgtggcatgttgatgagggccgccgctgccctccctcgccgatcgtcgcggccctcggagccggggtcctcctcctcccgggctcccgcccctggggcctcctccagacgggctcctgcccccggggcctccttcgaccccttcgatgtcgataccgacccgccatcgcggcttgagctgacgcccgagcagatcgggctctgcgttgacgggctcgcgcatttcgaggacaaggggaagcgccgggacgacttggccgacgcattccacaagtctctccgtaacgaatattagacataggaaggacgagcaggggcgggttcttgatccccggttaaccccagtaacatacgcggctacatctgagggcccctacccgtccggacggatacccggaagtgcgcggggacaacagtctgtagagggag

SEQ ID NO: 20689 - protein, 95 aa, Zea mays
  misc_feature: Ceres CLONE 1389398-F
MLMRAAAALPRRSSRPSEPGSSSSRAPAPGASSRRAPAPGASFDPFDVDTDPPSRLELTPEQIGLCVDGLAHFEDKGKRRDDLADAFHKSLRNEY

SEQ ID NO: 20690 - DNA, 744 bp, Zea mays
  misc_feature: Ceres CLONE 1389399-F
  misc_feature: Translation starting site: 179
  misc_feature (297)..(297): n is a, c, t, g, unknown, or other
  misc_feature (303)..(303): n is a, c, t, g, unknown, or other
  misc_feature (304)..(304): n is a, c, t, g, unknown, or other
  misc_feature (308)..(308): n is a, c, t, g, unknown, or other
  misc_feature (309)..(309): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (327)..(327): n is a, c, t, g, unknown, or other
  misc_feature (338)..(338): n is a, c, t, g, unknown, or other
  misc_feature (529)..(529): n is a, c, t, g, unknown, or other
gctctagaactagaaatcccccgggctgcaggaattcgcacgagaccattacctagaacatcctaatcgaaaagtcggcgttgtttcgtctccaccgccgctctcctttccagtctccaccaccgctcgtctccccgtaccgcccgcaacccccctcccctgcgagatccggggcgcgatgtggcgcagctgcgtctcgcggtgcctctccagggccaaggcctccgcctccaggctcctctccacggcgtcgtcgtcctacacggtggtcgaccacacctacgacgcagtggtggntggggnnccgnngnnngcgnnnntccgggngggggatcggncctctccgaagcacggctttcccaccggggtggattaaccaagttccttccccacggggttcggaaaaccggtggggggttaagggaggataaaatgcctggactttgggaaaaatgggatggaaaaaagaccgggaggggggccaaattggtatgtgccctgtgttaaagggaaaagtattttgtttggnggaaccaaaatttttctttctcaaaaatgggggcagaaggggcccaaaaaagggggttaaaaaaacttggaaaaaaatggggcacccctttttttcaaaagaactggaaaggggaaataattatccccccccggggcctttggtgggaggagaaatattaatatttttgggaaaagggggggaaaaaaccacacccgtgtgtgggtcgccgtgtg

SEQ ID NO: 20691 - DNA, 688 bp, Zea mays
  misc_feature: Ceres CLONE 1389402-F
  misc_feature: Translation starting site: 234
  misc_feature: Pfam Name: Arm Pfam Description: Armadillo/beta-catenin-like repeat
  misc_feature (456)..(456): n is a, c, t, g, unknown, or other
cgctcttttctagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcctgcgtccgagcgagcgggtcgaggtacggcggaaccgctacaaggtggcggttcacgcgtaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggnttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctggcagttgcagctgcatgggctctcacaaatattgcttctggcacttcagaaaatacaaatggtgtcat

SEQ ID NO: 20692 - DNA, 944 bp, Zea mays
  misc_feature: Ceres CLONE 1389404-F
  misc_feature (20)..(20): n is a, c, t, g, unknown, or other
  misc_feature (31)..(31): n is a, c, t, g, unknown, or other
ctatactttctccctctttncctctcgcctntacccccacccccaaccctggaatatctccgcgttgacggccgctctataactagtggatcccccgggctgcaggaattcgcacgagaccattacctagaacatcctaatcgaaaaaatgctgcgcgcgcacgagcacgacacgagctttcttccatcaagacatggcgacgccggagctttggtggtactggtggctatgggtgacgacgatgctggccgtcgtcgtctcgaccgtcgtctgctacctgaccaaccagcaccgccgctggcggcgctggctctcctcctcacggcgtcgccgtccgacgtgactgtgtcatttccacctgtacccatcccccccacatcttacatcgtgccattaacagaacatacactcgaattgccccaccctcacccacccccactcaaacactctcctactcaaggagccccccccacccccaccaccctgtccacatttcggtctacttcctctcaacatctccataccattcaccccgtccccacccctcacataccgcgcatgatcagctacagacaacacccccacttcccaccttcttactacgatactctccccaccttcactgtcaccatcttacgccgctccccgcccactcaatcttactcaacattcccacttacttataaccacatactccccactaccaagtatcatcatccggatatgctactctttacacttagcaccccccgacttccaattacaccccctccaccctttacaacccacaccacctcactctcttcatccaccccacgcagaatcacgcatccccgttatatcatatacccactaactaccatcacagtcttcaaccactcacctactcccccccccatccctcacccacctatcacttcataccatctcaccctctccctcc

SEQ ID NO: 20693 - DNA, 696 bp, Zea mays
  misc_feature: Ceres CLONE 1389407-F
  misc_feature: Encodes the peptide sequence at SEQ ID NO. 20694
ggcggccgctctattactagtggatcccccgggctgcaggaattcgcacgagaccattacctagaacatcctaatcaaaaatagacagcctcccattcatcagattcagatcagatcgtagcagccaaggattccgcgctccgggggtgccatgaagctgaagctcctctctccctgccttctcctcctcgccttctttgccaccgcggcgtacgcggcgtcggcgtcggcgtcgcgcgcggcggccgtcgtcaggggcgcgggcgccccgtcgcagtcggagttggagtcggacccggagaaccagtgcgtgtacacggtgtacgtgcggacggggtccatctcgaagggcggcacggactcgaccatcggcgtgacgctgctgggccccgacggcacgggcatccggatccgggacctggcggggtggggcgacctcatggtcgccggccacgactactacgagcgcggcaacctggacatcttcagcggccgggtcccctgcaatgatccaggcgccctgcgccatgaacctcacctccgacggcaccggctgcgcacatgtctggaactggaacgacttcgaggtaactgttaaggctccccacctcgtacgtgtgactgatctcttcgattgtcaagcagagcctttccattgaatgttttgattatgctgcttatagtgtctcctcgctt

SEQ ID NO: 20694 - protein, 148 aa, Zea mays
  misc_feature: Ceres CLONE 1389407-F
MKLKLLSPCLLLLAFFATAAYAASASASRAAAVVRGAGAPSQSELESDPENQCVYTVYVRTGSISKGGTDSTIGVTLLGPDGTGIRIRDLAGWGDLMVAGHDYYERGNLDIFSGRVPCNDPGALRHEPHLRRHRLRTCLELERLRGNC

SEQ ID NO: 20695 - DNA, 710 bp, Zea mays
  misc_feature: Ceres CLONE 1389408-F
  misc_feature: Encodes the peptide sequence at SEQ ID NO. 20696
  misc_feature (397)..(397): n is a, c, t, g, unknown, or other
  misc_feature (430)..(430): n is a, c, t, g, unknown, or other
  misc_feature (533)..(533): n is a, c, t, g, unknown, or other
  misc_feature (644)..(644): n is a, c, t, g, unknown, or other
tccccgcggtggcggccgctctataactagtggatcccccgggctgcaggaattcgcacgagaccattacctagaacatcctaatcgaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggncatcagcacgctggtgtacatctccgtggcggngctcaaggtgcgcagcatcgagatggtggcgcgctccgtgctccccaggttctacgcgggcgacgtgcacccggagagctggaaggtgttcagcttcttacgnaggcgctacgtcgtcacggccagcccccaggttcatgggtccaaccctttccccgggggctttccttaggggccggaaagggtctgcgagagccgaagctcgtaggcgctnctacccaatgcgagaccgccgccgttcacggcccctctcagggtatatctatcatcttttcttatt

SEQ ID NO: 20696 - protein, 143 aa, Zea mays
  misc_feature: Ceres CLONE 1389408-F
  misc_feature: SWISSPROT Homolog: EC 2.3.1.15 Glycerol-3-phosphate O-acyltransferase
  misc_feature (76)..(76): Xaa is any aa, unknown, or other
  misc_feature (87)..(87): Xaa is any aa, unknown, or other
MVASPRFKPIEECCSEGRSEQTVAADLDGTLLISRSAFPYYLLVALEAGSVLRAALLLLSVPFVYVTYAFFSESLXISTLVYISVAXLKVRSIEMVARSVLPRFYAGDVHPESWKVFSFLRRRYVVTASPQVHGSNPFPGGFP

SEQ ID NO: 20697 - DNA, 739 bp, Zea mays
  misc_feature: Ceres CLONE 1389411-F
  misc_feature: Encodes the peptide sequence at SEQ ID NO. 20698
  misc_feature (389)..(389): n is a, c, t, g, unknown, or other
tccccgcggtggcggccgctctagaactagtggatcccccgggctgcaggaattcgcacgagaccattacctagaacatcctaatcgaaaaacttccaccccggaccgacaaagcagagcacgcgctggcagccaagtgcacacagacacgtctctctgttcgttctcagcttgctatagcaacctctagtaggtagccatggagatggtcctggactggcgctcgctgggctccctgctggcgaccgtcgtggtgttccgcaccgcgctgcgtaacttcctgccgccggaggccgagatgctcctgcgccgcttcctcgcgtgggtcgccgccgcgttccgcccgcccagcgacaccatcctcatcgacgaggcggacgggcccacgnggagcgccaacgacctctacgagtcggagcagttctacctcagcgggtgctgcctcgccaccgggcccgccgtgtgggtgcacaaaccggtgccagccgccgcggcccaggggtaacaaacaaggaactccaggagccccggccgccactcccaggggataagggggtccttttaatcccccacctttgtctttttgaaagtacttatttctgaaaactcatcgtcccctcctctcacatgctgtacctcttcccagccaccgcatgtatcaactcttgccaaccggccccgccactaaaacaaccaccaatgtcgctactcctctgctaccggaaacgggacaccactg

SEQ ID NO: 20698 - protein, 101 aa, Zea mays
  misc_feature: Ceres CLONE 1389411-F
  misc_feature (64)..(64): Xaa is any aa, unknown, or other
MEMVLDWRSLGSLLATVVVFRTALRNFLPPEAEMLLRRFLAWVAAAFRPPSDTILIDEADGPTXSANDLYESEQFYLSGCCLATGPAVWVHKPVPAAAAQG

SEQ ID NO: 20699 - DNA, 825 bp, Zea mays
  misc_feature: Ceres CLONE 1389413-F
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (19)..(19): n is a, c, t, g, unknown, or other
  misc_feature (21)..(21): n is a, c, t, g, unknown, or other
  misc_feature (825)..(825): n is a, c, t, g, unknown, or other
tttttttnnnntttttctntntttttcctcttcctggcgtctccccaccacagctggagctccccgcgggggcggccgctttaccaatagtggatcccccgggctgcatgaattcgcacgagaccattacctagaacatcctaatcgaaaagttccgcgccccagggagggtgcttgatagtacttgactactacccgcccatctgagagactgcaacgccgttgcttcgactcgagtctcagcatccctcgtccccgcatcaccgcgccgccgacattccgctcgctttcgctcccgagacccgggcctgccgagccgccaccatggacgaggagtacgacgtgctcgatctgagcacggagctcaaggagcgaatcctcagcggtctcctctgtgccgactggctagaggattctgacgatggcagataaatgattactaccgcgtgagagtccccctccctaaacgtgaaccagtctctggaacaggtatatgtgcctcaagacggagccatcgcgcacactctatgtcgtgacgcgcaaacttaccctgttacacaagggagcatagtagccccatgaattggctgaatgggaacctttagggtttcacccatcctctttccacgactgactgcgacacccacaatatcgacgcgcattttgaaggcctgggcggaccggtagggctaatgtacctgtccggccaaaaggggtaagtatctccgtgcgagggttcccatgaaccacgcggagaagcggagtgccatcaaatcaaggcctgcctggggaggctgagcccccgattgtggtggcgcaaccgcn

SEQ ID NO: 20700 - DNA, 688 bp, Zea mays
  misc_feature: Ceres CLONE 1389414-F
  misc_feature: Encodes the peptide sequence at SEQ ID NO. 20701
  misc_feature (478)..(478): n is a, c, t, g, unknown, or other
  misc_feature (526)..(526): n is a, c, t, g, unknown, or other
cgctcagttctagtggatcccccgggctgcaggaattcgcacgagaccattacctagaacatcctaatcgaaaaattttttaactagtctaaatacttgacagaagaaattcccgttttcgcttgactattcttcttcgtccctgatttttatccccaaactcaccgccggggcacaacaatccagttctcctttcgccggaatctgtccctcctccccctcctccccgcctctgcgggtactggaccaccgtggagcgggcattcatccaggctaggtccattccttcctttgctcgttctcttctccatcgcggaagctccacccgagttgacgccagaagagaatcggtgccctagggtgttctcgcagaattattttccagaagatttgcagatcgagtcgaaccctatgccccacgttaagcctgccgccggcctgcccccttaccaccaccgggcgctccctggccccgggncagggtccagttcccacgggacatgggatgatgcaccgggaggtccgngatcagtacgggccgctgggggcgaggatgcacctaccaccgctggggcacgggcccgctccgttcccctacgacatgctggctccgctggcccccccggaggtcctggaacaaaatcttgtgcccagcacggggagatgcacaagctggctatagagaccc

SEQ ID NO: 20701 - protein, 58 aa, Zea mays
  misc_feature: Ceres CLONE 1389414-F
MMHREVRDQYGPLGARMHLPPLGHGPAPFPYDMLAPLAPPEVLEQNLVPSTGRCTSWL

SEQ ID NO: 20702 - DNA, 689 bp, Zea mays
  misc_feature: Ceres CLONE 1389415-F
  misc_feature: Encodes the peptide sequence at SEQ ID NO. 20703
  misc_feature (434)..(434): n is a, c, t, g, unknown, or other
gctctataactagtggatcccccgggctgcaggaattcgcacgagaccattacctagaacatcctaatcgaaaaacgaggcaatgctgtcccgtcgccgcagctcgccgcgcccgctcgcacctggcctcctcctgttactcctcgccatggcgccgccaccgccggcttccgcggtgggtgtgaactggggcttcgcgtcctcccactcgcttccggcggcgcaggtcgtacggggcctcctcctccccaactctgttccccgcgtccgcctcgccgccgcctcctccgacgcgctcacggcgctcgaaggcaccggcatcgccgtcagcgtcgggatccccgacgcgctgctccgggccctcgcctcctccaccaaggcagccgccgcgtgattccacgacaacatcacccgttactcctccagggtgcggntcgagtatattgttgttggagatgagctctttcttctacgtcatggacaaaattttcatccttttggacttcgaggagaaaaaaatggtaataaagcagtagcccatggcaaaatggccgagaaaggataaaggtgcaactaccttggagagggtatatatatctagaacggcacggacatggccaccggattcaaaacacaaaataggaaggtaagcaaacacatgcagattatgacttcatgtctttattact

SEQ ID NO: 20703 - protein, 81 aa, Zea mays
  misc_feature: Ceres CLONE 1389415-F
MAPPPPASAVGVNWGFASSHSLPAAQVVRGLLLPNSVPRVRLAAASSDALTALEGTGIAVSVGIPDALLRALASSTKAAAA

SEQ ID NO: 20704 - DNA, 660 bp, Zea mays
  misc_feature: Ceres CLONE 1389417-F
  misc_feature: Encodes the peptide sequence at SEQ ID NO. 20705
aaagctggagctccccgcggtggcggccgctctatcctagtggatcccccgggctgcaggaattcgcacgagaccattacctagaacatcctaatcgaaaaatgacttcccctgccccgacagtacgagaccacgccttctgcgggatcgatcggatagggtttcggagatggtcgcccgcgcggcgaacaagaacgacaacacccggtactacgagatgctggggggttcctaggacgcgtgacaggatgacctccagaaggcctaccgcaagtccggcatgaggaaccacccctatcaggccggcgaccccgacaagttcgaggagctaggtcacgcttatgtcgtcctcagcgaccctgaaaagatagagatctatgacccgtatgcggagaatgtcctcgaggagggaatcgggaggggacgccgccatggatgatccctttgacatattccagttcttctttgtcgggggaagcccttttgtgggtgagatcagcagggacagaaggcactcgacggggagatgatgtagcatcatcctctgaagggttctctggatgatttgtacgatgccacatctaaaatactctctctgtcccgcaatgtcctctgctcccagcgcaatggcaacgcttccgagtttgcagcttcgacgag

SEQ ID NO: 20705 - protein, 52 aa, Zea mays
  misc_feature: Ceres CLONE 1389417-F
MRNHPYQAGDPDKFEELGHAYVVLSDPEKIEIYDPYAENVLEEGIGRGRRHG

SEQ ID NO: 20706 - DNA, 749 bp, Zea mays
  misc_feature: Ceres CLONE 1389421-F
  misc_feature (657)..(657): n is a, c, t, g, unknown, or other
aaagctggagctccccgcggtggcggccgctctatcctagtggatcccccgggctgcaggaattcgcacgagaccattacctagaacatcctaatcgaaaaaacccaacccaacgacgcagctagcgcgcatctccgatctgcactgcaccttcgtctccgaagaacgtcgatcgtactcgtacaccatgaaggcagtcgtcgcggcgacgatgcttctgctgggtgctggtggccgcggcgacggtggcgagcgcagaccaccgtgatgacgacggccaccaccaccagcgccaccgcggccagagctggcaccgccacagcggcggcgctctgggtggccgacgatcgagcccgctgatggtattgacggcgcgcgcgcccgggtcccctccaggttcaccctgccgcagcaaaaaagtaacaccccacgttgtccgtctatgagccgaacacgaggcctcctcataaccgcccacactgctcatcacccatgcgccccatacttttctatctccgtcaccctctctccgcttctctcattcccccccccaccgccagcgcactccccccccccttcaccctcaccaccccgctaataacaaagcttttcactcccctctaccaagcccataccccccccccccctctctcaaantccaccatcgcaaaatccccccgcgcgcacgccaggctctcgcccgtgtactctccactcacccccccctctctattattttattatcttcg

SEQ ID NO: 20707 - DNA, 771 bp, Zea mays
  misc_feature: Ceres CLONE 1389439-F
  misc_feature: Translation starting site: 207
  misc_feature: Pfam Name: U-box Pfam Description: U-box domain
tttcttccttctcttccctactaccctcccccccccccctctccaccccccaaggtggtgctcaccgcggtggcggccgctttcccaatagtggatcccccgggctgcaggaactcgcacgagaccattacctagaacatcctaatcgaaaactttccctttctgggcgcattccctcgtcctccggcagccgtcgccagcttccgatggtccggaaggagacggccatgagggtgcccccgcatcaccaggggctggaggacaagatccccagcttcttccgcgtgccccatctcgcgtggacgtcatgcgctcgcccgttagcctctgcaccggcgtctcctacgaccgcgcctccatcctggagtggctcgactccggcaacaccacgtgctccggccaccatcctcacgctcccctccaccgacctcggccccaaactcactctccgcagactcatcacccactgggccgtctccgccgccctcctgttcccccaccgccgccgggggagtcggaagtcaccgacacgtcgtcgggacgtgctatgttcacccgcgcagcctcgtgcgacaggacggtttcgatctgggggggatcccctcgctcgccccctctgtgggctgcgaagccacatttaagccgaacgagcggggtggaatatggtaaagaaaaaaaaaagcagcttgggggtgtccacaggacacgtgcccccacgaggaggtgtcgttggcctggtaattctcggtaataatctaaaaccaagaaaga

SEQ ID NO: 20708 - DNA, 682 bp, Zea mays
  misc_feature: Ceres CLONE 1389441-F
  misc_feature: Translation starting site: 206
  misc_feature (426)..(426): n is a, c, t, g, unknown, or other
  misc_feature (453)..(453): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctggtcggggctggcgctgacggctccgtggntgggggctggccgtgcccaacgccggntgttcctgatcttcagccccgtgctggtccccgccgcgctgctcatcgggacggcgggtcatggggtccctcacgtccgggcgcgctgggggcttcgggggcctgtccttcgctcacgtgcctcgccaacacgggggcggcaggggttccagcgcacccgggaataaagggaaggaggcgcacccgcagaatggcggaagccgcggcgcaagcggaccaacaagaccgc

SEQ ID NO: 20709 - DNA, 727 bp, Zea mays
  misc_feature: Ceres CLONE 1389444-F
  misc_feature (530)..(530): n is a, c, t, g, unknown, or other
  misc_feature (727)..(727): n is a, c, t, g, unknown, or other
tccccgcggtggcggccgctctagaactagtggatcccccgggctgcaggaattcgcacgagaccattacctagaacatcctaatcgaaaaacaaaccaagttggctgaagtcaaggtcagcctctaggtcgacaattagaatccaacgagatttttccgcatttgataacgaagcagccgagggtttacagtctgcgttggatcacatggaattgcctgaaacaatcaggcggaggatccaagcagccatgcctcttcttccaccatcccggcacccttctttgcaatgtcaacctccgcagttgtcgttggctgcattaacaccactccagagcagtacatctggtgtaggtccgcaacagaaaagttgttctgcgagctgggtgcccactaacgtctcaggcagaagcaaggcggcgttgccttcgcatgatcctgaaatggaggtagatccatggaatctgctcgaagatggcacaagctgcccctcaacagcatctggaagccatggcgcgagtggagtgacggntgaccatgctaatctgaaagcgtgcagctggcttaagggtgctgtgagggtgaggaggacaaaactgacctaccttggctctttagacgatgacacctgaccggcgactgatattttgggtgaattgtgcacggacaccacctccacttggagctactgcaaagaaaagaacgaacatatacttgaacctttgcttn

SEQ ID NO: 20710 - DNA, 684 bp, Zea mays
  misc_feature: Ceres CLONE 1389445-F
  misc_feature: Encodes the peptide sequence at SEQ ID NO. 20711
aaagctggagctccccgcggtggcggccgctctagaactagtggatcccccgggctgcaggaattcgcacgagaccattacctagaacatcctaatcgaaaaagattcggagcttcggggggaaaaggcaggcacagtatcgtcgaccatgctgccaggtcgccacccggcgcgccgggccgacgccaccgggacggggccgctcctgccggacgccactcgcgcggtggtggcggagttcgtcgccacagccatgttcgtgttcgccgccgaaggctccgtctacggcctctggaagctgtacaaggacacggcaacgccgggcggcctgctcgcggtggccatcgcgcacacgctggcgctggtggccgcggtggcggtagcgagcaacgcgtcgggtgggcacgtcaaccctgcggtcacgttcggcctgctcgtgggccgccgcatctccttcgggcgtgccgcggtatactggctcgcgcagatgctcggcgccgaggccgcgtcgttgctgctaacgctcgtctccggcggcacgcgtcccgtggacttcggaatcgcccgcggcgtccactagctgcacgcgctcctgctagaggccgtaatgacggtcggagctcttgtacgcgttgtatgccaccgcgttggatcaacgaatccgtaactgtcataattctaatt

SEQ ID NO: 20711 - protein, 143 aa, Zea mays
  misc_feature: Ceres CLONE 1389445-F
  misc_feature (20)..(143): Pfam Name: MIP Pfam Description: Major intrinsic protein
MLPGRHPARRADATGTGPLLPDATRAVVAEFVATAMFVFAAEGSVYGLWKLYKDTATPGGLLAVAIAHTLALVAAVAVASNASGGHVNPAVTFGLLVGRRISFGRAAVYWLAQMLGAEAASLLLTLVSGGTRPVDFGIARGVH

SEQ ID NO: 20712 - DNA, 735 bp, Zea mays
  misc_feature: Ceres CLONE 1389448-F
cacccgcggtggcggccgctctagaactagtggatcccccgggctgcaggaattcgcacgagaccattacctagaacatcctaatcgaaaagttccaaaaagaaaaaagaaaaactcagccgccggccgctgcccctctcggctgcacgacgtccgtgagggcgtgccccctggccccgtcccttgtcgcctgcccgccggtgcccgcacaggctgccagtgccatactgccatccctccgtccggccgtctgcccaggctgcctgcccggcgccctggcctcccggtcgctggctctctgcccaggcgccaggccgcaggtcccaccgccccagaccacccgcgaaccagtccgctgcaggctgcaggccaccgtccctccagttcgccggtcagattattaaccattcagataccccagctccgcctagacgcgaatcctccgccactatggtggaagcggtgtcccttgacaagcaagaaaaggccgttgcttccaaaccgtctctggaacccggtcttcctccaactcatccccttgtaattccttgacaactatttaaacaaagccggattaccctctcatcacttttattatccaagaccggcaaaatcgacacccctccccttggcatcccaccgttccttcaatataataatgctctcccccaactcgatcacttatcacattaatacactatgaacactgctcaattctcatctcagacatgtttc

SEQ ID NO: 20713 - DNA, 694 bp, Zea mays
  misc_feature: Ceres CLONE 1389453-F
  misc_feature: Encodes the peptide sequence at SEQ ID NO. 20714
ccccgcggtggcggccgctctagaactagtggatcccccgggctgcaggaattcgcacgagaccattacctagaacatcctaatcgaaaaacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggcgtgcgcgtgctcggcaggggcgccgcgcgcgtgacgccgcgaccgtgggcggctgtcggcggcaggagacgcttctccgtgcggatgtccgtcgcgaccaccgaggccaccaccaccatcgccgtgggcgcctcggaggaccaaacgctgccccccaggaactccaacacgtgggcgacgctcttcctcggcggtggagtcattactagctttccccctcctaccttccgcatggcctacttcccactggcaaaagtcaaccacaagccgctatcctcccctctgtatcgccccgtctgttccgccttctcaccccgacccctctcctcttccactcttcttcccctctcactcccttcagcacccccattaatctcttctcgacctcctccccattcccctatcctcaacttcactcaacttcccccccgcctatcccccc

SEQ ID NO: 20714 - protein, 161 aa, Zea mays
  misc_feature: Ceres CLONE 1389453-F
MGLRVAATAPAPAGVRVLGRGAARVTPRPWAAVGGRRRFSVRMSVATTEATTTIAVGASEDQTLPPRNSNTWATLFLGGGVITSFPPPTFRMAYFPLAKVNHKPLSSPLYRPVCSAFSPRPLSSSTLLPLSLPSAPPLISSRPPPHSPILNFTQLPPRLSP

SEQ ID NO: 20715 - DNA, 712 bp, Zea mays
  misc_feature: Ceres CLONE 1389454-F
  misc_feature: Encodes the peptide sequence at SEQ ID NO. 20716
  misc_feature (524)..(524): n is a, c, t, g, unknown, or other
  misc_feature (557)..(557): n is a, c, t, g, unknown, or other
tccccgcggtggcggccgctctagaactagtggatcccccgggctgcaggaattcgcacgagaccattacctagaacatcctaatcgaaaaagcactgcactgcacgcctccgccatactgcgacgccgccgtgcatcgcttcacgcagagcagtgatggaatcccatcacggcggcgacgggaaggcgcgggacaagttctcggtgtaccagaacccgtccctcacccgcgccctagactcccgcagcgcccgcccctccgtcacagtcctcctcgtcctcgcggtcatatccgtcgcctccgcatcctccttcctcgccctcacctcccgggaggagcagctcaccaagctcgccggacgagcgggtatctctgtccttgctgctgtttttgtcattaggttggtggaagcagcactcggtcttgttgtacttttcacactgctggggttcttcagggcactgatgttatacaatgggcagaaggcactggccaaggccgacaaggttgtcttgtctgatcngcaactggggcttcttggttaaagatgggaggntcagaaggaggggggaaagggggagcaaatcaaaaggcctcccaagaccagccatcaacaccatcggaaaccattgtgcctatcaggaaggcttccgttcagtttaacccactctcggccttgcgggaaatctagaattggtctcaaccatttgt

SEQ ID NO: 20716 - protein, 129 aa, Zea mays
  misc_feature: Ceres CLONE 1389454-F
  misc_feature (123)..(123): Xaa is any aa, unknown, or other
MESHHGGDGKARDKFSVYQNPSLTRALDSRSARPSVTVLLVLAVISVASASSFLALTSREEQLTKLAGRAGISVLAAVFVIRLVEAALGLVVLFTLLGFFRALMLYNGQKALAKADKVVLSDXQLGLLG

SEQ ID NO: 20717 - DNA, 697 bp, Zea mays
  misc_feature: Ceres CLONE 1389455-F
  misc_feature: Encodes the peptide sequence at SEQ ID NO. 20718
  misc_feature (429)..(429): n is a, c, t, g, unknown, or other
  misc_feature (432)..(432): n is a, c, t, g, unknown, or other
  misc_feature (504)..(504): n is a, c, t, g, unknown, or other
  misc_feature (505)..(505): n is a, c, t, g, unknown, or other
  misc_feature (513)..(513): n is a, c, t, g, unknown, or other
  misc_feature (697)..(697): n is a, c, t, g, unknown, or other
tccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaaccctaaccgccgacggtggccatgatggccaccgagcccttgtccccggggaatctcgtcgaggacgtcgaaacactacccctggactcctcctccactctcgcggctacgacggacccgctgctccgcccacctcccccctcgtccaccttctctcccaccgccggtgagaaccatggcgcttttctggacgaggaggatgaggacgtgntgnatgacttcacgcctccgctggctccccatgccgctacggccgcgacgaagtcccgcgaggcgtcaccgtggnntcgctganatcactgcctccgaacctaggaagcacggggagcccccgaccggaagcgggggcgtctttccccggttcggccagctaattcccctaactactcgccccccaggggcccgacggagggaagttcccccgggggtcgggaattccgtgacgcgctggctctcctcataaaccctccgcgaaaacn

SEQ ID NO: 20718 - protein, 90 aa, Zea mays
  misc_feature: Ceres CLONE 1389455-F
  misc_feature (64)..(64): Xaa is any aa, unknown, or other
  misc_feature (65)..(65): Xaa is any aa, unknown, or other
  misc_feature (89)..(89): Xaa is any aa, unknown, or other
MMATEPLSPGNLVEDVETLPLDSSSTLAATTDPLLRPPPPSSTFSPTAGENHGAFLDEEDEDVXXDFTPPLAPHAATAATKSREASPWXR

SEQ ID NO: 20719 - DNA, 691 bp, Zea mays
  misc_feature: Ceres CLONE 1389456-F
  misc_feature: Translation starting site: 222
  misc_feature: Pfam Name: Cellulose_synt Pfam Description: Cellulose synthase
  misc_feature: SWISSPROT Homolog: EC 2.4.1.12 Cellulose synthase (UDP-forming)
  misc_feature (531)..(531): n is a, c, t, g, unknown, or other
ccccgcggtggcggccgctctagaactagtggatcccccgggctgcaggaattcgcacgagaccattacctagaacatcctaatcgaaaactctcggatcgagtgcttgagctccgaccaaatctcgcagcggctgcaattccgagcccgaagagcggatcaggcgaggacgacgccttcgattctgatctgcggtcggcgcgacccagagagaaccggagatgcagcagggcgacggcacggaggcgcaggtgacgtgggaggaccagcagaacatcaaccgcttcggtcgcctcaacaaccgcctccacgagctccaggaagagatcaagctcgcaaaggagacgaatgagaaccttgatctcttcctgggtcacagtggagggcttgacgttgaaggcaatgaacttcctcgtttggtttatgtgtctcgtgaaaaacgtcctggattccaacatcacaagaaggctggtgccatgaatgcacttgttcgtgtatcagctgtccttactaatgggcaatacatgttgnaatcttgattgtgaccactacatcaataatagcaaggctcttcaagaagctatgtgcttccttatggacccaaacctaggaaggaatgtctgttatgtccaatttcctcagaaggttgatggtattggatagaatgaccgatatggaaacaggaacactg

SEQ ID NO: 20720 - DNA, 718 bp, Zea mays
  misc_feature: Ceres CLONE 1389458-F
  misc_feature: Encodes the peptide sequence at SEQ ID NO. 20721
  misc_feature (564)..(564): n is a, c, t, g, unknown, or other
ggcggccgctctataactagtggatcccccgggctgcaggaattcgcacgagaccattacctagaacatcctaatcgaaaaaaaccaaccaaccccattcctccgccggccgccggcagccgcccgcgatgtcgaaggccgcggcagcgtccctcccgccgccgccgccagaggtggcgcaccttgtggagcagctccagcgccaccacctcgccccggacgcgtccctcctctccagctccgcgcactccgacctcctccaggcgcgcgaggaggtcgcggcggagcgcgcgctgtacctcgaggcactggcggtgtacgcggaggcggtggccatggtggaggagtaccatgcggctgccggcgccggcaagaagctcaactgctccccgcaggtgtacgagtctttggagcaccggttggccgtggcagaggcagcacagaggcttaggctcccactgctctctcaggacggggaggtccatgagcaggagatcgaaaagctgagcacctattcaagaagttcattcgatagcaccctcacaagcgcgacacccagctcangttcaatctcgacgagttacaacaattatagcagcagcgctagtgcggtgactgttgctgctccacatttgaatggtaagtctgatggaacttgaaactggagtcgctgcgttcctgatcattctataggaatcccttctgattacttctaccc

SEQ ID NO: 20721 - protein, 176 aa, Zea mays
  misc_feature: Ceres CLONE 1389458-F
  misc_feature (146)..(146): Xaa is any aa, unknown, or other
MSKAAAASLPPPPPEVAHLVEQLQRHHLAPDASLLSSSAHSDLLQAREEVAAERALYLEALAVYAEAVAMVEEYHAAAGAGKKLNCSPQVYESLEHRLAVAEAAQRLRLPLLSQDGEVHEQEIEKLSTYSRSSFDSTLTSATPSSXSISTSYNNYSSSASAVTVAAPHLNGKSDGT

SEQ ID NO: 20722 - DNA, 671 bp, Zea mays
  misc_feature: Ceres CLONE 1389460-F
  misc_feature: Encodes the peptide sequence at SEQ ID NO. 20723
  misc_feature (420)..(420): n is a, c, t, g, unknown, or other
  misc_feature (421)..(421): n is a, c, t, g, unknown, or other
  misc_feature (524)..(524): n is a, c, t, g, unknown, or other
  misc_feature (570)..(570): n is a, c, t, g, unknown, or other
aagctggagctccccgcggtggcggccgctctagaactagtggatcccccgggctgcaggaattcgcacgagaccattacctagaacatcctaatcgaaaaatttggctctggtcgtcacaaagttgtttgtgcatcgcggcggcgacaagggggcgacgaggcaggcggagcgggcggcgactaccgcggcagcagatctcacggaatggcggcgaaggcaatctcgagccccgtgccggtggagtggtacccgacgctggccgtcgtcatggtatccgtaggcctcatgttcaccgcctccttcttcatttatgaagcaacttcatcccggaggagccgtagcctgtcaaaggagatcgcaacagcagttgttgcttctgttttcttgggctttgggtctctggtcgtgcttcttgcnnagtgtgttatgtctgatgactggctatgggccgtgtgtgcttggtgtctgcatccccgagtgtagacttggttatgacagatcctcaaagctggtgtcctaancgatatagagcatttgaacttattctagaacgatgtatgggagcanccgagttaaagcaacgtttctttccagggctgcatatatatcatcaatctaaatccctggtccctgaaaaaaaaaaaaaaaggctatcgatacggccgacc

SEQ ID NO: 20723 - protein, 92 aa, Zea mays
  misc_feature: Ceres CLONE 1389460-F
  misc_feature (2)..(76): Pfam Name: UPF0197 Pfam Description: Uncharacterised protein family (UPF0197)
  misc_feature (72)..(72): Xaa is any aa, unknown, or other
MAAKAISSPVPVEWYPTLAVVMVSVGLMFTASFFIYEATSSRRSRSLSKEIATAVVASVFLGFGSLVVLLAXCVMSDDWLWAVCAWCLHPRV

SEQ ID NO: 20724 - DNA, 674 bp, Zea mays
  misc_feature: Ceres CLONE 1389461-F
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (389)..(389): n is a, c, t, g, unknown, or other
tggagctccccgcggtggcggccgctctagaactagtggatcccccgggctgcaggaattcgcacgagaccattacctagaacatcctaatcgaaaaacttaggccgtcacaaggagaccctcctcagccgctagtaccagtagtcgtcgcgtttgcagctaggcagatctgagttagccggcggatccgatccgtgcgcgtgcgcagtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccccggggggggccccccccnnnnnggngccggcccccccccccgccccggcgcccgcggggcccccccgggccgcccggggcggcgggggccgggcccgggcgccgcgccccccggcggccgggggcgccgggccccccccccgggcccgggcgccgcgcgcgggcggcgcgccggcgccccggcccgcgcggcgcgggccgcgccgccgcccccccgccgccgggggcgcgccgcgcgggccggcgcgcgcgggcgccccggggcgggcgccccccgcgccgggcggggggcccggcgccggcgcccgccg

SEQ ID NO: 20725 - DNA, 687 bp, Zea mays
  misc_feature: Ceres CLONE 1389462-F
  misc_feature: Encodes the peptide sequence at SEQ ID NO. 20726
  misc_feature (544)..(544): n is a, c, t, g, unknown, or other
acaaaactggagctccccgcggtggcggccgctctagaactagtggatcccccgggctgcaggaattcgcacgagaccattacctagaacatcctaatcaaaaaacactcgtccactcaccccctctttgctctgcctcgccgcgccgcagagcagagcatggcgcccccacgccctctcctcgccgccgtcttcctcgccgcggaggttctgctcctcctttctccggcagaggcggtgacggtgggcgtgaactacggccgcgtggagaacaaacctgcccaacccagcggcggttgtgcagctgctcaagcagcaggacgtcgcgcaggtgaagctgtacgacgccgaccccaccgtgctgcgcgccctcgcgaacaccggcatcaagatggtgttggcgctgcccaacgagcaggtcgcggcggcggcgtcgcgcgcgtcctacgcgctgctgtgggtgcgccgaaacgtgccggcgtaccacccggccacgcagatccagggcatcgccgtggggcaacgaggtgttcgcgtccgccangaacgtgacgggggcagctggtcccgggccatggccaacgtgcacgccgcggtggccagactcgggccccaagggggccgtcaaggggggcgtcgcccttcgggttcacgggggtcggggtctccaacccgtcctcggggggg

SEQ ID NO: 20726 - protein, 98 aa, Zea mays
  misc_feature: Ceres CLONE 1389462-F
  misc_feature (51)..(51): Xaa is any aa, unknown, or other
MVLALPNEQVAAAASRASYALLWVRRNVPAYHPATQIQGIAVGQRGVRVRXERDGGSWSRAMANVHAAVARLGPQGGRQGGRRPSGSRGSGSPTRPRG

SEQ ID NO: 20727 - DNA, 672 bp, Zea mays
  misc_feature: Ceres CLONE 1389464-F
  misc_feature: Encodes the peptide sequence at SEQ ID NO. 20728
ggagctccccgcggtggcggccgctctagaactagtggatcccccgggctgcaggaattcgcacgagaccattacctagaacatcctaatcgaaaacgtcactcttgtgtcctcctaaaaccctaaccctccgccgcccctcggacccccaaccagcagctgccgcggccatccgccggcgagatggcgctgtacctgctgttcgagtcggcgtccggctacggtctattccacgcgtacggcatcgatgagatcgggcagagcgtggaggccgttcgctcctccgtgctggacctcgatcgcttcggcaaggccgtcaagctcaccgccttcaaccctttctcctctgccgtcgatgcactcaatcagtgcaacgctatatccgaagggatcatgaccgatgaactgaggagtttcctggagctgaacctgcccgaagcccaaggaggggaagaagggccaaatacagcctcggggtcgtcgagcccaaggtcggttctcacatctccgaggtcaccggcattccctgccagagcaacgaattcgtccaggagctggctcccgcggggtccgcctccacttcgaccgtttcatcaacgagctttagggattctgacttggaaaaggcccagtttgggccgggggaaaagcttacagcgggcccaaggtgga

SEQ ID NO: 20728 - protein, 163 aa, Zea mays
  misc_feature: Ceres CLONE 1389464-F
  misc_feature (3)..(69): Pfam Name: NOP5NT Pfam Description: NOP5NT (NUC127) domain
MALYLLFESASGYGLFHAYGIDEIGQSVEAVRSSVLDLDRFGKAVKLTAFNPFSSAVDALNQCNAISEGIMTDELRSFLELNLPEAQGGEEGPNTASGSSSPRSVLTSPRSPAFPARATNSSRSWLPRGPPPLRPFHQRALGILTWKRPSLGRGKSLQRAQGG

SEQ ID NO: 20729 - DNA, 668 bp, Zea mays
  misc_feature: Ceres CLONE 1389466-F
  misc_feature: Encodes the peptide sequence at SEQ ID NO. 20730
aagctggagctccccgcggtggcggccgctctagaactagtggatcccccgggctgcaggaattcgcacgagaccattacctagaacatcctaatcgaaaagttggaccctttcccactttacccccgcccttcaccgtcggaatccacccccactcgcgctgtgtcctgcgggagatggccacggccgcgaggctgcctacggttccaccgtcggctgcggcgggagatgtctccgaggtggagctctcggaggcgggatcgccggacctcggcagccggagcagcggtagcggtagcgggggcagcggccggagcacggcggagtactccgggtgggtgtaccacctcggcgtacactccatcggccacgagtactgccacctccgcttcctcgtcatccgcgccaaattcgtcgccatgtaccagcgggacccgcacgacaacccgggactcgaacctatccgaaaaggtgctgttagccccactctgatggtggaggagcttggtcggcggaaggtcaatccatggggatgtttatggttttgaggttgtacaatgggttggaatcaacaaagaaagggagagattagcatggtgctactccctgggggagcccggaaaaggaattgaagccttttggaacaatttaaacaacaggggagactt

SEQ ID NO: 20730 - protein, 123 aa, Zea mays
  misc_feature: Ceres CLONE 1389466-F
MATAARLPTVPPSAAAGDVSEVELSEAGSPDLGSRSSGSGSGGSGRSTAEYSGWVYHLGVHSIGHEYCHLRFLVIRAKFVAMYQRDPHDNPGLEPIRKGAVSPTLMVEELGRRKVNPWGCLWF

SEQ ID NO: 20731 - DNA, 646 bp, Zea mays
  misc_feature: Ceres CLONE 1389468-F
aaagctggagctccccgcggtggcggccgctctagaactagtggatcccccgggctgcaggaattcgcacgagaccattacctagaacatcctaatcaaaaaaaattcatcttcttcgtcttcatcgcagcatcggcgctccatcttctgctccctcccccacttcgtgctcgggttccatcttccgctccttcccccactcgcggtcggcacgcaggctcggccggcgtcagcggctccccatcccgccagtacaggaagagggccgccgcttggagctcgcgggaggtagcgtcgccgccgccgcatggaggtcccgaatggctgaatcctgaccgctgcctggagagtctcgcgcctaaatcacatcatattgagcttctcgccttttggatccgtcttattatttgctcacactggaaaattaattttgccctttggaggaaaaaggggggggtggctccaaaaaagggttctccgggggaaagggtatctccctccccaccccaaaaaaaaccccccttttgggggaaaaaaaaaacttgttgttttttttcaaaacccgcgggggaaaaaattttttttttcccccgccgggcggggggggggaagaatttactgggggggggctttttctccaaaaaag

SEQ ID NO: 20732 - DNA, 664 bp, Zea mays
  misc_feature: Ceres CLONE 1389470-F
  misc_feature: Translation starting site: 297
  misc_feature: SWISSPROT Homolog: EC 3.1.3.7 3'(2'),5'-bisphosphate nucleotidase
tccccgcggtggcggccgctctagaactagtggatcccccgggctgcaggaattcgcacgagaccattacctagaacatcctaatcgaaaacaacgcaggcgccgggcagtgcacgcacatggctgcgcgcgtgggcctgctcccgcacgcgatcctcgtctcctcccgagctctacccacgccccgagctcgcgtcccttatcctcttccacccgtcccttcctacctccgccacgcctcctcctccgccttccgctcctgccgcgcgtcgccgcgttttgtcgcagtccgcgccatggcttcggggaacccctacgccgccgagctcgccgccgccaagaaggccgtcaccctcgccgccaaactctgccagacagttcaacaggatattatgcattctggcgttcaggctaaggcagacaaaagtcctgttacagtggctgattatgatctcaaatatttggccggttttcctaaaagatggatgtatcatctggaccattttcattggtggctgaagaggactcagatgaatggagaaaaagatgcgctgaagaaattttgggagatattactggacctggcaatgaaacatcttttgatgaggttcatataacatttcatttacaagggaagtatactctctgcaatggatgatgcgag

SEQ ID NO: 20733 - DNA, 732 bp, Zea mays
  misc_feature: Ceres CLONE 1389471-F
aaagctggagctccccgcggtggcggccgctctataactagtggatcccccgggctgcaggaattcgcacgagaccattacctagaacatcctaatcgaaaaagtaccgcaccaccaccaagcaccgcaaccggagccggagccagaggagggcgagaggccgagggtagaggagcgaaggaggccgccgaccgaccgtgcgtccggccccgcggcggcgtcggcaggtcgtagacggcagacgaggagcagcagcagcacgaggcggtcgggccccggcccacgccattgccggagaaggaggcgcaagccgccgcgtttttgcggcaaggtggtgattcgccgagttcgagtcccttcaccggttacccccgccgcccgtggaagggcggatacgtttcccccggattcttgggaaacaaaccccttgggcccgagtaccttctcggttgccgggggcctttcgggggcccgtacccgaactccccccacgttttcccggggctttgtggtgccgttttttttcaatgatatgtcgtaatattttggcccctttatttttgggggtttttctccgtaaggtggtacccactttccccctgtgtttttctccccccaaaggccctttccccctttcctttttctcttttaaacttcttgggcaaccaaggcaataggtggaaacaagccccacacaacccccctccccccttctttaaccccggagagaag

SEQ ID NO: 20734 - DNA, 650 bp, Zea mays
  misc_feature: Ceres CLONE 1389475-F
  misc_feature: Encodes the peptide sequence at SEQ ID NO. 20735
  misc_feature (374)..(374): n is a, c, t, g, unknown, or other
acccgcggtggcggccgctctagtactagtggatcccccgggctgcaggaattcgcacgagaccattacctaaaacatcctaatcgaaaaagaggctaaacccccgtctaaccctgctgccgtgccgcttgccactactccgcttcgttctccgccgcctccccggacgtccggaaacttctagattgaagggggatagccattggcgtcaacgtgtgtgatggaggtcaggggactggggcagctcctggcggcgctggccgcggcgttcttcgtccgcgccatcgcgggacccggccccgccctccttccgccggcggaggacacggaggccgacgaggccgacgcggaggctgcgagggaggtgggttggntggtgtgccgcccgtgaccatccggtgggctcgcatcacctgcgcactgaagaacaagcgcggggaagtggcaaggtttctgttgtcaaatgtgtcaggggaggcgaaaccggggaggctgcttgcactaatggggccatcgggctctggcaaacaactttgctcagtgtgctagcagggcagctcgccgcatcgtcttcctgcacctttccggggttctgtatatcagtggtcggcctatctcgaaggcgggatatagattgcttttgtcgggag

SEQ ID NO: 20735 - protein, 56 aa, Zea mays
  misc_feature: Ceres CLONE 1389475-F
  misc_feature (52)..(52): Xaa is any aa, unknown, or other
MEVRGLGQLLAALAAAFFVRAIAGPGPALLPPAEDTEADEADAEAAREVGWXVCRP

SEQ ID NO: 20736 - DNA, 803 bp, Zea mays
  misc_feature: Ceres CLONE 1389476-F
  misc_feature: Encodes the peptide sequence at SEQ ID NO. 20737
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (30)..(30): n is a, c, t, g, unknown, or other
  misc_feature (31)..(31): n is a, c, t, g, unknown, or other
  misc_feature (785)..(785): n is a, c, t, g, unknown, or other
ttgcccccctccccccccnnnnncccgtannagatgggccggtccccccaaactggcgctccccgcggtggggggcgcttatccctagtggatcccccgggctgcaggatttcgcacgagaccattacctagaacatcctaatcgaaaaaacgatcggtcgggactccggactcgggagtcggcactcgggtctcgacgtctcgtctcgtctcgtctcgcctgcccgcagccccttggcttcgttccatccggcttctcggcggcggcggagaggagggggatggcgcaccggctgctgcgcgacgcgcaggtggacgggtgggagcggacggacttccccatcatctgcgagtcatgcctcggcgacaacccctacgtccggatgttaagagctgcataatgccaaagaatgccaaatttgtgcacgccctctttactgtcttccgggtggcgtcccgcccccacccgtacaggcactacgaacaccgcacatccgcccaagaattgcccgccaggctacccccacgcctcgcccccacccgcccggcgtggctccctcggacaatgcgtcccgccctctggacccgcacacaccccaccccccccctcccacccgccccctaccacacccgcaccccccccccaccccgcacccccacccgcctgcatccgggtcacgccgctccagcacaaacaccaccaccccggagtggtgcctcggtgtaccactatcgcaccgccacgccccggggcgtctgatgaccttcccgccgtccccaccccngttcccgtgccccacccg

SEQ ID NO: 20737 - protein, 39 aa, Zea mays
  misc_feature: Ceres CLONE 1389476-F
MAHRLLRDAQVDGWERTDFPIICESCLGDNPYVRMLRAA

SEQ ID NO: 20738 - DNA, 662 bp, Zea mays
  misc_feature: Ceres CLONE 1389480-F
  misc_feature: Encodes the peptide sequence at SEQ ID NO. 20739
  misc_feature (356)..(356): n is a, c, t, g, unknown, or other
  misc_feature (486)..(486): n is a, c, t, g, unknown, or other
  misc_feature (537)..(537): n is a, c, t, g, unknown, or other
  misc_feature (569)..(569): n is a, c, t, g, unknown, or other
  misc_feature (578)..(578): n is a, c, t, g, unknown, or other
  misc_feature (608)..(608): n is a, c, t, g, unknown, or other
tccccgcggtggcggccgctctataactagtggatcccccgggctgcaggaattcgcacgagaccattacctagaacatcctaatcgaaaaaagatgaatgctacgtaggtagacagtgttcttgtggtgacgtgacctccacagagtgcagagatgggagaagctgaagaagcgccaggagacagcaatggtgaggcactggagctcctcatgtccatggcgtcctcttcgctggcctgctctgtctcgcagttcccagccaagtggcagtccatcaaggacaagctccagctgctctgctgcagcctcaattcactctgcggcggcggcggtgaccacgacgacgacgacgacnaggagcatcctgtgttggctgagcttctgcggctggcttcagcaaccgtgaggagcatcccagtcgttgcttctcagtgcagcgacgggtcatacaagggtggaaggcttcgtctgaggagcgacctggnacacctgagctgcaagctcgatgcgcacatgaagcagcttcaggagatggncgtctcgtccggggcgccgtcgccgtccaggncattgtcgncgtcaggcccagcgcgagggcagcgtgggntgaaaaagccttcttactcaggatctcttttccaggatcaggatcgggggcacc

SEQ ID NO: 20739 - protein, 169 aa, Zea mays
  misc_feature: Ceres CLONE 1389480-F
  misc_feature (68)..(68): Xaa is any aa, unknown, or other
  misc_feature (111)..(111): Xaa is any aa, unknown, or other
  misc_feature (128)..(128): Xaa is any aa, unknown, or other
  misc_feature (139)..(139): Xaa is any aa, unknown, or other
  misc_feature (142)..(142): Xaa is any aa, unknown, or other
  misc_feature (152)..(152): Xaa is any aa, unknown, or other
MGEAEEAPGDSNGEALELLMSMASSSLACSVSQFPAKWQSIKDKLQLLCCSLNSLCGGGGDHDDDDDXEHPVLAELLRLASATVRSIPVVASQCSDGSYKGGRLRLRSDLXHLSCKLDAHMKQLQEMXVSSGAPSPSRXLSXSGPARGQRGXKKPSYSGSLFQDQDRGH

SEQ ID NO: 20740 - DNA, 672 bp, Zea mays
  misc_feature: Ceres CLONE 1389482-F
  misc_feature (457)..(457): n is a, c, t, g, unknown, or other
  misc_feature (458)..(458): n is a, c, t, g, unknown, or other
  misc_feature (460)..(460): n is a, c, t, g, unknown, or other
  misc_feature (527)..(527): n is a, c, t, g, unknown, or other
  misc_feature (530)..(530): n is a, c, t, g, unknown, or other
tcaccgcggtggcggccgctctataactagtggatcccccgggctgcaggaattcgcacgagaccattacctagaacatcctaaaaaaaaaaccgctatggtccatccacatccacagtcgccatcgcccccacctctcaccgtcgtcttcgtgcaccactcggcctccactgccggtcgcgcctcccagccacctcgtgccgctctgccaccccgcgcatcctccaccgcccctatggctgccacgggcgagcgctgcccgagcagtcgaccgccctttccgtgccgccccgcctccccgctaggcctccactgcccactgctccggcgcctacagtggaaggcaaggagaaggacatcgggcggcggtagctggatctggcaagcacaaggccgcgcccccggcggcgcctggatctgcgttgctgcaacccccccccccccccaccccccccannanacacacacaaaaaagatctgctacagggacaatctgatggtcggcgcatcgcctagaggcccgtggntgnagagtcacgcctcctcagccctcatcctcacgtcgtccccaccgaagatccgcccaacggcccctgacccgacaatgacgattatcttattgctagcaccgatgggggtggagacaaaagctgaagcttgctttcaaaactg

SEQ ID NO: 20741 - DNA, 779 bp, Zea mays
  misc_feature: Ceres CLONE 1389493-F
  misc_feature (6)..(6): n is a, c, t, g, unknown, or other
  misc_feature (31)..(31): n is a, c, t, g, unknown, or other
  misc_feature (32)..(32): n is a, c, t, g, unknown, or other
  misc_feature (37)..(37): n is a, c, t, g, unknown, or other
tttttnttttcttttttttttgtaaattttnnattanggggcccccccaaaaagtggagctccaccgcggtggcggccgctctccaatagtggatcccccgggctgcaggaattcgcacgagaccattacctagaacatcctaatcgaaaactcctccattcctctccctctctctctcgtcggtgggaccgtgggatacgctgacggacggacgggctgaggcaaggccgcctgcgggcgggaggaagaaaagcgaagctgctgcgccctcccctcccccatctccgccccccgcctcacccaccagacgagagagcgagcgcagttcggccgccggtcgcgtccgactccagcaaagccgagcgcccaccccctcaccctattaccttccctctcggttccaattcggggcctggctgaactccggcacgttttccccccttttccctccctcgaacgaagaccgttccgtccaccaccggaatccaaggagcgaccctccctcggggtccgtcgacgatcgaccgggccgcccgatcggccaagaaagggaggccgagccctccagggagccgcttgggtccccggagaacctgcccaaagttggagtattaaaagaactccggacgagttcggggacgctgggggagttcgggagggcccccgggccgggcgaacaacccaccccccagcaactggggcaaaaaacccggcaggaaggtttcccggggaaacaattgggcagacccccctacaaaaggggctatttcccatacgg

SEQ ID NO: 20742 - DNA, 668 bp, Zea mays
  misc_feature: Ceres CLONE 1389494-F
  misc_feature: Translation starting site: 245
  misc_feature: SWISSPROT Homolog: EC 1.14.13.93 (+)-abscisic acid 8'-hydroxylase
  misc_feature (395)..(395): n is a, c, t, g, unknown, or other
  misc_feature (532)..(532): n is a, c, t, g, unknown, or other
  misc_feature (607)..(607): n is a, c, t, g, unknown, or other
  misc_feature (626)..(626): n is a, c, t, g, unknown, or other
acccgcggtggcggccgctctatccatagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggncttaccttggcgagaccctccagctttactcccaggaccccagcttcttcttcgcttcaaacagaagaggtacggcgagatcttcaagacgcaccttctgggttgcccgtgcgtgatgctggcgagcccggaggcgncgcggttcgtgctggtgacgcaggcgcacctgttcaagccgacctacccgcggagcaaggagcgcatgatcgggncgtcggctctcttcttcancagggggactaccacctcccgcctcgcaagttcgtccagggg

SEQ ID NO: 20743 - DNA, 735 bp, Zea mays
  misc_feature: Ceres CLONE 1389495-F
  misc_feature: Encodes the peptide sequence at SEQ ID NO. 20744
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (20)..(20): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (39)..(39): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
gcccccccnnnccccccccncccccnnngngnnngggtngcagcccctcccnnnccaaaactggaactccaccgcggtggcggccgctttacaactagtggatcccccgggctgcagtaattcgcacgagaccattacctagaacatcctaatcgaaaataccttcaataagaatggctccatgatatttctggatttgtcatttaatcagcttgactcagagatcccaaaggagcttgggaacatgtactacctcatgatcctgaatcttggccacaacttgctgtctggcgtcatcccaccagaactagctggtgccaagaagcttgctgtactcgacctgtcacacaaccagttggaagggcctattcccaactctttctcgacgttgtccttgtcggagatcaacctttcaaataatcagttgaatggttcaattccagagctcggttcgctgttcacattcccgaagatttcatatgagaataactctggtctttgtggcttcccactgttgccatgcgggcacaatgctggctcaagttcttccgatggccaccgatcccaccggaaccaggcttcactcgcgggtagtgttgctatgggactcttgttctcgctgttctgtatagttggaattgtcatcatagttgttgagtgcaagaagcggaagcagatcaatgaaggagcaagtacctctcgtgacatatactttgatagccggcctcattctgc

SEQ ID NO: 20744 - protein, 184 aa, Zea mays
  misc_feature: Ceres CLONE 1389495-F
  misc_feature: SWISSPROT Homolog: EC 2.7.11.1 Non-specific serine/threonine protein kinase
MIFLDLSFNQLDSEIPKELGNMYYLMILNLGHNLLSGVIPPELAGAKKLAVLDLSHNQLEGPIPNSFSTLSLSEINLSNNQLNGSIPELGSLFTFPKISYENNSGLCGFPLLPCGHNAGSSSSDGHRSHRNQASLAGSVAMGLLFSLFCIVGIVIIVVECKKRKQINEGASTSRDIYFDSRPHS

SEQ ID NO: 20745 - DNA, 690 bp, Zea mays
  misc_feature: Ceres CLONE 1389496-F
cgctcttaactagtggatcccccgggctgcaggaattcgcacgagaccattacctagaacatcctaatcgaaaagagaagagggcgggcatcggccagtgggggctcggaggccgagggaggcgaggaaagcggcgggtgccgggccgcccgcgccggtgccgaggccctcaccagtcaccaccccctcccctcttccgtctgtcccccgcttgccgccaccgccgctgcctgctcgcgacccttcccccttttaacgctcccgcggccccgcgtcgtgctcccttttgtcgccgctgccttcgtgcccgtactcgcgggttctcctcgctcctcaatctccgcgcctgggcgcggcgttcgccgccgaatctgggcgcgggacggtgccccggacggtcgatgggcgcgggtggcgctccggttggacgcccgggcgctcgcggttctcgtcctcgtgtcaggggttctgcttccatttgtcagttcccgacgatggaaccaaaccctgggaaggtggtttccaagggtcttggacggaatccccccccgcggggggcggggaaggaccggcaacaaaacgtgaccccccaagggatttcggctcctcctcccctcccaatctccctagagattgggaagggccggcacaccaaccttttcccgtgggtttccataaaacaaaagcttg

SEQ ID NO: 20746 - DNA, 655 bp, Zea mays
  misc_feature: Ceres CLONE 1389499-R
ccgattgggtaccgggccccccctcgaggtcgacggtatcgataagcttttttttttttttttttaaaaagaaattacaatcctaatacatgttgaaaaaaagtaattgtatcgtacgaacaaactatggcaccattttagctcacccgataatacactgagaaaataagcataacaagcacgatcgatcttacaggacgatggatgatggtccttggtaacataactcgtttttatatgtcagcattatctttgccatctgccgaccaggatgtaataactggacattgatcatcgattagaccatgctccaggagtatctttccacacagctcacaggaagttccgctgaacagcaccagacgcgaaacgggaagataatccttgcgacatgttctctgcgtctaaggccacattctggcgcccagcagacagatccttctcccggtcccatggcttccatgggtggtttccctcccattcctctttctcgtgctgcttttgcttctttttctcctttttgctctctcggtgcttctgcacaagcgacactgatcgtttggaggtgttgtatttatctacgattgaagcatccgggtttttgctcttcacgtcgtcgccttctgcaattgcctttgtcttattgtaggcttct

SEQ ID NO: 20747 - DNA, 657 bp, Zea mays
  misc_feature: Ceres CLONE 1389500-F
  misc_feature: Encodes the peptide sequence at SEQ ID NO. 20748
  misc_feature (550)..(550): n is a, c, t, g, unknown, or other
  misc_feature (557)..(557): n is a, c, t, g, unknown, or other
  misc_feature (588)..(588): n is a, c, t, g, unknown, or other
  misc_feature (627)..(627): n is a, c, t, g, unknown, or other
tccccgcggtggcggccgctctagaactagtggatcccccgggctgcaggaattcgcacgagaccattacctagaacatcctaatcgaaaaacgccaaagatttcctcttccgcctgcgcttccctttgccccgctctcccccagcctcgctcgccatataatacgggccggccggccggccagctgggtccccgcggatgggctcggtctcgcggggctagggtttggtcggtcgtctcgccggcgtcgaggccgccagcgctgctagctagctctctcgcgttagggttccccgtagccatggtgctgcagcgcttctcgtggccgtacggcggccggagcgccaccttctgcggtagcttcaccgggtggagagagtgtcccatggggctggttggggccgtgttccaggtcgtcttcgatctgccccccggagttaccagtaccggtttttggttgatggtggctggaggtgtgatgagacaaaacctttgtacgtgatgaatatggactgatcagcaatgaagtgcttgtggaaaaacatgtacnacctggntgtgcagcagagccttctatcagaggactantattggataagggtaccatttttgaaaacatgcccccgnagccatcatctcagaacccagcatgcaaaa

SEQ ID NO: 20748 - protein, 66 aa, Zea mays
  misc_feature: Ceres CLONE 1389500-F
MVLQRFSWPYGGRSATFCGSFTGWRECPMGLVGAVFQVVFDLPPGVTSTGFWLMVAGGVMRQNLCT

SEQ ID NO: 20749 - DNA, 685 bp, Zea mays
  misc_feature: Ceres CLONE 1389508-F
  misc_feature: Encodes the peptide sequence at SEQ ID NO. 20750
aaagctggagctccccgcggtggcggccgctctataactagtggatcccccgggctgcaggaattcgcacgagaccattacctagaacatcctaatcaaaaaagcaccgtccacctccaccatctttcctcttcctcctcgcctccaccccttcccttccatctcctcccacccggcgactcctcttcctctctgccgcgccgatcgattggcccacccatcgatcgagcacggggaagaagattccagtccggagtggtttcaattcggtcgggttcgttgcccgtgtgggtgggcgctatggcggcgatggatgcctcggcagataagaacgccgtcttccgcaagcttcgcgccaaatcggacaacaagatgtgctttgattgcaacgccaagaacccgacgtgggcgtccgtcacctacggcgtcttcctctgcatcgactgctcgggggcgcaccgcagcctcggcgtcccacgtctccttcgtcagggcaacaaatttggattcatggactccagaacaactggaaaatgatggtctatgggggaaaataacggtggcgcaagctttctttaaacagcatgggttggacagatgggtgaaaaaattgaagcaaagtatactttcaggagctggtgacttggaccgacaggtggcttgctaaaagacgttgctaaaagcg

SEQ ID NO: 20750 - protein, 78 aa, Zea mays
  misc_feature: Ceres CLONE 1389508-F
  misc_feature (11)..(78): Pfam Name: ArfGap Pfam Description: Putative GTPase activating protein for Arf
MAAMDASADKNAVFRKLRAKSDNKMCFDCNAKNPTWASVTYGVFLCIDCSGAHRSLGVPRLLRQGNKFGFMDSRTTGK

SEQ ID NO: 20751 - DNA, 877 bp, Zea mays
  misc_feature: Ceres CLONE 1389509-F
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
ttttccccaccccncnncccccccctctccaccctcctttgatgttagagcaaactgtaactcaccgcgctggcgcccgctctttactagtgaatcccccgggctgcaggaattcgcacgagaccattacctagaacgtcctaatcgaaaaacggtgtcctgcacttgcacccctatgccgtcgccgcggcggcagcggcattgatctcggcgtacatggtgtggttctggccgctgacgcgacggttgtccggaccggggatgtggcccctcggcggtggcctgcccagggcccccctggaaccggccgcggttccacgactggcaccgtccaacaaccctgcgttccaaggggggaagcgcccacgtaaacgaaggggaatcttggcggtggcccgtcatcggcgcggccccccaggagtttgatggcccgagcaaggaggcaaacccgggggaacccctggaagcaacttcctgggccgcgcgcggtctccgaacacttaccccccaggggccccacttggggggcaaggcccggccgtcttccagccgacccccccccggatccgaagaggccatccgatcaacccgcgcgaaaggagccgtcatactgcccctcgcgacctcacaccctcacacccgtgactctcctccctccaacaaccgccagtgcgacacgtcccttccccttccaccccctcttctcctcccacaccaccacacaaaagacgttaaaatatgtaaaaaaccacgcgatcaggggcgccgtgtcctacccccctccccccccccatgcactaagaactcgcaactacactagaaaaaatattgatcatcacaatgttccagagcgtaataggtacaatattcaaaccac

SEQ ID NO: 20752 - DNA, 841 bp, Zea mays
  misc_feature: Ceres CLONE 1389514-F
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
ttccccccccccnnnnnnnnntattttcacaatcttggcgccgcacgcaacgaaatggtactccacgcggtggcggccgctctaaaatagtgcatcccccgggctgcaggaattcgcacgagaccattacctagaacatcctaatcgaaaaaacctaaacctcgtctcgcctccttcagtccatcccctcaaccccggcggacaaaagccggcacatcgaagcgagggccatggcggagctaaagcgactgtcatagagccggaacctgacgcggatctagcgcatcggggcgcactcccacatcggggcgctaggggtggactcctccatggaggcgcgcgacgcctcggaaggcatgggcaggacaaatgatcgcgcggcggggccgggggacttaataattcaagatcatcccgcagggccaaaatcgtcggatcggggcgtttctccttcgcgggggcaggcccggggaaccgtcgaagagcggggcctcgccatgaggtattggtcaaggcctcctcggggggggggggaagtcggcctgggaaaatccggaaggcaggccccgaggagtgtcccttcctcgcctcgccaccgcctcccaagaaaagctgagggcgattacacgccagaggcattacccccagaagggccatcgggtggtgcggcccgtcacaggggtggcagaatcggaaacacccatacccggggaccggggagcaccgtccgcggaccctaagcgcccgaaacaatccactatagacagacagaagtaatggtgcgggatggaggtaaagagacgcaggggatgcgccagctccatagaagcgcataaacggc

SEQ ID NO: 20753 - DNA, 686 bp, Zea mays
  misc_feature: Ceres CLONE 1389521-F
  misc_feature: Encodes the peptide sequence at SEQ ID NO. 20754
  misc_feature (188)..(188): n is a, c, t, g, unknown, or other
  misc_feature (345)..(345): n is a, c, t, g, unknown, or other
  misc_feature (389)..(389): n is a, c, t, g, unknown, or other
  misc_feature (406)..(406): n is a, c, t, g, unknown, or other
tggagctccccgcggtggcggccgctctatcactagtggatcccccgggctgcaggaattcgcacgagaccattacctagaacatcctaatcgaaaaagttccatcccaatcgccgagaaggggaagccaaatcgatggcggcggcggcgcccggcggcgagaacagcggcgcggccgcggccgcggncgagggcgagttctacttgcggtactacgcacaccggccggtgaccctggcgtgggagcctctctctctctctctctctctcccctcccgcatccggtggatcgtcaacgccgcccggcccgggcggcagcgccgcgcgccacctgagggcagcggnagccagcagccgctgctccaccagggcggtcgcgccgctttttnagcgcttatgaccccgntccgctgagcgcttagtggaggtttttggaacatgagacctcctagcagtggcaaaaagattgaggtctcccataacgtgagaaatggggggggtttctggtcaagcttggcatggcaaatggccaagctggggcatcgaggcaaaacccttttttgtgctgggggggaagaaagtctccctggttgcccggcagcccaccttgggggggggggccccccaaggaaattggggggggcacgagactttttaacaattggtccgggctgattgtctcaaca

SEQ ID NO: 20754 - protein, 92 aa, Zea mays
  misc_feature: Ceres CLONE 1389521-F
  misc_feature (18)..(18): Xaa is any aa, unknown, or other
  misc_feature (85)..(85): Xaa is any aa, unknown, or other
  misc_feature (91)..(91): Xaa is any aa, unknown, or other
MAAAAPGGENSGAAAAAXEGEFYLRYYAHRPVTLAWEPLSLSLSLPSRIRWIVNAARPGRQRRAPPEGSGSQQPLLHQGGRAAFXALMTPXR

SEQ ID NO: 20755 - DNA, 664 bp, Zea mays
  misc_feature: Ceres CLONE 1389523-F
  misc_feature: Encodes the peptide sequence at SEQ ID NO. 20756
cgctctttcctagtggatcccccgggctgcaggatttcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggagaagaaggccaaggcggagaagcggctacctgcgggcaagtccgccggcaaggagggcggcgacaagaaggggaggaagaaggctgagaagagcgtggagacctacaagatctacatcttcaaggtctgcgttctcccccaattcgccttcacctcggcggcttcctccttgacccgcaccggtgacgtcgtcttccggcgaggtaactcgccggaaaacctcacctggattttttcggaggacccctccaacattcttttacccctccggaagggccccctggttttaaacccgcaaaggcccaattcccggttggtttcctcgagggccccatccgcctctttttggttttggaaagggcccccgtgggtggccccggggggatccccataccccctttttattcgg

SEQ ID NO: 20756 - protein, 168 aa, Zea mays
  misc_feature: Ceres CLONE 1389523-F
MAPKAEKKPAAKKVAEEEPSEKAAPAEKAPAEKKAKAEKRLPAGKSAGKEGGDKKGRKKAEKSVETYKIYIFKVCVLPQFAFTSAASSLTRTGDVVFRRGNSPENLTWIFSEDPSNILLPLRKGPLVLNPQRPNSRLVSSRAPSASFWFWKGPPWVAPGGSPYPLFIR

SEQ ID NO: 20757 - DNA, 744 bp, Zea mays
  misc_feature: Ceres CLONE 1389532-F
  misc_feature: Encodes the peptide sequence at SEQ ID NO. 20758
  misc_feature (231)..(231): n is a, c, t, g, unknown, or other
  misc_feature (342)..(342): n is a, c, t, g, unknown, or other
  misc_feature (364)..(364): n is a, c, t, g, unknown, or other
aagctggagctccccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaccggggtgcgacgggaggtggcggnggctacggcgacctccagcgcgggggcggcatgcacggcgaggcgcagcagcagcagaagcaggccgccatgatgacggcgctcaaggccgcgacgggcgcgaactttcgngggtcaatgctggtgctgtccnggctgatcctggcggcaccgtgatcgcgctcacgtggccaaccccgtggtggggatttcagcccggggtgggggccgcccccatccggttggggcctaggggggcgggttctccacccccgggggcccccggcccctggccttcccggttcctccgggagcaaaaatccttgaggggaaacccccccgggccccaaacttgtgacccccaaagggaggtgtggcccaagcccccacactcagggtgggaaacaccccctttaccccgggggggtgtttaaaaaaaaacccccctggggggcgggggggaccccttttaaaaatagggggggggggaaattccccacaaaaagggggggtggtccaaaccccgcgcaaaaa

SEQ ID NO: 20758 - protein, 64 aa, Zea mays
  misc_feature: Ceres CLONE 1389532-F
  misc_feature (58)..(58): Xaa is any aa, unknown, or other
MADHHRGATGGGGGYGDLQRGGGMHGEAQQQQKQAAMMTALKAATGANFRGSMLVLSXLILAAP

SEQ ID NO: 20759 - DNA, 724 bp, Zea mays
  misc_feature: Ceres CLONE 1389533-F
  misc_feature: Encodes the peptide sequence at SEQ ID NO. 20760
  misc_feature (448)..(448): n is a, c, t, g, unknown, or other
aaagctggagctccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttccacctcgaaacagggtatgtggaggtggacgaggacgccggcgcggagctcttctactacttcgtccgggccgagtccggcgccgacgacagcgacaccccgttcgtcctccggatccccggcggccaacgctgctcctccttcagcggcctcgcctacgagataggtcccatcatgtttgtcgtggagccctacaacggnagcttgccgcgcctgcgctacaacccaaactcgtggacaaaggtggcgcatattctttttgtggatcaccagttggggccgggttttccttctccgagatgccaaagttaacacgctggagcggaatcaaccacgatgcacttggcgaagttcttcaccaggggttcaatgaccatcccgagtacatgcaaatcctttctacctcgatggagatcatacgctggaaaattggaccatccctgcacagatgatttcagaaagtattgaacaaggatg

SEQ ID NO: 20760 - protein, 144 aa, Zea mays
  misc_feature: Ceres CLONE 1389533-F
  misc_feature: SWISSPROT Homolog: EC 2.3.1.91 Sinapoylglucose--choline O-sinapoyltransferase
MTLVRMPCRLCCFLLVVAASAVSGRGRVVTTLPGYEGRLPFHLETGYVEVDEDAGAELFYYFVRAESGADDSDTPFVLRIPGGQRCSSFSGLAYEIGPIMFVVEPYNGSLPRLRYNPNSWTKVAHILFVDHQLGPGFPSPRCQS

SEQ ID NO: 20761 - DNA, 657 bp, Zea mays
  misc_feature: Ceres CLONE 1389535-F
  misc_feature: Translation starting site: 261
tcttcactagtggatcccccgggctgcaggttttcgcacgagaccattacctagaacatcctaatcgaaaagctttcttaaaggtgtattgtgcttctcctccccctccggttcggatgcggtctcgtgaggatctccgcgactcggtttcatgcgagacggaatcaagatggcggagatgcctgctgagtaccgctgcttcatcggcggcctagtctgtgcaattaacgaacattctctacataacgccttcaggacctatggctaggccctcgagacgaatatcttcctcgatcggaatacttatagtacctctagcttcggatttgtgtccttcgccacggaggacgcgatgtaggagcgccatcgaggtcatgagcgtccacgagatgaacggccgctacatcaccgacaacgacgccaagtcccgcgtcggccgcggaggcttggtcttcgccgactgcgtggtccggataggcggcgtgtatctcgtcgacgtgcgccgtgatggcggtgtggactatggcttcgatatcccctacggcgactgtggcctctacggtgaggccgacggcgtttagcggggtggcaacatgggtggggcttacggaaactccgacaggaatagcagaactgaatcggggggaactgcttggc

SEQ ID NO: 20762 - DNA, 705 bp, Zea mays
  misc_feature: Ceres CLONE 1389538-F
  misc_feature: Translation starting site: 367
  misc_feature (335)..(335): n is a, c, t, g, unknown, or other
  misc_feature (531)..(531): n is a, c, t, g, unknown, or other
  misc_feature (549)..(549): n is a, c, t, g, unknown, or other
  misc_feature (563)..(563): n is a, c, t, g, unknown, or other
  misc_feature (627)..(627): n is a, c, t, g, unknown, or other
  misc_feature (705)..(705): n is a, c, t, g, unknown, or other
aagctggagctccccgcggtggcggccgctctagaactagtggatcccccgggctgcaggaattcgcacgagaccattacctagaacatcctaatcgaaaaaggacctgcttgtttgattgtttcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggngggctagctagctgagctcgtgcgacgaagaatggccggaattggcaggaacatggtggcgccgctcctggtgctcaacctcatcatgtacatcatcgtcatcggcttcgcgagctggaaccctgaaccacttcatcacgggcagaccaactaccccggcgtggccggcaacggcgcgacgttctacttccctggntgtcgccatcctggccgncgtggtgggcgcgncgtccaagctggcgggcgtgcaccacgtgcgcgcctggcgccacgacagcctggccaccaacgncgcgtcgtcgctcatcgcctgggccatcacggcgcttcgcttcgggctgccctgcaagagatccacatcggcggacan

SEQ ID NO: 20763 - DNA, 785 bp, Zea mays
  misc_feature: Ceres CLONE 1389542-F
  misc_feature: Encodes the peptide sequence at SEQ ID NO. 20764
  misc_feature (785)..(785): n is a, c, t, g, unknown, or other
tactcctctatttcctccctcccatcaaactatggcgcgaccacctcaaactggaactccccgcggtggcggccgctcaatacctagtggatcccccgggctgcaggatttcgcacgagaccattacctagaacatcctaatcgaaaaacaccaccactgggtcttccgaccattagctttatctactccagagcgtagaagaacccgatcgacaccatgagggtgttgctcgtagccctcgctctcctggctctcgctgcgagcgccacctccacgtatacaagcggcggctgcggttgccatacaccgccgccggttcatctaccgccgtcggtgcatctgccacctccggctcacctgccacctccggagcatctcccaccgccggtccacctgccgccgccggtcctcctgccaccgccggtccatgtgccgacgccggttcatctggcgccaaccaccatgccactacccctattcccccgccccggcctcaagccctcatccccaggccaacccatgtaccggtgccaccagccggaatccaagcctcgtgcccaggtgcagggtaacctgcggccgctgtccaccaccccgaaacttgggggcagtgcggtctagttccttgcaggaacccgggcgaccccgacgggggacggccctactgctcgccctcagaggttgatcgcctcccggctgaaatgattcgccggccgtttcaaggccctgggcacccgccccccccgtacactacggcccctccctctatttggaccactccaan

SEQ ID NO: 20764 - protein, 33 aa, Zea mays
  misc_feature: Ceres CLONE 1389542-F
MYRCHQPESKPRAQVQGNLRPLSTTPKLGGSAV

SEQ ID NO: 20765 - DNA, 654 bp, Zea mays
  misc_feature: Ceres CLONE 1389543-F
  misc_feature: Encodes the peptide sequence at SEQ ID NO. 20766
  misc_feature (292)..(292): n is a, c, t, g, unknown, or other
  misc_feature (453)..(453): n is a, c, t, g, unknown, or other
  misc_feature (512)..(512): n is a, c, t, g, unknown, or other
  misc_feature (533)..(533): n is a, c, t, g, unknown, or other
  misc_feature (534)..(534): n is a, c, t, g, unknown, or other
  misc_feature (607)..(607): n is a, c, t, g, unknown, or other
ggagctccccgcggtggcggccgctctacaactagtggatcccccgggctgcaggaattcgcacgagaccattacctagaacatcctaatcgaaaaaactagtttctatcttgctccccaaaccagcgcaaaccctgccctgacaccggcagcgacacgtccaccggcggcgccatggtgctcgaggcaacgatgatctgcatagacaattcggaatggatgcggaacggcgactacgctccgtcgcggttccaggcgcaggccgatgccgtcaacctcatctgcggcgccnagacccagtcaaacccggagaacacggtaggcgtgatgacaatggcccgggaagggtgttcgcgtgcttgtcactcccaccagcgacctcgggaagattctcgcctgtatgcacgggttagaagttggcgctgagggcaacttggctgcggcaatccaggntgcccagcttgctctaaagcatcgccagaacagaggcagcagcagagggatatagtttncattggaggccctgtgagacnnaaaaagaaaggtttgagaccatttggaaggaagctgaaaaggacatgttgctctggacattggtggacttggnggaacccgatgatgaaaaacctgagaactgaaagcatgggatggtgc

SEQ ID NO: 20766 - protein, 83 aa, Zea mays
  misc_feature: Ceres CLONE 1389543-F
  misc_feature (40)..(40): Xaa is any aa, unknown, or other
MVLEATMICIDNSEWMRNGDYAPSRFQAQADAVNLICGAXTQSNPENTVGVMTMAREGCSRACHSHQRPREDSRLYARVRSWR

SEQ ID NO: 20767 - DNA, 708 bp, Zea mays
  misc_feature: Ceres CLONE 1389545-F
  misc_feature: Encodes the peptide sequence at SEQ ID NO. 20768
  misc_feature (12)..(12): n is a, c, t, g, unknown, or other
  misc_feature (14)..(14): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (39)..(39): n is a, c, t, g, unknown, or other
ggtttgcccccncnccncnnntcccccccccccctaccngctccctccccgtcaaagtgtgactccccgcggtggcggccgctctagaactagtggatcccccgggctgcaggaattcgcacgagaccattacctagaacatcctaatcaaaagtttatacgttcagggctactattgaagcagactccacccggcgcgtcctcgtctcgtctcgtctcgcacgcacccctcactttccttgtcaatcgactcgcgatcgaatccgccccgagtcgattccgccgcggaccgcccggttcacttcccttttctcccgagatctcgactctcgagcaagtatgggtgaggcgaaggacaacgaggtgtacgaggaggacctagtcgactatgaggaggaggtggagaatgtcattgatggcgcccccaacaacggctcctcagatgtcgccaagaggggtacgtagggatcaccggctcggggtcaaagacttcctgctcaagccgaggtttcttccgccattagggattgggggttttgacactcccttctggaggggaaaagggaggggcctccccctccaggtttttttttggggaaggggagtggcgccctgttgcgccaaagccaaaaaacctggggggacgggggcgaaaaaaatcccggtgcgtgtcttttttttcggccctcgtggggaacaacccatccc

SEQ ID NO: 20768 - protein, 41 aa, Zea mays
  misc_feature: Ceres CLONE 1389545-F
MGEAKDNEVYEEDLVDYEEEVENVIDGAPNNGSSDVAKRGT

SEQ ID NO: 20769 - DNA, 676 bp, Zea mays
  misc_feature: Ceres CLONE 1389548-F
  misc_feature: Encodes the peptide sequence at SEQ ID NO. 20770
aaagctggagctccccgcggtggcggccgctctataactagtggatcccccgggctgcaggaattcgcacgagaccattacctagaacatcctaatcgaaaaagggaccaaatcaactcaagtcatcgagtccacagctcgcgcgcgctgccgccagccaatcgctctgcctccggcctccgcagcccaaaaccacctcggccccacttcttctctccgtcgccccctgtttgcccaacccatggcgacccacgccagcgacaatggcagcgggcacgcggagtggcggttcgctcgtgcggcgaaggagggtgcgctggccgtggccggggacaagatgagcatcccggcggcgcggttcaagatcagcgcgagcgtggacgggcgcgacccgcggcccgtgctgccgcttgcgcacggggacccctcggtgttcccggccttcggcaccgccgccgaggccgagaacgccgtgggcgccgcgctccggacgggcaagttcaactgctaccccggcggggtcggcctccccgaagcccggcgtgctctggcggagcacctgtcaagtgatcctccatacaagctgccaactgaagacatcttcctcaccgtgggaggactcaaggccttggaggtggccgctcagccctggccaaccgagggccacttattgctc

SEQ ID NO: 20770 - protein, 145 aa, Zea mays
  misc_feature: Ceres CLONE 1389548-F
  misc_feature: SWISSPROT Homolog: EC 2.6.1.5 Tyrosine transaminase
MATHASDNGSGHAEWRFARAAKEGALAVAGDKMSIPAARFKISASVDGRDPRPVLPLAHGDPSVFPAFGTAAEAENAVGAALRTGKFNCYPGGVGLPEARRALAEHLSSDPPYKLPTEDIFLTVGGLKALEVAAQPWPTEGHLLL

SEQ ID NO: 20771 - DNA, 706 bp, Zea mays
  misc_feature: Ceres CLONE 1389549-F
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (421)..(421): n is a, c, t, g, unknown, or other
aagctggagctccccgcggtggcggccgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtggcggcgccgtcgtcgtcccgacggcgcggatggggccggacggtcgcccttcccctgttcggnnnnagggagccgntgttggtgtaccagagcagcgccaaccctctgcccagcggcatcccggcctacaccgtgcagatcatcaacgtctgcggcggagggtgcaccgtgtacgacgtgcacgtctcctgcggcgacttcgcctccacggagctcgtcgacccggccaagtccagcgcgtcgccttcgacgactgcgtcgtcaggggcggcgccgccttggaacccagcgagaccgtctccttcagtactccactccttctcctaccagctcagggtcgcctccgccccgtgcactaaag

SEQ ID NO: 20772 - DNA, 722 bp, Zea mays
  misc_feature: Ceres CLONE 1389552-F
  misc_feature: Encodes the peptide sequence at SEQ ID NO. 20773
  misc_feature (599)..(599): n is a, c, t, g, unknown, or other
  misc_feature (607)..(607): n is a, c, t, g, unknown, or other
caccgcggtggcggccgctcttcaatagtggatcccccgggctgcaggaattcgcacgagaccattacctagaacatcctaatcgaaaaactgccgcgccgccaccctctacagataaggaagaggaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactccccgtggcctccgcacactcaactctgtttgggcccaacatcttagcgaagaagtgaggagaaggttctacaagaactggtgcaagagcaagaagaaggctttcacaaagtatgctctcaaatatgaaaatgatgctggcaagaaagaaattcagctgcagcttgagaagatgaangaatatgnctctgttatccgtgtcattgctcatacccagattaggaagatggagggttttgagcagaagaaggctcacctgatggagattcaggtccatggtgctaccattgctgaccaggtg

SEQ ID NO: 20773 - protein, 195 aa, Zea mays
  misc_feature: Ceres CLONE 1389552-F
  misc_feature (50)..(194): Pfam Name: Ribosomal_L3 Pfam Description: Ribosomal protein L3
  misc_feature (154)..(154): Xaa is any aa, unknown, or other
  misc_feature (157)..(157): Xaa is any aa, unknown, or other
MSHRKFEHPRHGSLGFLPRKRSSRHRGKVKSFPRDDPKKPCHLTAFLGYKAGMTHIVREVEKPGSKLHKKETCEAVTIIETPPLVIVGLVAYVKTPRGLRTLNSVWAQHLSEEVRRRFYKNWCKSKKKAFTKYALKYENDAGKKEIQLQLEKMXEYXSVIRVIAHTQIRKMEGFEQKKAHLMEIQVHGATIADQV

SEQ ID NO: 20774 - DNA, 711 bp, Zea mays
  misc_feature: Ceres CLONE 1389557-F
  misc_feature: Encodes the peptide sequence at SEQ ID NO. 20775
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
tccccgcggtggcggccgctctagaactagtggatcccccgggctgcaggaattcgcacgagaccattacctagaacatcctaatcgaaaactcagctgctggcccgctgcctgcagccattgcccgctcctcgaggtcaaatggcccctgcccccgctctcaccgccacatccgtcctgaagcgttcccacctacccggcgtccactcgttggcctgtcgccggcagccgggggcggaccgcgtctcggtgctttctccagcgatcccgccgccccgcgtttcatggcagcaaggatctggagtggttgctaagaggctcctctgggcgagtgcgagtggttccttcgagaaagataacatcggggaggacgcggtgttgccttctcagatagcggtggagaataaagtagattttttgaagattttaaagagtgccaactccattattccccatatagtgctggggagtacaattctcgccctggtgtacccgccttcgtttacatggttcactacagatatgaccttggtctggtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20775 - protein, 133 aa, Zea mays
  misc_feature: Ceres CLONE 1389557-F
MAPAPALTATSVLKRSHLPGVHSLACRRQPGADRVSVLSPAIPPPRVSWQQGSGVVAKRLLWASASGSFEKDNIGEDAVLPSQIAVENKVDFLKILKSANSIIPHIVLGSTILALVYPPSFTWFTTDMTLVWC

SEQ ID NO: 20776 - DNA, 636 bp, Zea mays
  misc_feature: Ceres CLONE 1389558-F
  misc_feature: Encodes the peptide sequence at SEQ ID NO. 20777
  misc_feature (540)..(540): n is a, c, t, g, unknown, or other
tcaccgcggtggcggccgctctaatcatagtggatcccccgggctgcaggaattcgcacgagaccattacctagaacatcctaatcgaaaactcgccgcaacgaattcccggtctccaaccagccggccagccaccgcagacgacccctagttccgcgtccccgacccgaaccctcgagttcgcacgggctccggccagattcgcgcggtctaagcttcgaatcggcgcatggaggcagcagtagccgcggcactcaagtcgcccaccgccgcacgtccctcgtggcggcccgcggccccgggcgccacctcgctcccctttgaccggaggcgcagctttgccttcggctccatcaagggtctcgggcggcagcagctcacctctaggactaggaggcgaagcagtgtggtcagggcctcctggtccccctcggagtctctgccaccgtcctcgtcgatggcgccgctcaggatggaatcgcccgcggggcagctactctcccagattcttcacacgcacccgcacctactgcctgccgncgccgagcagcagctcgagctgctccagacgaccgcgagggagagaaggataaggataaggagagcgatgctggcgacagctgcttccgacaggtg

SEQ ID NO: 20777 - protein, 59 aa, Zea mays
  misc_feature: Ceres CLONE 1389558-F
  misc_feature (28)..(28): Xaa is any aa, unknown, or other
MAPLRMESPAGQLLSQILHTHPHLLPAXAEQQLELLQTTARERRIRIRRAMLATAASDR

SEQ ID NO: 20778 - DNA, 710 bp, Zea mays
  misc_feature: Ceres CLONE 1389559-F
  misc_feature: Encodes the peptide sequence at SEQ ID NO. 20779
  misc_feature (678)..(678): n is a, c, t, g, unknown, or other
ataactggagctccccgcggtggcggccgctctataactagtggatcccccgggctgcaggaattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgttcgccatcctggccgccgtggtgggcgcggcgtccaagctggcgggcgtgcaccacgtgcgcgcctggcgccacgacagtctgtccaccaacgccgcgtcgtcgcttcatcgcctgggccatcacggcgctccgcttccggctggcctgcaaggaaatccacatcgncggacccgcggctggcccctgcccgtgcttgg

SEQ ID NO: 20779 - protein, 121 aa, Zea mays
  misc_feature: Ceres CLONE 1389559-F
  misc_feature (14)..(105): Pfam Name: AWPM-19 Pfam Description: AWPM-19-like family
MAGIGRNMVAPLLVLNLIMYIIVIGFASWNLNHFINGQTNYPGVAGNGATFYFLVFAILAAVVGAASKLAGVHHVRAWRHDSLSTNAASSLHRLGHHGAPLPAGLQGNPHRRTRGWPLPVL

SEQ ID NO: 20780 - DNA, 795 bp, Zea mays
  misc_feature: Ceres CLONE 1389560-F
  misc_feature (34)..(34): n is a, c, t, g, unknown, or other
  misc_feature (35)..(35): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (47)..(47): n is a, c, t, g, unknown, or other
tgtcccccccctccttttttttcccccccccccnncgnnnataaaantttccaaagctggagctccccgcggtggcggccgctctataatagtggatcccccgggctgcaggaattcgcacgagaccattacctagaacatcctaatcgaaaaacaaaagcgagagcaaagcaagcttcggcctcacctccagcggcaggtggtgctgcggagcttctcctcgccctagatcccgcgcacccaacgccagatcagagatcagggcgcgccggccgtctccattgcccggcggatcctgcgatgcgagctggaccgacagggaggagcgagggagcgcgcggatagagaaggcggcgcggccggaggaaggaaggaaggagcgccggccggagcagacgcccccctcggggcccctcggtcggatgagatcgacgatgaaggcgcaacaccgccaacggggggggggaagcaggagcccctttcctgacggcctaaggcgctcaacgctcggccttcatccacccttcgcctcccgggcctctaactttaagggactttctccttccaggggtggaaccggcccccttccttcaaccggccccccgaccgccaacggcctgcctccaaaaaaaaaagcccaggcgggggccggcccccgccgttgcccaagaaacggactcgcccgttccagaggtagcggactaggcgtcccgaggagaagtctgaggctttcccagactaaaggcggactccccttgtatacgattctacccgggtcgggaaccatatataacc

SEQ ID NO: 20781 - DNA, 710 bp, Zea mays
  misc_feature: Ceres CLONE 1389561-F
  misc_feature: Encodes the peptide sequence at SEQ ID NO. 20782
  misc_feature (516)..(516): n is a, c, t, g, unknown, or other
tccccgcggtggcggccgctcttcaactagtggatcccccgggctgcaggaattcgcacgagaccattacctagaacatcctaatcaaaaatcatctccagcggcttcttccaaagctccaactacgacgagaaccgccactcctcgaaatctccaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccaagctcgagtccatggagccctgctccagcgtcaaggataggattggctacagcatgatcacggacgcagaggagaaaaggctgatttactccaggcgtgagtggttctgattgaacaactagcggcaacacaggcattggactgccctttatgcctgctggcaggggctacaaacttacactcacaatgcctggctccatgagcatggangaggagatcctattggagggttttgggggttggactttggccctaactgaccccctccctggaaaaggaagggaggttgcaaaaaaaagggggaaaaaaaaaaaagggaagaaaccccccaatttggaaatatcccttcaaaatatttgaaaaaccccggttaaaccccagagtttcctctttgggggaactgg

SEQ ID NO: 20782 - protein, 73 aa, Zea mays
  misc_feature: Ceres CLONE 1389561-F
  misc_feature: SWISSPROT Homolog: EC 2.5.1.47 Cysteine synthase
MGEASPSIAKDVTELIGNTPLVYLNKVTDGCVGRVAAKLESMEPCSSVKDRIGYSMITDAEEKRLIYSRREWF

SEQ ID NO: 20783 - DNA, 786 bp, Zea mays
  misc_feature: Ceres CLONE 1389566-F
  misc_feature (10)..(10): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
tgcccttccntccctcnnnctcctccccccctccctcgccgcatttttaaaaagtggagctccaccgcggtggcggccgctctacactagtggatcccccgggctgcaggaattcgcacgagaccattacctagaacatcctaatcgaaaagcgaccgcgactcggatcggatctctctcctgtgtagagccatgctgtgctgtgctggtagtagcagcagcagtagcaatgagtagtccagtccacagctccaagaacacgtggccgtcctttccttgcctctccctatcggtatccggtaacgcagggggagggcgccaccggctttaaccatggcctgtcgcttttgcctcgtctggtcggatggtccctctgctctatcccatcccccttgagaaggctgttgagcaagctgaactcatacgaacctcgatttcttccggcccggcgttttttttttcctctcaggttccggagggatttctcccccctttcttttcttccctccctcccaaaaagattcttcactggctccggggatattggaacacacgcccggggatcccaaagcttgggcgggcttccatacaaatgggggagtgaaacaacctcacctctgttatcgagggcaaggagaaaagaaagcacaaaaaaatacattaccacctccaccccccccccctctcgcacccaccccccccccacccccctcccacgttcccccccaccccaaccgaatcaatctctaacacacgtacccgattaccccttttttccaccatccg

SEQ ID NO: 20784 - DNA, 682 bp, Zea mays
  misc_feature: Ceres CLONE 1389568-F
  misc_feature: Encodes the peptide sequence at SEQ ID NO. 20785
  misc_feature (347)..(347): n is a, c, t, g, unknown, or other
  misc_feature (363)..(363): n is a, c, t, g, unknown, or other
  misc_feature (386)..(386): n is a, c, t, g, unknown, or other
ggagctccccgcggtggcggccgctctagaactagtggatcccccgggctgcaggaattcgcacgagaccattacctagaacatcctaatcgaaaaatcacgaagagtcatcacgccatacgacacggaggacaccgagccggaggcgaagccggtgcgcagcgcgagagtagcggcgagtcggcgaccatcaagcaactgcatggccgcgttacccgccagcacccccgcccccgcccccgccccctccgaggcggcggagctcgtgccgacgctctcctcgctggagccggtctacggcgcgggcgcgcagctcgacgaggcgcgcctccgcttcgcccgcctcngggaccgcttccacgncgtctacggggcccgccccgggntcttcggccgctccccagggagggtcaatctgatcggggaggacatcgactacaagggctactccggggttgccgatggcccacccgccaggaattgatccgccccccttcgaagggccaacgggcgcccaggggggggtcccccaaaggcgaagaaaaaataccccctttggggttaacccccgcgccccaaaaaagggaattggggcgtaaaaaatcccccgagggggcgcccaatttcctgggggggaaaccagctggggtttttccaccccccgcccccccagggggcttgt

SEQ ID NO: 20785 - protein, 93 aa, Zea mays
  misc_feature: Ceres CLONE 1389568-F
  misc_feature (22)..(83): SWISSPROT Homolog: EC 2.7.1.6 Galactokinase
  misc_feature (56)..(83): SWISSPROT Homolog: EC 2.7.1.157 N-acetylgalactosamine kinase
  misc_feature (49)..(49): Xaa is any aa, unknown, or other
  misc_feature (54)..(54): Xaa is any aa, unknown, or other
  misc_feature (62)..(62): Xaa is any aa, unknown, or other
MAALPASTPAPAPAPSEAAELVPTLSSLEPVYGAGAQLDEARLRFARLXDRFHXVYGARPGXFGRSPGRVNLIGEDIDYKGYSGVADGPPARN

SEQ ID NO: 20786 - DNA, 655 bp, Zea mays
  misc_feature: Ceres CLONE 1389571-F
  misc_feature: Encodes the peptide sequence at SEQ ID NO. 20787
  misc_feature (397)..(397): n is a, c, t, g, unknown, or other
  misc_feature (428)..(428): n is a, c, t, g, unknown, or other
  misc_feature (445)..(445): n is a, c, t, g, unknown, or other
  misc_feature (489)..(489): n is a, c, t, g, unknown, or other
  misc_feature (495)..(495): n is a, c, t, g, unknown, or other
  misc_feature (525)..(525): n is a, c, t, g, unknown, or other
  misc_feature (578)..(578): n is a, c, t, g, unknown, or other
  misc_feature (587)..(587): n is a, c, t, g, unknown, or other
tccccgcggtggcggccgctctataactagtggatcccccgggctgcaggaattcgcacgagaccattacctagaacatcctaatcaaaaagagagagaaggttctccaagtcaatcgcaatcacgaagagtcatcacgccatacgacacggaggacaccgagccggaggcgaagccggtgcgcagcgcgagagtagcggcgagtcggcgaccatcaagcaactgcatggccgcgttacccgccagcgcccccgcccccgcccccgccccctccgaggcggcggagctcgtgccgacgctctcctcgctggagccggtctacggcgcgggcgcgcagctcgacgacgcgcgcatccgctttgcccgcctcggggaccgcttccacgccgtctacggngcccgccccgcgctcttcgcccgctccccanggagggtcaatctgatncgggagcacatcgactacgagggctactcggtggtgccgatggncatccngcaggacatgatcgtcgccatccgaagggnccacgcgaccagggtgagggtcgcccacgtcgacgacagtaccccctctgcgnttaccccgncgaccccagacaggaaattgacgtaaaaatcacaaatggggcactatttcatgtgtgattacaaggga

SEQ ID NO: 20787 - protein, 128 aa, Zea mays
  misc_feature: Ceres CLONE 1389571-F
  misc_feature: SWISSPROT Homolog: EC 2.7.1.6 Galactokinase
  misc_feature (68)..(68): Xaa is any aa, unknown, or other
  misc_feature (73)..(73): Xaa is any aa, unknown, or other
  misc_feature (88)..(88): Xaa is any aa, unknown, or other
  misc_feature (90)..(90): Xaa is any aa, unknown, or other
  misc_feature (100)..(100): Xaa is any aa, unknown, or other
  misc_feature (118)..(118): Xaa is any aa, unknown, or other
  misc_feature (121)..(121): Xaa is any aa, unknown, or other
MAALPASAPAPAPAPSEAAELVPTLSSLEPVYGAGAQLDDARIRFARLGDRFHAVYGARPALFARSPXRVNLXREHIDYEGYSVVPMXIXQDMIVAIRRXHATRVRVAHVDDSTPSAXTPXTPDRKLT

SEQ ID NO: 20788 - DNA, 665 bp, Zea mays
  misc_feature: Ceres CLONE 1389573-F
  misc_feature: Encodes the peptide sequence at SEQ ID NO. 20789
  misc_feature (332)..(332): n is a, c, t, g, unknown, or other
  misc_feature (531)..(531): n is a, c, t, g, unknown, or other
tccccgcggtggcggccgctctagaactagtggatcccccgggctgcaggaattcgcacgagaccattacctagaacatcctaatcgaaaaactggattcttctctcttctctttctctgagtcgcagcttcggcagctggcggtctggtctacggtctaccactaccactctaccagagaggggatcgatcacacaaacacacccatggcgggctgcgcggcggcgcgcatgttcgcgtacaacgccagcctctgcgcctgcgatccggggtactactactacctcagcagcaacggcaccgcgagctgcatcccgatgccgggcggcggntggggcgactggcaggtggcctccgtgggcgcgccgaggaaccagagcctctacttcctggagccggtgctctcggtctacgccatccgccgcctcacccagtccccaggccgtgctcctcgaggcgaccctcgcgtcgctcctctgctgaatcgccttctgcgccgcagccaggttccgggggcggaacccccgcggngaagagaggctgttccggggccgggtactgggtcaagccgcttcgactgccttttcgacaaagccactgggggggggggttcaggcaggtactaggggaaaagggaaaccccaatttgggtgggcacaattctc

SEQ ID NO: 20789 - protein, 139 aa, Zea mays
  misc_feature: Ceres CLONE 1389573-F
  misc_feature (109)..(109): Xaa is any aa, unknown, or other
MAGCAAARMFAYNASLCACDPGYYYYLSSNGTASCIPMPGGGWGDWQVASVGAPRNQSLYFLEPVLSVYAIRRLTQSPGRAPRGDPRVAPLLNRLLRRSQVPGAEPPRXREAVPGPGTGSSRFDCLFDKATGGGGSGRY

SEQ ID NO: 20790 - DNA, 676 bp, Zea mays
  misc_feature: Ceres CLONE 1389574-F
  misc_feature: Encodes the peptide sequence at SEQ ID NO. 20791
  misc_feature (563)..(563): n is a, c, t, g, unknown, or other
tccccgcggtggcggccgctctacaactagtggatcccccgggctgcaggaattcgcacgagaccattacctagaacatcctaatcgaaaaggacgcaccggccatggcatctgcacgggctgctgctgcctgctgatagagtggacaatgcatgagctgctgcagatagaatagaacgctgccggcagggtctgctgctgatagatgcatgtatagatagagacgctgctgctagctgccggccggtgcagactgcagaccacgggaggcgcgggcgcgcgctataaaagccgagccagtgggcgcggccagtgtcacaactcacatcgaggtctcagcttcaggaaagggaaggaagcatgttcgggcaccaccacggccacggcgggcaccaccaggccccgccgccgcacgagcagacgctgttcaggatcttctgccgcgccgacgaggcgtactgcctcaccgtgcgtcacggacgccgtcgtcctcgcgcccaccaacccccgcgacgagtaccagcactgttacaaggacatgaggcacagcacggaaggtgaanggacgcggagggcccagccagcgttcgcgctcatcaacagggccaccggcctcgccatcaagcactcgctcggcagtcccatccccggggaagctggggccctaaaacgggga

SEQ ID NO: 20791 - protein, 66 aa, Zea mays
  misc_feature: Ceres CLONE 1389574-F
MFGHHHGHGGHHQAPPPHEQTLFRIFCRADEAYCLTVRHGRRRPRAHQPPRRVPALLQGHEAQHGR

SEQ ID NO: 20792 - DNA, 715 bp, Zea mays
  misc_feature: Ceres CLONE 1389575-F
  misc_feature: Translation starting site: 426
  misc_feature: SWISSPROT Homolog: EC 1.14.17.4 Aminocyclopropanecarboxylate oxidase
  misc_feature (597)..(597): n is a, c, t, g, unknown, or other
cgctctataactagtggatcccccgggctgcaggaattcgcacgagaccattacccagaacatcctaatcgaaaaatgcagcagcgaacaacacaaattaagtagtggagtgtcagaacttgggaggcacaaattaagtacaaagcagtctaattaatgacgggcccgatggagattccggtgatcgatctcggcggcctcaacggcggcggcgaggagaggtcgcggaccttggcggagctccacgacgcctgcaaggactggggcttcttctgggtaagcagagcaccaacgaatgcttgcaattaatatttgacaacttctttccatatgcatgcgcgcgggcgtacgtacgtcattatgatgcgccggcgccgctcgcatccgcatcgcaggtggagaaccacggcgtggacgcgccgctgatggacgaggtcaagcgcttcgtctacggccactacgaggagcacctggaggccaagttctacgcctccgccctcgccatggacctcgaggccgccaccagaggtgacactgatgagaagccctccgacgaggtggactgggagtccacctacttcatccagcaccaccccnaagaccacgtcgccgacttcccagagatcacgccgccgacacgagagacgctggacgcgtacgtcgcccagatggtgtccctcgcggagcgtctggcggagtgcatgagcctcacctg

SEQ ID NO: 20793 - DNA, 676 bp, Zea mays
  misc_feature: Ceres CLONE 1389576-F
  misc_feature: Encodes the peptide sequence at SEQ ID NO. 20794
  misc_feature (467)..(467): n is a, c, t, g, unknown, or other
  misc_feature (468)..(468): n is a, c, t, g, unknown, or other
  misc_feature (539)..(539): n is a, c, t, g, unknown, or other
  misc_feature (541)..(541): n is a, c, t, g, unknown, or other
  misc_feature (542)..(542): n is a, c, t, g, unknown, or other
  misc_feature (548)..(548): n is a, c, t, g, unknown, or other
  misc_feature (549)..(549): n is a, c, t, g, unknown, or other
tggcggccgctctagttctagtggatcccccgggctgcaggaattcgcacgagaccattacctagaacatcctaatcgaaaacgaacacaccagaccagctcatcatcacattcgcatacatctcttctagcacgcaaagatcgagctatagctagctctgcaaccagagacaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgagaaggcaagcaagcgtgacgccgagacggcgcccccggcagccaaggcgcccgtggtgggttggccgccgnntgagtcgtaccggaagagctgcttcccagcagccagcagcaagcagggcgcggcggccaaacagggagcgncnngcgcgnncgcgccgcctggtgcacgtcatcgtcagcagccgccacaacacagcagctgcagcagcgccgccgttgtcgtcggctccttcgtcaaagggagcatggacggcgccccgtacctgaggaggtggacc

SEQ ID NO: 20794 - protein, 149 aa, Zea mays
  misc_feature: Ceres CLONE 1389576-F
  misc_feature (7)..(148): Pfam Name: AUX_IAA Pfam Description: AUX/IAA family
  misc_feature (80)..(80): Xaa is any aa, unknown, or other
  misc_feature (104)..(104): Xaa is any aa, unknown, or other
  misc_feature (105)..(105): Xaa is any aa, unknown, or other
  misc_feature (107)..(107): Xaa is any aa, unknown, or other
METVVGDLMATELRLGLPGTVDDCSQPQLVKATPPSTPRGKRRATADAVEEAAGAEKASKRDAETAPPAAKAPVVGWPPXESYRKSCFPAASSKQGAAAKQGAXXAXAPPGARHRQQPPQHSSCSSAAVVVGSFVKGSMDGAPYLRRWT

SEQ ID NO: 20795 - DNA, 651 bp, Zea mays
  misc_feature: Ceres CLONE 1389577-R
  misc_feature: SWISSPROT Homolog: EC 1.8.1.4 Dihydrolipoyl dehydrogenase
  misc_feature (606)..(606): n is a, c, t, g, unknown, or other
caattgggtaccgggccccccctcgaggtcgacggtatcgataagcttttttttttttttttttagggcaaccaacaacaaatatgcaaataacgaagccaacaaaaacccaccccaccgtaaaaaaaagacccttttaacaatctggacccaaaaaagaaacatttgtgtgcttgtattcactgatgaatttcttcctcaaatttgtaacctacagcaactgcctacaacaacaccctccccgttaccgttgtcaatctcgttttggggaagaaaacagggtcgtgacgaagctgaggaccttcaggagtggttggggtggctgccttggcttgctatccggcctttctctaggctgcaactggttcatttacagaatgagaaacaccggaattaaccttggctgctttgaagagttcatccaggacctcagacaatgtaaggtgtgcgtgaacagcaaacttgatgtcttgcacacgagttcctagggcgatggcatttgatgccctcggaatgagatcagcagcatgcaaaacccaaaatgtgaacccccagaattttccccccgtgtcaagggccggtaaattcaactctacgcaattcccnttcttcccttcaattttccggcccaaaagcctttacagcggtaac

SEQ ID NO: 20796 - DNA, 671 bp, Zea mays
  misc_feature: Ceres CLONE 1389578-F
  misc_feature: Encodes the peptide sequence at SEQ ID NO. 20797
  misc_feature (572)..(572): n is a, c, t, g, unknown, or other
  misc_feature (593)..(593): n is a, c, t, g, unknown, or other
  misc_feature (594)..(594): n is a, c, t, g, unknown, or other
tccccgcggtggcggccgctctagaactagtggatcccccgggctgcaggaattcgcacgagaccattacctagaacatcctaatcgaaaagtcctcttggctttctctttcccgctctcctcctcgcttgccccccgccagctcgatctccagggagtggactagtgcagggagggagggaagaaaggagtggtgcagctgtgagtgaagccgcctctcgtttccttgattgattggagccgagccggaatgtgatgcgagagaggtgtgcagattagcaccgttcgcaggacacaactgagcaatcctctgaaggccaaacaccccctttcagttagccatctctgaaggaacatacaggctttttcataagatagtcatggcagagttcaagatcggtaggctggatggccaaccaccaagggtcagaaatgtgcccattgccgtcaccccggaaggattctggtgctgcccatcacaggccgcgcttcagaagacagcgaagagcccaaaccagcagggcaggcctagagggggagcatcccctgcgccttcgagggcgtcctccggnttcagaggggtccaaccgttnncttcagagaagagagcacagtccacctcctactaggtccagaaaaccattcagaatgaggcagtgtgccctccagca

SEQ ID NO: 20797 - protein, 82 aa, Zea mays
  misc_feature: Ceres CLONE 1389578-F
  misc_feature (71)..(71): Xaa is any aa, unknown, or other
  misc_feature (72)..(72): Xaa is any aa, unknown, or other
MAEFKIGRLDGQPPRVRNVPIAVTPEGFWCCPSQAALQKTAKSPNQQGRPRGGASPAPSRASSGFRGVQPXXSEKRAQSTSY

SEQ ID NO: 20798 - DNA, 686 bp, Zea mays
  misc_feature: Ceres CLONE 1389582-F
  misc_feature: Encodes the peptide sequence at SEQ ID NO. 20799
  misc_feature (428)..(428): n is a, c, t, g, unknown, or other
  misc_feature (471)..(471): n is a, c, t, g, unknown, or other
  misc_feature (538)..(538): n is a, c, t, g, unknown, or other
  misc_feature (542)..(542): n is a, c, t, g, unknown, or other
aagctggagctccccgcggtggcggccgctctagaactagtggatcccccgggctgcaggaattcgcacgagaccattacctagaacatcctaatcgaaaatcaagccaacagcttccgaaaagtttccgaaagctccttcagatctgttggttaatggatacactcatcctgtacctatgtctactgctggctggccaaccaatgctagtttagtgcctgttcagagcactggatcaatgactgcaactggttggccacccaatggtgggtcaaatgcttttccaagtactgcatctctatcagctgctggtaattacaacattaaccagtcgcttcccaggtcttccgttggttgggctgtcaatggtgagcaaagtgttattcctagcattgctcccagatttgaactcgtgcagcctgttgaangagctgttttcagctggacaagcagtggtgcacagcatgttgntactcagcaaaggacacaggtttacttttcccagatggtatgttctgaccacttgtatctgcatcantggntccaacgtttcaggagcactgattattcgaaatttctcaggggacaagaaatgctcttaatggatggactgaatactggtcacttaactggaaatggctatttaaagcagagactgcagcccaagaattgagtggtttacagtc

SEQ ID NO: 20799 - protein, 164 aa, Zea mays
  misc_feature: Ceres CLONE 1389582-F
  misc_feature (84)..(84): Xaa is any aa, unknown, or other
  misc_feature (98)..(98): Xaa is any aa, unknown, or other
  misc_feature (120)..(120): Xaa is any aa, unknown, or other
  misc_feature (122)..(122): Xaa is any aa, unknown, or other
MSTAGWPTNASLVPVQSTGSMTATGWPPNGGSNAFPSTASLSAAGNYNINQSLPRSSVGWAVNGEQSVIPSIAPRFELVQPVEXAVFSWTSSGAQHVXTQQRTQVYFSQMVCSDHLYLHXWXQRFRSTDYSKFLRGQEMLLMDGLNTGHLTGNGYLKQRLQPKN

SEQ ID NO: 20800 - DNA, 809 bp, Zea mays
  misc_feature: Ceres CLONE 1389589-F
  misc_feature (32)..(32): n is a, c, t, g, unknown, or other
  misc_feature (33)..(33): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (328)..(328): n is a, c, t, g, unknown, or other
tttttccccccccccccccccccccctccctnnccccatgttagcccnnnnnnnaaaagctggagctccccgcggtggcggccgctctagaactagtggatcccccgggctgcaggaattcgcacgagaccattacctagaacatcctaatcgaaaaacttcccagacccgctactccctcgccgcgatttcctcacatggcagcgctgcgcctccgcgaatcactcgagaggaacggcccccgcttctatttatccggcccttgtccctgcgccgacccgcgttgccccggtcccgatctcgccgcccccttctcctccctccgcgntcatcgcacccgttcctgatcccgcttgcttgctctgggtctgctttccgccgtttggtctcggcgggtcctgggagctcctggagccccgggttctgtctcctaagctgtcttgcccatgggggaaaagcaaaaaagagcaaggcccggcgggggggggggggaacgacctggttcgaacgggtagggaaccccgaacagggttcagttccctcgtcccaccgcgaattggtcggaattctcctccttttttcgaaggcttaccgagacacgtcaaacttcgcggagggggtccggcccggggaacaagtacaccggaccgccgcccaacagaaaaagaaagggggccctaaccagggacgcggccgcaacgggctaaaactccgggctgcacgcccttcagacaagcttcttatcggccccacgggcccctgaggggggaacaaaaatcttcccccccctccgtaggagacaaaaatcg

SEQ ID NO: 20801 - DNA, 792 bp, Zea mays
  misc_feature: Ceres CLONE 1389590-F
  misc_feature: Encodes the peptide sequence at SEQ ID NO. 20802
  misc_feature (269)..(269): n is a, c, t, g, unknown, or other
  misc_feature (313)..(313): n is a, c, t, g, unknown, or other
  misc_feature (337)..(337): n is a, c, t, g, unknown, or other
  misc_feature (749)..(749): n is a, c, t, g, unknown, or other
  misc_feature (750)..(750): n is a, c, t, g, unknown, or other
aagctggagctccccgcggtggcggccgctctataactagtggatcccccgggctgcaggaattcgcacgagaccattacctagaacatcctaatcgaaaaagattcggagcttcggggggaaaaggcaggcacagtatcgtcgaccatgctgccaggtcgccacccggcgcgccgggccgacgccaccgggacggggccgctcctgccggacgccactcgcgcggtggtggcggagttcgtcgccacagccatgggtcgtgtcgccgncgaaggctccgtctacggcctctggaagctgtacaaggacacgnaaacgccgggcggcctgctcgcgntgggcatcgcggaaaccctgcgctgttggccgcgttggcggtaacaaaaacccgtccgggggaacgtaaaccctggggaaaccttcggcctgtttgggggccccccattcccttttggggggccgggataaattggtctccaaaaattcccgccgcggggcccccttttttttttaaaaccctcccctccggaacacccccccgggttttttgtcttcccccgggggccaaaaaagaggaccccctcttttaaaaggacataaaaatttttttttttttgacgcgggccccccccccgggggtaacaacgagggggggggggggggagagaacccccccccctccctttttttttgtgggggagaaaacacccaccccgcgcctttaaaaagagaaaaaaaaaagagggggnnggggcccccccccccctctttggggagaggcgccccaccccg

SEQ ID NO: 20802 - protein, 77 aa, Zea mays
  misc_feature: Ceres CLONE 1389590-F
  misc_feature (41)..(41): Xaa is any aa, unknown, or other
  misc_feature (56)..(56): Xaa is any aa, unknown, or other
  misc_feature (64)..(64): Xaa is any aa, unknown, or other
MLPGRHPARRADATGTGPLLPDATRAVVAEFVATAMGRVAXEGSVYGLWKLYKDTXTPGGLLAXGIAETLRCWPRWR

SEQ ID NO: 20803 - DNA, 716 bp, Zea mays
  misc_feature: Ceres CLONE 1389591-F
  misc_feature: Encodes the peptide sequence at SEQ ID NO. 20804
  misc_feature (467)..(467): n is a, c, t, g, unknown, or other
  misc_feature (468)..(468): n is a, c, t, g, unknown, or other
  misc_feature (537)..(537): n is a, c, t, g, unknown, or other
  misc_feature (669)..(669): n is a, c, t, g, unknown, or other
  misc_feature (716)..(716): n is a, c, t, g, unknown, or other
gctctagaactagtggatcccccgggctgcaggaattcgcacgagacctttacctagaacatcctaatcgaaaaatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgcggccgggacggtgggcttcttctggctggtgaaccacggcgtggcagaggagctgatgggcggcatgctccgcgnngtgcgccagttcaacgagggccccgtgggagcgaaagcagcgctctactccagggacctggctcgcaanctgcgcttcgcctccaacttcgaccctctcaggccgctgcggccgactggcgcgacacgtctttctggcgagtggctccgaacccgccgccgcggaaggagctgccggagccactgaggaacgtgatgctgnagtcacgcgcggcggtgacgaaactggggccgggtcgtgttcaagtn

SEQ ID NO: 20804 - protein, 178 aa, Zea mays
  misc_feature: Ceres CLONE 1389591-F
  misc_feature: SWISSPROT Homolog: EC 1.14.11.20 Desacetoxyvindoline 4-hydroxylase
  misc_feature (117)..(117): Xaa is any aa, unknown, or other
  misc_feature (140)..(140): Xaa is any aa, unknown, or other
MAPTTATKDDSGYGDERRRELQAFDDTKLGVKGLVDSGVKSIPSIFHHPPEALSDIISPAPLPSSPPSGAAIPVVDLSVTRREDLVEQVRHAAGTVGFFWLVNHGVAEELMGGMLRXVRQFNEGPVGAKAALYSRDLARXLRFASNFDPLRPLRPTGATRLSGEWLRTRRRGRSCRSH

SEQ ID NO: 20805 - DNA, 857 bp, Zea mays
  misc_feature: Ceres CLONE 1389592-F
  misc_feature (1)..(1): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (28)..(28): n is a, c, t, g, unknown, or other
  misc_feature (30)..(30): n is a, c, t, g, unknown, or other
  misc_feature (38)..(38): n is a, c, t, g, unknown, or other
  misc_feature (39)..(39): n is a, c, t, g, unknown, or other
nggggccccccccccccccnnnnggggntngggggaannaagggcctccgtcaaagctggagctccccgcggtggcggccgctctagaatagtggatcccccgggctgcaggaattcgcacgagaccattacctagaacatcctaatcgaaaaaaatcccaccacccttttcccccttccaaccctcgggatctctccggcccgccatggaagtgttctactacctcgtgttcggcgcgctcgccggcattgtgggcggcgctggagctccccaaggccgggaaaggaacggggtccccccctccccgggcttcaactcatttaagaaaaactaccttcctcgttaactcccctcatggtggcctgggggactgggctggagggggccctacgtggaactaccttctaagggccaggacggttttcaaaaaagggcccaaattttggccggcctctttaatcggcccggccttccgggtcccctccaatggctccttcggggaaaccaatgtcgcggaattcctctccgcggaaaaaaagaaagggggcggagaaagaaaagaggactggagggctccagctaaacttggaaattaacccttaaatgtcgcccgggtggggctttaccacagaggggacccctcccccaagaaacaagggggtccctatacggacggggggcggccgcgcccctggggcgggctatatgccaccttcttcttggattctcgttcaccagggctgtgaggcgtaggcgggcgcggggggcaggaaccaacaatgggggaggggggttggtgcccgcacgggggggggggagagagaaaatcggcgcgcaggggaattaatcccggggg

SEQ ID NO: 20806 - DNA, 695 bp, Zea mays
  misc_feature: Ceres CLONE 1389600-F
  misc_feature: Encodes the peptide sequence at SEQ ID NO. 20807
  misc_feature (264)..(264): n is a, c, t, g, unknown, or other
  misc_feature (280)..(280): n is a, c, t, g, unknown, or other
aaagctggagctccccgcggtggcggccgctctagaactagtggatcccccgggctgcaggaattcgcacgagaccattacctagaacatcctaatcaaaaaacgagcgctccagctccactcctcgcacccgaatcagccgctcagatccccaggcccgcctctccctccggcggcagttcctcgccggggtcctgcccgcccctcccttcatcccctcctcacctcagaacttatggatggacaggtggagaactttgtggnagatgaggaaggcggntcgcctcaagttccttacgatggggagcagcaaatgctgtatgatagtgtcgcgaagcagtacagtgaagagctaggtgaccagtacaacgagcagcctcgtgccaatatgatggaagggtctgggaatccgtataatgattatgaagagcaagcaaacctgtacagcgaggaaactgggaatcagtacaacgaggacccagcagattcttaccaggaagagcatgagaatgcattcagggggggcataaaccaacggggcaactttgcgggtcaaccaatgttgacgattacatatgggcctggaagccccgggcaaaaaagggttttgcggaaactcggtccgaggctaaaaaaaggttggaagctatcgtttggcccacaaagaggggaagctccattaaggaaaaatgggc

SEQ ID NO: 20807 - protein, 153 aa, Zea mays
  misc_feature: Ceres CLONE 1389600-F
  misc_feature (10)..(10): Xaa is any aa, unknown, or other
MDGQVENFVXDEEGGSPQVPYDGEQQMLYDSVAKQYSEELGDQYNEQPRANMMEGSGNPYNDYEEQANLYSEETGNQYNEDPADSYQEEHENAFRGGINQRGNFAGQPMLTITYGPGSPGQKRVLRKLGPRLKKGWKLSFGPQRGEAPLRKNG

SEQ ID NO: 20808 - DNA, 725 bp, Zea mays
  misc_feature: Ceres CLONE 1389602-F
  misc_feature: Encodes the peptide sequence at SEQ ID NO. 20809
  misc_feature (457)..(457): n is a, c, t, g, unknown, or other
  misc_feature (458)..(458): n is a, c, t, g, unknown, or other
  misc_feature (524)..(524): n is a, c, t, g, unknown, or other
  misc_feature (526)..(526): n is a, c, t, g, unknown, or other
  misc_feature (544)..(544): n is a, c, t, g, unknown, or other
  misc_feature (546)..(546): n is a, c, t, g, unknown, or other
  misc_feature (556)..(556): n is a, c, t, g, unknown, or other
  misc_feature (601)..(601): n is a, c, t, g, unknown, or other
  misc_feature (646)..(646): n is a, c, t, g, unknown, or other
  misc_feature (654)..(654): n is a, c, t, g, unknown, or other
  misc_feature (672)..(672): n is a, c, t, g, unknown, or other
aagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcatcagcggtgtcttcggtatgtgaaaacccaatccttcaaccctacaggatccaacaggcaatcgcagctggcatcttacctttatcacccttgttcctccaacaatcatcagccctattacaacagttacctttggtgcatttattggcacaaaacatcagggcacaacaactacnnacacttgtgctagcaaacctttgctgctactctcagcaacagcagtttcttccattcaccaactangntcattgaactctgcttcntnaattgcacancaacaactaccattcagccagctacctgctgcctacccccagaanttctttccatccaacaactgggagcattgaactctcctgctattnaacacagnaacactactaccattcanccgttagctggggggaccctggtacctctttgaccaaccaagttgttgcggtt

SEQ ID NO: 20809 - protein, 124 aa, Zea mays
  misc_feature: Ceres CLONE 1389602-F
  misc_feature (100)..(100): Xaa is any aa, unknown, or other
  misc_feature (122)..(122): Xaa is any aa, unknown, or other
  misc_feature (123)..(123): Xaa is any aa, unknown, or other
MAAKIFCLLMLLGLSASAATATIFPQCSQAPIASLLPPYLSSAVSSVCENPILQPYRIQQAIAAGILPLSPLFLQQSSALLQQLPLVHLLAQNIRAQQLXTLVLANLCCYSQQQQFLPFTNXXH

SEQ ID NO: 20810 - DNA, 683 bp, Zea mays
  misc_feature: Ceres CLONE 1389604-F
  misc_feature: Encodes the peptide sequence at SEQ ID NO. 20811
  misc_feature (460)..(460): n is a, c, t, g, unknown, or other
  misc_feature (507)..(507): n is a, c, t, g, unknown, or other
  misc_feature (511)..(511): n is a, c, t, g, unknown, or other
  misc_feature (527)..(527): n is a, c, t, g, unknown, or other
  misc_feature (679)..(679): n is a, c, t, g, unknown, or other
aagctggagctccccgcggtggcggccgctctagaactagtggatcccccgggctgcaggaattcgcacgagaccattacctagaacatcctaatcgaaaacccatttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctggtggcccnagtgagttgcaaacaatgaacgtgcagcagcccgctgatggtgccgnaccnagcgagggggtggcgncgatctcaaagggggggaagtagggccgaacggtgcagcgcctgcaggagagggttggacttacgggattccactgccggtgtgggaacttgtactgcgcactccaccgctactccgaaagcacgactgggagttcgactaccggactggtngcag

SEQ ID NO: 20811 - protein, 109 aa, Zea mays
  misc_feature: Ceres CLONE 1389604-F
  misc_feature (14)..(38): Pfam Name: zf-A20 Pfam Description: A20-like zinc finger
  misc_feature (96)..(96): Xaa is any aa, unknown, or other
  misc_feature (103)..(103): Xaa is any aa, unknown, or other
MEHKEAGCQAPEGPILCINNCGFFGSAATMNMCSKCHKEMITKQDQAKLAASSIDSIVNGSDAVMEPVVAGSNTVVAGGPSELQTMNVQQPADGAXPSEGVAXISKGGK

SEQ ID NO: 20812 - DNA, 695 bp, Zea mays
  misc_feature: Ceres CLONE 1389607-F
  misc_feature: Encodes the peptide sequence at SEQ ID NO. 20813
  misc_feature (525)..(525): n is a, c, t, g, unknown, or other
  misc_feature (661)..(661): n is a, c, t, g, unknown, or other
gctctagaactagtggatcccccgggctgcaggaattcgcacgagaccattacctagaacatcctaatcgaaaacccacctaccgttgccgccgccacctcgccctcgcgccccctctccctcggctacgggcatcggccgccgtcatgtcaacggcggcggaacagacgatcgctgaccagaagcgcacgctgcgcgccgaggtgcgcagggcgctgaaggccctctctgccgaccagcgcgccagcgaagatctggctattcaaactacaatactggattcctcttggttcaaagcaagcaaacggttgtgcgcttatataagctgtcagcagttgcgagaagtcgatacatcaaaaatactagcagagtgtctaccgtcaaatcctggtgagtccatctgtagctgtgctcgttacagattcttccgctaacaattaggttttccttaaggacaagaggaactagcaaaggatctttatgttcctcgagtggaggataagaaccgtaatatgaggatgctcnaaatcaccaccatggatgatttagttaagaattcaatgaacattctggaaccatcgcttgtggatgctaccgggaaacatcgtgaagatgtattgtcatcatcgtcccctggtgatctttttttattgcctggacnagcttttgatagaactggtcgaagactggggcgg

SEQ ID NO: 20813 - protein, 143 aa, Zea mays
  misc_feature: Ceres CLONE 1389607-F
  misc_feature: SWISSPROT Homolog: EC 6.3.3.2 5-formyltetrahydrofolate cyclo-ligase
SRTSGSPGLQEFARDHYLEHPNRKPTYRCRRHLALAPPLPRLRASAAVMSTAAEQTIADQKRTLRAEVRRALKALSADQRASEDLAIQTTILDSSWFKASKRLCAYISCQQLREVDTSKILAECLPSNPGESICSCARYRFFR

SEQ ID NO: 20814 - DNA, 725 bp, Zea mays
  misc_feature: Ceres CLONE 1389607-R
  misc_feature: Pfam Name: 5-FTHF_cyc-lig Pfam Description: 5-formyltetrahydrofolate cyclo-ligase family
  misc_feature (419)..(419): n is a, c, t, g, unknown, or other
cgattgggtaccgggccccccctcgaggtcgacggtatcgataagcttttttttttttttttttaccatgtcaagtctactgactgttttggtcagctcgacggtttacattataaatctataaatctgaagtggctggaataagacgtagacgtccagttcaccctgttaaaacgtaaaagatgatacaagacaggagccacgagggggaaaaaagagacagtttccctgatctgctggtgtatttgctagtgcaaccagggaccagaagaaggtgcttcttgtcaaagcatggctacagagggccaatcaacttcattgcatcctctgcaacgccgcagcacttattgtaataacaccagaggatgagaccagagcatcaataggaacatcagttgaattgactgggatgatgcccncccccataatttgcaccgagtacgaaagagcaactaagagaggctggttccaccctttctcttttgcaagttcttggtacttcagcaagaatgtatcatagtacccctccgccacgccccagtctttcgaccagttctatcaaaagcttgtccaggctataaaaaagatcaacgggggacgatgatgactatacctcttcacgaattgtcccgggtagcttccacaagcaaatggttcccagaattgttctttggattctttaaactaatcctcccagggggggggatttttgagcctccctcata

SEQ ID NO: 20815 - DNA, 683 bp, Zea mays
  misc_feature: Ceres CLONE 1389611-F
  misc_feature: Encodes the peptide sequence at SEQ ID NO. 20816
  misc_feature (286)..(286): n is a, c, t, g, unknown, or other
aaagctggagctccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgctgctacggaggtgcccctcgccccgggcttccgcttccaccccaccgacgaggagctcgtctcctactacctccgccgccgcgtcctcnggcgccgcctccgcgtcgacgccatcgccgagatcgacctctaccgcctcgagccctgggacctcccctccctctcccgcatccgcagccgcgacgcccagtggtacttctttcgcccgtctcgaccgcaaggtcgccggggctggcgcccgggggccggggccgttcccggcaaaaggaacaaccgcgctaaccgcgaggggggtattggcagactctgggcaaaggaccggggtgggggacccccgggcggagccccggtcggaaagaaaaaaaactgttgccctttcaaagccggggagggggcccagcaggccgtacgtgtctaatttgggctttatgtccggtatatccctttccgtgggtgctggaggggtcccccaggatacgtgggtgg

SEQ ID NO: 20816 - protein, 156 aa, Zea mays
  misc_feature: Ceres CLONE 1389611-F
  misc_feature (24)..(157): Pfam Name: NAM Pfam Description: No apical meristem (NAM) protein
  misc_feature (48)..(48): Xaa is any aa, unknown, or other
MSLSPLDSSSPPAAAAAAATEVPLAPGFRFHPTDEELVSYYLRRRVLXRRLRVDAIAEIDLYRLEPWDLPSLSRIRSRDAQWYFFRPSRPQGRRGWRPGAGAVPGKRNNRANREGGIGRLWAKDRGGGPPGGAPVGKKKNCCPFKAGEGAQQAVRV

SEQ ID NO: 20817 - DNA, 783 bp, Zea mays
  misc_feature: Ceres CLONE 1389619-F
  misc_feature (192)..(192): n is a, c, t, g, unknown, or other
  misc_feature (200)..(200): n is a, c, t, g, unknown, or other
  misc_feature (277)..(277): n is a, c, t, g, unknown, or other
tggagctccccgcggtggcggccgctctagaactagtggatcccccgggctgcaggaattcgcacgagaccattacctagaacatcctaatcgaaattccctccctcactcgcgtccaaattctctcctcaccacaccacctctccctccgacgcacgggtgcatcgcagtgctagatagagtgaccatgcnaggcgcgncggtgacggtgaatgccgcgggcgacgtgcaaaagccccagcagcagccgatgggggttgggggcgcccccccccgngggtcatggtgccccccccatgggtttggcataaccgatggccgccccacccgatggcgcccccccccaggtcgggggcggctcaattccccccccgcccccccggcgtggtgggattccgccgcaactttggcgcgcaccccgctgccccgcggtccgcgcccggggcacccccccggcctccactatctgggcccgcggggaggggagaaacagcaggcccgtcctgaggagttcgcgtgaattactaagctcttggtggggaggcgctcgcaagcttcccctccataaccttgccgccccacccgccccccccccgtccccccttaaatcctccacatctcctacccggagtaacgggcggactcgccgccggtctccaagaaccccactatcctctacgatatgatagcccgtcccgtacattgctaaacagccgccccctcatgaccccacaccgcagtgcgaaaggttgagggagccatgtccggacgcgtcgggcagcg

SEQ ID NO: 20818 - DNA, 651 bp, Zea mays
  misc_feature: Ceres CLONE 1389622-F
  misc_feature: Translation starting site: 153
  misc_feature: SWISSPROT Homolog: EC 3.4.22.34 Legumain
  misc_feature (234)..(234): n is a, c, t, g, unknown, or other
  misc_feature (262)..(262): n is a, c, t, g, unknown, or other
  misc_feature (265)..(265): n is a, c, t, g, unknown, or other
  misc_feature (286)..(286): n is a, c, t, g, unknown, or other
  misc_feature (332)..(332): n is a, c, t, g, unknown, or other
  misc_feature (347)..(347): n is a, c, t, g, unknown, or other
  misc_feature (355)..(355): n is a, c, t, g, unknown, or other
  misc_feature (356)..(356): n is a, c, t, g, unknown, or other
  misc_feature (379)..(379): n is a, c, t, g, unknown, or other
aaagctggagctccgcggtggcggccgctctagaactagtggatcccccgggctgcaggaattcgcacgagaccattacctagaagatcctaatcgaaaaaaccgacttccagttccactctcgcttccttccctccctccctcccacgcaaatggtggccgctcgcctccgcctcgcgctgctactctccgtctgcctctgctccgcgtgggcgcgcccacgcctcgagacgnccatccgccctgcgtcgcagcgcgcggncgncgccgacgaaaacgacgacgncgccgtcgggacccgctgggctgtgctcatcgcaagctccagcggntactaacactaacgncaccaggnngacatctgcatggcatacagatnatggaaaaaggcgaactccaggatgaaaacttcattggcttcatggacgaagacatcgccgatagcccgaagaatcgagggcctggtgtcatcatcaaacatccccagggggggggacgtcatattttggggggccaaagattaaactggggggaaagggcaacagcaaaatttccttccgtggtttggttggaaaaaaaatgttctccagggggggaacccaaaagtttgggaaaaggggccccaaaaaaaattattttttttttaaaggg

SEQ ID NO: 20819 - DNA, 661 bp, Zea mays
  misc_feature: Ceres CLONE 1389623-F
  misc_feature: Encodes the peptide sequence at SEQ ID NO. 20820
  misc_feature (473)..(473): n is a, c, t, g, unknown, or other
  misc_feature (661)..(661): n is a, c, t, g, unknown, or other
tccccgcggtggcggccgctctagaactagtggatcccccgggctgcaggaattcgcacgagaccattacctagaacatcctaatcgaaaaaccagaaacccgcgaatcaatcccgaatcccgatcgaccggcggcgcgggaggcgatgccggacaaggcggtggacgacgtcatggaggccgcggtgggggcccacttcagcggcctccgcctcgaggcgctgcgcctctccacctctgcgccctcttccccttcctcctcccccgccgccgcggcgcacacgcactccaactgagccgtctacgccaacggcaccaccgagcttccctctcctgccgctgcccggcagccattcgtcatcggggtttctggagggacggcgtcggggaagacgacggtgtgcgacatgatcatccagcagctgcacgacccacgtgtcgtgctcgttaaccaggattcgttttaccgtggncttactgctgaagagtctgcacacgcacaagactataattttgatcaccctgatgcatttgatacagagcaccttctagaatggatggggcagctgaaatgtgctccacctggaaatgttcctatatatgatttcaagaagcatcgacggtgtcctgaaagcttaaaaaggccaatgcatcaaacgtn

SEQ ID NO: 20820 - protein, 84 aa, Zea mays
  misc_feature: Ceres CLONE 1389623-F
  misc_feature: SWISSPROT Homolog: EC 2.7.1.48 Uridine kinase
MIIQQLHDPRVVLVNQDSFYRGLTAEESAHAQDYNFDHPDAFDTEHLLEWMGQLKCAPPGNVPIYDFKKHRRCPESLKRPMHQT

SEQ ID NO: 20821 - DNA, 825 bp, Zea mays
  misc_feature: Ceres CLONE 1389624-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (23)..(23): n is a, c, t, g, unknown, or other
  misc_feature (35)..(35): n is a, c, t, g, unknown, or other
  misc_feature (39)..(39): n is a, c, t, g, unknown, or other
  misc_feature (40)..(40): n is a, c, t, g, unknown, or other
  misc_feature (44)..(44): n is a, c, t, g, unknown, or other
  misc_feature (268)..(268): n is a, c, t, g, unknown, or other
  misc_feature (433)..(433): n is a, c, t, g, unknown, or other
tttttttccccnnnccccccccncccccccccccntggnntagntttctttcttccaaagctggcactccaccgcggtggcggccgctctagaatagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgcctcggcatcatggncgcggaggagcaggcgctgctgtccacggagatcgggaaccgcggcggggagccgccgggcccgggacgccgttcgccggccttcccgggggacgcgggggcgcccactgacgaatttcccggcggcccggggaccctcaagggcaatgttttttgggaaccacnctacctgtcgtgaggcggggggggggtctcttagccccaccaacccccccccacacgtggccgggggcggaccctgccgaggctggcgcccactcactacccctcggaccgagcgcggagagccgatgagcagggagcgggcgacgcacggacgccgccccgcatcgccagccacatcgcctcaaccctctctcctcccgtgcccaccttctcacttaattcgcgtcgttggcatcactcgtcaattctaacctccgcatgacgtggggggacgtccgtgacgagaaaagtcagcgggccgacacccgcggcgacgcggagtggaggagcgacaagcggagggcgggggagacggcaaggttcgtccaccaccgtgccccctaccccgcctc

SEQ ID NO: 20822 - DNA, 718 bp, Zea mays
  misc_feature: Ceres CLONE 1389626-F
  misc_feature: Encodes the peptide sequence at SEQ ID NO. 20823
gctctataactagtggatcccccgggctgcaggaattcgcacgagaccattacctagaacatcctaatcgaaaaattttcttctcccgttcacttctctttggcccgaaaccgaaagctagtgcttgattcggtcgtttttgggcaccgaacacgttcttgggaccgccgccgccgccctacttccagtcccagctgctcaggtctccatcggcctcgagccctttgccggcgacgagcactcacaacaccagggtgtaacaatgtcttcttcaatggaatcgtcataccttcctgctacaactgagtcattagcccaagctcaagaggctaaggatgcttcaaagtccatttcattcctttacggggtcttccaggacccatcttcttccggttgatgcactgagaaacaaaaaaagtggcaattacaaatcttaacaaactacctccctaaaagaaaaccggagcttggagaagcttgggtaaatctttctggacccacgttcaaacccatttttcttggcagtctattccctaagggcaaaaacaatagctaaaaactttcgcccgcgcccaaacacattaatgcgccgtcctcccaacaaccccctcggtcacacacagaacccattccgactcgtccctccccccaaacgaacatcacgatacaaatggcgccctcgcgccaaaaacgatcacgcacttttcccctctacgcg

SEQ ID NO: 20823 - protein, 44 aa, Zea mays
  misc_feature: Ceres CLONE 1389626-F
MSSSMESSYLPATTESLAQAQEAKDASKSISFLYGVFQDPSSSG

SEQ ID NO: 20824 - DNA, 666 bp, Zea mays
  misc_feature: Ceres CLONE 1389629-F
  misc_feature: Translation starting site: 221
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (317)..(317): n is a, c, t, g, unknown, or other
  misc_feature (320)..(320): n is a, c, t, g, unknown, or other
  misc_feature (339)..(339): n is a, c, t, g, unknown, or other
  misc_feature (347)..(347): n is a, c, t, g, unknown, or other
  misc_feature (348)..(348): n is a, c, t, g, unknown, or other
  misc_feature (368)..(368): n is a, c, t, g, unknown, or other
acccgcggtggcggccgctctagaactagtggatcccccgggctgcaggaattcgcacgagaccattacctaaaacatcctaatcgaaaaagaggctaaacccccgtctaaccctgctgccgtgccgcttgccactactccgcttcgttctccgccgcctccccggacgtccggaaacttctagattgaagggggatagccattggcgtcaacgtgtgtgatggaggtcaggggactggggcagctcctggcggcgctggccgcggcgttcttcgtcccgcgcatcgcgggacccggccccgccctcttnnncgcgncgnaggacacggaggccgacgnagcccacnncgagctggcgaggaaggttntttgttttttttcccccccgtgaccatcgggtgggttcgcatcacctgcgcactgaagaacaggcggggggaagggccaaggtttctgttgccaaagggtgcagggagggcaaaaccggggaggttgcttgccaaaatgggcccctccgggctcgggaaaacaaattttgtcatggggttaagagggaattcccccaatctttttctttggcctttccggggtttggaaaaaaaggggcggccaatctggaggggggtaattaaaattttttttgacggaaagagaaaccttttccct

SEQ ID NO: 20825 - DNA, 791 bp, Zea mays
  misc_feature: Ceres CLONE 1389630-F
  misc_feature: Encodes the peptide sequence at SEQ ID NO. 20826
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (25)..(25): n is a, c, t, g, unknown, or other
  misc_feature (529)..(529): n is a, c, t, g, unknown, or other
  misc_feature (636)..(636): n is a, c, t, g, unknown, or other
  misc_feature (638)..(638): n is a, c, t, g, unknown, or other
nnnnnnccccccccccnnnnnaccnacagaaggtgaagggttccccacatacatactggagctccccgcggtggcggccgctctataactagtggatcccccgggctgcaggaattcgcacgagaccattacctagaacatcctaatcgaaaaatccactccactccatcatcccgtgcctcacgagtcacgagtcactccaggtccaggctgagcagcaatggcgccgcgaacgctcggcttcaacgcggccccgctcctccagattctgcggtccctgtgcctcctggccctcgccggggcgaaggcggtgttccggctgccgcccggggcctccccggcgcggggaaacggacaaaaaaaatgatccttgggggggaacagagtttttgcgtgagaactttaaaaacacacacccgataggcaacgccccgcccgcacctctttttaaccccggtgccgggcggtggttatagcgagcccgcaccccttcttctcacctccccacacgggcctccccccgccgggnaggccctccccgtgcttccttttccctcggcgcgcggaaagagctgcccggggatgtgttgtgtgtggtgtattgatgcgcccgtcgcacacgagcgcttccccccntnctcggcgtaccgaccgcccaaccccatacacgcgagcagcagttgttttgtatagggattcatcacccccgtccccccccgagtacctcacgcccatgtcttatataaattctatgacgcacccaaatacggacccgacccagggaagcgccg

SEQ ID NO: 20826 - protein, 48 aa, Zea mays
  misc_feature: Ceres CLONE 1389630-F
MAPRTLGFNAAPLLQILRSLCLLALAGAKAVFRLPPGASPARGNGQKK

SEQ ID NO: 20827 - DNA, 663 bp, Zea mays
  misc_feature: Ceres CLONE 1389635-F
  misc_feature: Encodes the peptide sequence at SEQ ID NO. 20828
  misc_feature (223)..(223): n is a, c, t, g, unknown, or other
aaagctggagctccccgcggtggcggccgctctagaactagtggatcccccgggctgcaggaattcgcacgagaccattacctagaacatcctaatcgaaaaacatcgatcagtcgcgtgtctaggtttcctctctcaccatagcgcccgctctgtcgcccttcgttcacctctccttcctctcctccctgcctgccagggagaggggaagtcagaggcacgnagtggcgcagagcagacgcacgtgaaccattgtagctgtccctgtcgtcgtcgtcgtcgtcaacgaatccacacaggaaaggatggagaaagagccggacatcctcatgaaacagtacgagctcgggcgcacgctcgggcagggcaccttccccaaggtgaccacggccggaacctcccctccgggggaaaaggtggccattcagggcatccacaggaaaaaagtgatgcccgtccccatgtatcaaccaaataaggggggaaattcccgtattgggctccgtccgccaccccaaagttttggaaattggccaaagggatggccaaaaaaaacaaaaaatactctccccggggaaaaggcccggggggggcaaatttttttccccgcggggcccggggggggggtttaagaggggcccccccgaaaaggtcttctccccc

SEQ ID NO: 20828 - protein, 108 aa, Zea mays
  misc_feature: Ceres CLONE 1389635-F
  misc_feature: SWISSPROT Homolog: EC 2.7.11.1 Non-specific serine/threonine protein kinase
MEKEPDILMKQYELGRTLGQGTFPKVTTAGTSPPGEKVAIQGIHRKKVMPVPMYQPNKGGNSRIGLRPPPQSFGNWPKGWPKKTKNTLPGEKARGGQIFFPAGPGGGV

SEQ ID NO: 20829 - DNA, 705 bp, Zea mays
  misc_feature: Ceres CLONE 1389636-F
  misc_feature: Translation starting site: 199
  misc_feature: Pfam Name: UDPGT Pfam Description: UDP-glucoronosyl and UDP-glucosyl transferase
  misc_feature: SWISSPROT Homolog: EC 2.4.1.115 Anthocyanidin 3-O-glucosyltransferase
  misc_feature (380)..(380): n is a, c, t, g, unknown, or other
  misc_feature (418)..(418): n is a, c, t, g, unknown, or other
  misc_feature (560)..(560): n is a, c, t, g, unknown, or other
  misc_feature (574)..(574): n is a, c, t, g, unknown, or other
  misc_feature (578)..(578): n is a, c, t, g, unknown, or other
  misc_feature (587)..(587): n is a, c, t, g, unknown, or other
  misc_feature (602)..(602): n is a, c, t, g, unknown, or other
  misc_feature (621)..(621): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (671)..(671): n is a, c, t, g, unknown, or other
  misc_feature (697)..(697): n is a, c, t, g, unknown, or other
ggagctccccgcggtggcggccgctctagaactagtggatcccccgggctgcaggaattcgcacgagaccattacctagaacatcctaatcgaaaaaggttcttgtcgactttacatatcttctctgatagccttcgtagtgaagagtaggatgagccaccctcctccacggcgttcctgcaggcatccctcatctccatggccttctccctcgccttcctcccttcctcgccaccgcccatcagctccttcaccgctcgctccagctccgaggcctccacgaaattgttcctcttcctgtccaccttcatcgccacggcgacgcctacataggccaccagcgtggaacgcgttcaggtggctgctcggcgtacagcggnccacggtgccatcggcaccccgaaccacaggctctcgnagcaccgagttccagcccgccggtgtgtcacgaaacaccaaaggggcggcggtgggctagtatcctctttctggcggcgccttcgtcgggcacaccaggccttctgcccttggtccctttcgaggaatccatcggggagagnttcggagaggtcgnggtnccgacgggngccccttcgccgggnggccgggggggccccgccncccccnnnggggggggggggggcggttccgcccccgggccgggggggggnctcggggggcggggggcgccgggggngccccctg

SEQ ID NO: 20830 - DNA, 670 bp, Zea mays
  misc_feature: Ceres CLONE 1389642-F
  misc_feature (374)..(374): n is a, c, t, g, unknown, or other
tccccgcggtggcggccgctctagaactagtggatcccccgggctgcaggaattcgcacgagaccattacctagaacatcctaatcgaaaaaacgatcgatcgggccaggcccgcattctatgggatccgtctctccactctcttctctaccgaacacaatctcatccgtcttcctcttccccatcagccgccctaccgagtcttcgcacgcacgacgcttcgtcaggatcgattcgcgagacctctcctgtccggatcgaggttcatggtttacatatgcgcgtttgtttactgatgcataccacgaccacctgatccggatgtcaggacagatctcctgctttaatcgagtccagttcatgtatgaactctnccttttcctgcacgttgctagatgtaaaagggtggtccgggatttaagagaacacccacgcatccatgtctgaccagcaaaggcactacgggagctacgagctcctcccgctcacccaagatttggcggtgctggtctggacgcggccgtcactcttggacgccgaggcaccgacaagcttggaagctttaccataatgcaggaagtgaaagacgacgggtgcttagtgaacagcaaaggggacgacactccccgagccacccgaaagagaaaaatggcgaaaggagcaaggttct

SEQ ID NO: 20831 - DNA, 671 bp, Zea mays
  misc_feature: Ceres CLONE 1389643-F
  misc_feature: Encodes the peptide sequence at SEQ ID NO. 20832
  misc_feature (276)..(276): n is a, c, t, g, unknown, or other
  misc_feature (287)..(287): n is a, c, t, g, unknown, or other
  misc_feature (367)..(367): n is a, c, t, g, unknown, or other
  misc_feature (368)..(368): n is a, c, t, g, unknown, or other
  misc_feature (402)..(402): n is a, c, t, g, unknown, or other
  misc_feature (404)..(404): n is a, c, t, g, unknown, or other
  misc_feature (405)..(405): n is a, c, t, g, unknown, or other
  misc_feature (516)..(516): n is a, c, t, g, unknown, or other
  misc_feature (574)..(574): n is a, c, t, g, unknown, or other
aagctggagctccccgcggtggcggccgctctagaactagtggatcccccgggctgcaggaattcgcacgagaccattacctagaacatcctaatcaaaaagcttgctttgcttccgagtttcgacacgcgtgcccaggaatcggtcggattccccaatcccgtcaccatgggcgcgccgccttctccttcgtcccgctcccccgtcagcgaggttgccgtccacagattcagcggcaccttggatgtatcatcatcgccctcaaggaccgagttngtgagcatggntgagcaacactcacatttgattgggtggacgattattggtgccgaggatgatgcatcagatgtgggaatggatgataaanntctgcatgaaatgcttgacctatcccttgtgcgngnncagcaatcaaaaagaagggaagaggatgaccttgtccttctttgtaataacatgaaaatgcatggggtatggttcatggatacatggaagatcacccttcccttttttggnacggagatggcctccacgcttgaaaagatcagataataccgggggagggtggattggnaggggtcattctatttggaattaaccgctcaccggcgaaacctgtcactgtggaaaaattgggaatttggaaatttcccaaccggggagggaaaaaa

SEQ ID NO: 20832 - protein, 127 aa, Zea mays
  misc_feature: Ceres CLONE 1389643-F
  misc_feature (36)..(36): Xaa is any aa, unknown, or other
  misc_feature (40)..(40): Xaa is any aa, unknown, or other
  misc_feature (67)..(67): Xaa is any aa, unknown, or other
  misc_feature (79)..(79): Xaa is any aa, unknown, or other
MGAPPSPSSRSPVSEVAVHRFSGTLDVSSSPSRTEXVSMXEQHSHLIGWTIIGAEDDASDVGMDDKXLHEMLDLSLVRXQQSKRREEDDLVLLCNNMKMHGVWFMDTWKITLPFFGTEMASTLEKIR

SEQ ID NO: 20833 - DNA, 842 bp, Zea mays
  misc_feature: Ceres CLONE 1389644-F
  misc_feature: Encodes the peptide sequence at SEQ ID NO. 20834
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (842)..(842): n is a, c, t, g, unknown, or other
nnnccccccccccccccccccccccacccccnnnnaaagtgcgtttgtcccaaagctggagctccccgcggtggcggccgctctagaactagtggatcccccgggctgcaggaattcgcacgagaccattacctagaacatcctaatcgaaaatcagttgcgggcgcgcgtccctgtttcgctcgtgccgttgcgctgcgccaagcctccccacctctctcgtctcttctccacccgccgccctcgtgggagtgaaaccctagctagggttctgcccgccgccgccttcgatcaagacgcctgcagccttagcgcgagcccgccatggacacaggacgcaagcgcatcggcgccggggggcggccacgggcgccggggcgtcccgaaagcgcgcgaagagaaatcggaaaaaacttcaaatgggcccgtaagaaagcaaaaaccaaggcccgtgcaccaaaattttttcacgaactggcggggtttggcccctttttgggttcaaaattgggccctttttcctccaataaacctcccccggggggggggttaatcccggggcggggttttcaaaaagattgactccaacgcttttggggggggggggcccccgcctggttttcccggccccccccccccagggaaagggacggcgccacatgcgccacaccccgggccgcaccccccaagagagggggccgaccatatgttcacgcttagtattggataaataacctggtatctggtggaattaccaatctcacaaaccctctgggaatgaaagaggagtggacgcggtggagaacggaacctcacggcgccaccttttcagtttaacaaan

SEQ ID NO: 20834 - protein, 85 aa, Zea mays
  misc_feature: Ceres CLONE 1389644-F
MDTGRKRIGAGGRPRAPGRPESARREIGKNFKWARKKAKTKARAPKFFHELAGFGPFLGSKLGPFSSNKPPPGGGLIPGRGFQKD

SEQ ID NO: 20835 - DNA, 690 bp, Zea mays
  misc_feature: Ceres CLONE 1389647-F
  misc_feature: Encodes the peptide sequence at SEQ ID NO. 20836
  misc_feature (294)..(294): n is a, c, t, g, unknown, or other
aaagctggagctccccgcggtggcggccgctctagaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtggncatgctccccgttcgggctcgcgaaacctcgggcgcctctaagaggcctcaccgacgccctccaacgggtccgggtgcacggtaatggttccgagtaccaagaatactcggggagcacccccctgtggacgcactatattggactcagccactcaccggcctgtagccgtacgctggtgcaatacaccagggggtacacattcttttgtatgtgatcccgcattattttgtgcatttggtgtaccacttgccgcctaccacgcagctactacagtcacaagcaccgcttgtctgttgttgttctatcttcttctctctttcccctttttcacacgccactccgcgtttcctgtatacgcggcaatgtgaccattaaaatacgcctcacgatctcac

SEQ ID NO: 20836 - protein, 73 aa, Zea mays
  misc_feature: Ceres CLONE 1389647-F
  misc_feature (46)..(46): Xaa is any aa, unknown, or other
MGALRSLAISYPEFLVAGLCFVSLSALRHAMRERRQRAPLSWPVVXMLPVRARETSGASKRPHRRPPTGPGAR

SEQ ID NO: 20837 - DNA, 663 bp, Zea mays
  misc_feature: Ceres CLONE 1389649-F
  misc_feature: Translation starting site: 204
  misc_feature: Pfam Name: Acyl-CoA_dh_N Pfam Description: Acyl-CoA dehydrogenase, N-terminal domain
  misc_feature: SWISSPROT Homolog: EC 1.3.3.6 Acyl-CoA oxidase
  misc_feature (505)..(505): n is a, c, t, g, unknown, or other
  misc_feature (507)..(507): n is a, c, t, g, unknown, or other
  misc_feature (526)..(526): n is a, c, t, g, unknown, or other
aaagctggagctccccgcggtggcggccgctctagaactagtggatcccccgggctgcaggaattcgcacgagaccattacctagaacatcctaaaaaaaatctctcgtctctatcgccgcatcgcttctctgccggagctccaacaacctcgcctcgcgcagcactccgctgaccctccctgactccctccctgccgctgggatggccgggaaacgagttacgggccgcgatgggcaagacgagggcggcgccaaggtcgggctcccggcgatggacctctccctcgcgttcccgcaggccacacctgcctccattttcccgccgtccgcttcggattattaccagtctgatgatttgctgaccagtgaagagcgctctatcaggatgaaggtcaggggtattatggaaaaaagaaattgctcccattatgtcagcgtactgggaaaaaggagagttttcatttaatgcccatcctaaactgcaaagccttggtgtttgctggngnacaataaaggggttatggntgcccaggactttccattaccgccagtggtggtactatgtcaaaaatggacgggaagaagcaagctggttccaattaatactggggcctccccctctgggaagggggaaaaagctctttgggggaccgaggctcaaa

SEQ ID NO: 20838 - DNA, 684 bp, Zea mays
  misc_feature: Ceres CLONE 1389650-F
  misc_feature (265)..(265): n is a, c, t, g, unknown, or other
  misc_feature (309)..(309): n is a, c, t, g, unknown, or other
  misc_feature (314)..(314): n is a, c, t, g, unknown, or other
  misc_feature (332)..(332): n is a, c, t, g, unknown, or other
  misc_feature (335)..(335): n is a, c, t, g, unknown, or other
tggagctccccgcggtggcggccgctctagaactagtggatcccccgggctgcaggaattcgcacgagaccattacctagaacatcctaatcaaaaaacatcgattttcctccggaatcgtaacctcagaaagccaaatctcattctccggcgctcaggcccacccaagcgtcgactctcccgatccaatcggtacctcctagttcctcgccggcggtagcggcgtcgggcgaacagcggtgacttggcgagggcgcttggccgncgacaatcatccactaagatggaaggtgaggcagagaccgtggnttggnttcttgtctaaacatgtnggnctctggaggactactacattccagattacattctgaaagcaggtgcccaacaagtacttgttgatcatgcggcaccctgccccgttgtagtgttcatcaactcaagatctggaggcaacttgggaagtagtttaatcaaaaaataatcggagcttctcaatgagcacaggtttttgatctctcaaaagagggtccagaaaaggaattgcattggtttatatgcccaccttgaaaagctgaaaatgggaaggaaactttcttgcagttcaaaatttggagggcacggaggtttaatgttgccggggggggatgaaacagttagctgggtggttggggggaaacaaggacc

SEQ ID NO: 20839 - DNA, 690 bp, Zea mays
  misc_feature: Ceres CLONE 1389651-F
  misc_feature: Translation starting site: 226
  misc_feature: Pfam Name: FA_desaturase_2 Pfam Description: Fatty acid desaturase
  misc_feature: SWISSPROT Homolog: EC 1.14.19.2 Acyl-[acyl-carrier-protein] desaturase
  misc_feature (206)..(206): n is a, c, t, g, unknown, or other
  misc_feature (230)..(230): n is a, c, t, g, unknown, or other
  misc_feature (231)..(231): n is a, c, t, g, unknown, or other
  misc_feature (286)..(286): n is a, c, t, g, unknown, or other
  misc_feature (292)..(292): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (313)..(313): n is a, c, t, g, unknown, or other
  misc_feature (314)..(314): n is a, c, t, g, unknown, or other
  misc_feature (318)..(318): n is a, c, t, g, unknown, or other
  misc_feature (319)..(319): n is a, c, t, g, unknown, or other
  misc_feature (325)..(325): n is a, c, t, g, unknown, or other
aaagctggagctccccgcggtggcggccgctctagaactagtggatcccccgggctgcaggaattcgcacgagaccattacctagaacatcctaatcgaaaaaacccactgttgcagcgcgagtgtagcaggctgcacacacaaggaaggggacacccacagcgcctaagatcccgtcctccgcgtcgagatctttgccgagccgntgaccgtcgagggatcgccatggnncgtgaggcgtcccccgtgtcgcatggcaccgcggcagcgccgctgccgcctttcncgcggnagagatggccgttgnnnttgnntgtnnccatgncgtccaccatcaacggggtcaaaactgtcaaaagaacctataccccctcacgagagggacatcgccaaaattacccattcactaccacctcaaaggcgggagatttttcgattcacttcaacctggggccaaggataacctactgaacctactggagccagttggaaaagcatggcaagcacaggatttcctacagaagcttcttctgaggggttttatggaagaaggtaaaggactgggggggaggggacaaaggaaataccgggaggaaaactttgtttggcttaagtgggggaaaaggggtaaccggaggaacccttacccaacttaccaaaaaaggggtttaacacctttggggggggacg

SEQ ID NO: 20840 - DNA, 767 bp, Zea mays
  misc_feature: Ceres CLONE 1389654-F
  misc_feature: Encodes the peptide sequence at SEQ ID NO. 20841
aagctggagctcaccgcggtggcggccgctctagaactagtggatcccccgggctgcaggaattcgcacgagaccattacctagaacatcctaatcgaaaagtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggccgcccgatgggtgagcaagtgaaagccatgctccacgacaaggggccgacggcgtccaaggcgctgacgggggggacgctgttccccgctggccgccctgctgctgggtgctggccgggcttggccctaacgcccccccgggttgggggcttgcccggggcacaccccgggggttccggattctttcgcccccggggtgggcccccgccccggctggttaatcggggacgggccggaatggggtttccccccacggccggggggggctgggggcctcgggggccctggcccccccttccacggggcccccccaaaaagggggggggaagggggttccagggggaccccgggaaaaaatggggggagggggcccccccatatgtaggggggaaggcccccgggaccccgcggggcgggaaaaaaacccccccaatcggggcccccccttcacacaggggcatgaggtggtaaaaaacgcccggccccccacg

SEQ ID NO: 20841 - protein, 183 aa, Zea mays
  misc_feature: Ceres CLONE 1389654-F
MADRDRSGIYGGAHATYGQQQQQGGGGRPMGEQVKAMLHDKGPTASKALTGGTLFPAGRPAAGCWPGLALTPPRVGGLPGAHPGGSGFFRPRGGPPPRLVNRGRAGMGFPPTAGGGWGPRGPWPPLPRGPPKKGGGRGFQGDPGKKWGEGAPPYVGGKAPGTPRGGKKTPPIGAPPSHRGMRW

SEQ ID NO: 20842 - DNA, 715 bp, Zea mays
  misc_feature: Ceres CLONE 1389657-F
  misc_feature: Encodes the peptide sequence at SEQ ID NO. 20843
gctcttaactagtggatcccccgggctgcaggaattcgcacgagaccattacctagaacatcctaatcgaaaaaccaacaggaaaaaaggcccagaggcggtgccgtgaccgattcgagacgcaagagaaggatcgagacgaggcggcggttttccgggggcagcatcggcgcggccacgaaagatgtcttactcaagaggctcaaggtatggatctcgctcgccttactcgagaagcacaaggtaccgaagtcgctctaggagtgtcgactctagtgatgctgaaaaccctgagaacaacctgtatgtgactggtttgtcagctcgtgtaacggatcgagatctggagaagcacttctccactgagggtgaggtgattgatgccagcgttgtatatgatcctttgcacaaggggatcacgggggttttggtttttgttaccatggttgctgttaaaagaagcagatcgctgcatcaaatatctggaccgttcttgggtggcaagtcggctcttaactgtggaaaaaatttgttgacagcaaccgggtaaaggttggtagttgccttgaacaaactggtacaaccaaaacccaaaccatggccaccctccagccaaaggggtggtatggccctacttttgaaaaaaaaaaaaccggggttaaaccccccaacccccggggaaggatttttgggcaaaaaaaccccccccgggggg

SEQ ID NO: 20843 - protein, 121 aa, Zea mays
  misc_feature: Ceres CLONE 1389657-F
MSYSRGSRYGSRSPYSRSTRYRSRSRSVDSSDAENPENNLYVTGLSARVTDRDLEKHFSTEGEVIDASVVYDPLHKGITGVLVFVTMVAVKRSRSLHQISGPFLGGKSALNCGKNLLTATG

SEQ ID NO: 20844 - DNA, 737 bp, Zea mays
  misc_feature: Ceres CLONE 1389659-F
  misc_feature: Encodes the peptide sequence at SEQ ID NO. 20845
  misc_feature (248)..(248): n is a, c, t, g, unknown, or other
  misc_feature (249)..(249): n is a, c, t, g, unknown, or other
  misc_feature (257)..(257): n is a, c, t, g, unknown, or other
  misc_feature (260)..(260): n is a, c, t, g, unknown, or other
  misc_feature (263)..(263): n is a, c, t, g, unknown, or other
  misc_feature (308)..(308): n is a, c, t, g, unknown, or other
  misc_feature (331)..(331): n is a, c, t, g, unknown, or other
  misc_feature (333)..(333): n is a, c, t, g, unknown, or other
  misc_feature (348)..(348): n is a, c, t, g, unknown, or other
  misc_feature (542)..(542): n is a, c, t, g, unknown, or other
tcaccgcggtggcggccgctctagaactagtggatcccccgggctgcaggaattcgcacgagaccattacctagaacatcctaatcgaaaaaatagcgaacaaacatcgagtacagtcggctaggtaatctggtggtacgacgacatggcggccaccagcagcaagtcgtcgtcgtcctcgagctcggcgcagcgggcagctgccgcactgctcatggccgccgccgtggcggtgtccgtcctggtgnntggcgcgncgncgntgtgcgacatgagcaacgagcagttcatgtcgtgccagcccgcgncggccaagacgacgaacccgccngnccgcgcgtcgcaggngtgctgcgacgcgctggcgggggcgaacctcaagtgcctgtgcggctacaagaactcggcgtggatgtggcgtctacaacatcgaaccccaaggggggcaatgtgagtttcccggcaaagggccggctcccccaccgcgcccgattgctaaaagtggggttaccaagccaagcccaggcaggagggccccccgncaattgttaagctggacggggcttgggggggcaatttgccaaagggtggaaggaagggcccccgaaagaaaagggcttttttttccctctcccatttttggaaccgaaccttttataaaggggggggggtgccaaaaaaaaaaaaaaagggtttttgtgcccccccccttggggattgaatgggaccagtgggcc

SEQ ID NO: 20845 - protein, 102 aa, Zea mays
  misc_feature: Ceres CLONE 1389659-F
  misc_feature (35)..(35): Xaa is any aa, unknown, or other
  misc_feature (38)..(38): Xaa is any aa, unknown, or other
  misc_feature (39)..(39): Xaa is any aa, unknown, or other
  misc_feature (40)..(40): Xaa is any aa, unknown, or other
  misc_feature (55)..(55): Xaa is any aa, unknown, or other
  misc_feature (63)..(63): Xaa is any aa, unknown, or other
  misc_feature (68)..(68): Xaa is any aa, unknown, or other
MAATSSKSSSSSSSAQRAAAALLMAAAVAVSVLVXGAXXXCDMSNEQFMSCQPAXAKTTNPPXRASQXCCDALAGANLKCLCGYKNSAWMWRLQHRTPRGAM

SEQ ID NO: 20846 - DNA, 723 bp, Zea mays
  misc_feature: Ceres CLONE 1389660-F
  misc_feature: Translation starting site: 183
  misc_feature: Pfam Name: Ribosomal_L14e Pfam Description: Ribosomal protein L14
aagctggagctcaccgcggtggcggccgctctagaactagtggatcccccgggctgcaggaattcgcacgagaccattacctagaacatcctaatcgaaaatgttcggacttccgccgcgcttcgccctctcgctccagccgcttcacagcgccgccgctcgcctctccgactgccgcgagaatgccgttcaagaggttcgtggagatcgggcgcgtggcccttgtgaactacggcaaagactacggccgcctcgtcgtcatcgtcgatgtggtcgaccagaacagggcacttgtggacgcccctgatatggtcaggtgccagattaacttcaaacggctctcacttactgacatcaagaattgacatcaaacgcgttcccaagaagtcaacccctgatcaagggctatggaggaagctgatgtgaagacgaagtgggaaaacagctcatggggcaagaagctgattggtccagaagaggagggctgcgctcagtgactttgacaggttcaaggtcatggctggcaaggatcaagaggggggttgctatccaggaagagctcccccagctgaaaaaaggggccacggcttaaacccctttttgggggagggcatgtaagtttttgggttcatggttcctcaacattttggttttaagtggtggccaaagcccgaaatcaagaagaatgtttcctggggcaccccttttcaaacttcatcaaag

SEQ ID NO: 20847 - DNA, 676 bp, Zea mays
  misc_feature: Ceres CLONE 1389665-F
  misc_feature: Translation starting site: 259
  misc_feature: SWISSPROT Homolog: EC 6.3.2.19 Ubiquitin--protein ligase
  misc_feature (51)..(51): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (133)..(133): n is a, c, t, g, unknown, or other
  misc_feature (137)..(137): n is a, c, t, g, unknown, or other
  misc_feature (144)..(144): n is a, c, t, g, unknown, or other
  misc_feature (145)..(145): n is a, c, t, g, unknown, or other
  misc_feature (279)..(279): n is a, c, t, g, unknown, or other
  misc_feature (361)..(361): n is a, c, t, g, unknown, or other
  misc_feature (408)..(408): n is a, c, t, g, unknown, or other
aagctggagctccccgcggtggcggccgctctagaactagtggatcccccngggctgcaggaattcgcacgagaccattacctagaacatcctaatcgaaaagaaacccgtctcgcaccacaagcgnnnaggncggnaaagggnngaaccccggggcggaagaagagagagaagacgtctctctcctctcggcgtccccgttccccaacctctcgtctgctgcctgcctgcctgcctgcctgcaaaaaggagtttgtcatggcgtctaagcgcatcctncaggagctgaagggactgcagaaggacccccccacatcatgcagtgcaggtccctgctggttgaggacatggtttcattggncaagcacaattaatggggaccacctgacagtcctatggctggggggnggtttttttaggggacaattcatttcccgccagattaccccttcaaacctccaaaggtttctttcaaggaaaaggggcttccatccctaatttcaacgggaatgggaggatttggccttggacattctccaaaaaagagggggaggccctgcttttgaaaatttttttaaggggcccggggtccccatttgggggccccggggtggacggacccccaaacccgggagaaccccctttttgcccccgaaaaattggcccacaatggtaa

SEQ ID NO: 20848 - DNA, 700 bp, Zea mays
  misc_feature: Ceres CLONE 1389666-F
  misc_feature: Translation starting site: 405
tccccgcggtggcggccgctctagaactagtggatcccccgggctgcaggaattcgcacgagaccattacctagaacatcctaatcgaaaattctctcccctgagcctgactggaaccttcccgagagaggatacaaaggcacccggatcgaggaaaccaatccattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatgggacgtggtggaccccggagcaggcgcgcctcgcgaaggaggccgcgcgtgcgccgtgatggcgctggagcgggtccccggccgaatccccgcgcagggcggcgtggcgcgcaatgccgacccgggcctcatccgcgacatcaagcgcgccgtcaccatcccggtcatggccaagggccgcatcgggcacttcgtggaggccagaatctggaggccgggggcgtccactacctggaccaaagcgaagtggtgacccccgccgacgacgcgcacccatcaacaaggacaacttccgcgtccccttcgtctggggtggcgcgacctcggggaggggctccgcaggggtgcgcgagg

SEQ ID NO: 20849 - DNA, 691 bp, Zea mays
  misc_feature: Ceres CLONE 1389668-F
  misc_feature: Translation starting site: 246
  misc_feature (322)..(322): n is a, c, t, g, unknown, or other
  misc_feature (337)..(337): n is a, c, t, g, unknown, or other
  misc_feature (340)..(340): n is a, c, t, g, unknown, or other
  misc_feature (384)..(384): n is a, c, t, g, unknown, or other
  misc_feature (438)..(438): n is a, c, t, g, unknown, or other
  misc_feature (577)..(577): n is a, c, t, g, unknown, or other
  misc_feature (597)..(597): n is a, c, t, g, unknown, or other
aaagctggagctccccgcggtggcggccgctctagaactagtggatcccccgggctgcaggaattcgcacgagaccattacctagaacatcctaatcgaaaatcagcatctcgcgcttcagatctcgcccaccgatctggaactggaattccctcccgatctgtatgtatctcacgcacgcttgctcgcgttcttggctttgctcccacctctctctagcagagtaacagtctagcagagcaagcatgtcgtcgtcggcggagaacgaccccacggtgacggtgaccgagcgcggaggcaaggacaagcacgaggacggcgncgaacaggagcaggncgncggcgtcttcatcgacaaggtgaggacttcatccacgacatcgncagagaaatcgaggagggtcgtcggttcggcaagccacgggcgacgtgtgcggnattcacatcccggacatcagcctccaccgcgccgacctcggtggtggacgtgctcatcaagaacccgaacccggtcccgatcccgctcgtggacatcgactacctcatcgacagcgacggccgcaaggttggtgtcggncctcattcccggacgccggnaacatccacggggaacggccaggagaccgtcaaagatcccggtgtcgctcgtcttcgacgaaatctagaggacttaccagacattccagccggc

SEQ ID NO: 20850 - DNA, 671 bp, Zea mays
  misc_feature: Ceres CLONE 1389670-F
  misc_feature: Encodes the peptide sequence at SEQ ID NO. 20851
gctctgtactagtggatcccccgggctgcaggaattcgcacgagaccattacctagaacatcctaacgaaaaaatcaattctccagaccctccccggcaaccgcgtccggccgtccgcttccgtctccttggataaccacgacgcccgccggcaagcgaaagcgaagcgagccaacccagccatggagaaggcgatcgatcggcagcgggtcctcctggcgcacctcctcccctccctctccgccgcctcctcgcagcctcagcttgcggcgtcggcgtgcgcggccggggacagcgccgcctaccagaggtcctcctccttcggggacgatgtcgtcgtcgtcgctgcctacaggacgccgatatgcaaggccaagcgaggaggcttcaaggacacctacccagaggacctcctcactgttgttctcaaggctgttctggacaacactagaatcaatccagctgacatcggtgacatcgtcgttgggacggtgcttggccctggttcccagcgtgcaaacgagtgcaggatggctgcgttgtttgctggattccctggaaaccgccctggtagaactgtcaacccgccaggttcatctgggctaaagcaagaaactgaaggcccaactggtaaaaaggctggtaaaaagggaataaggaatgggggcggg

SEQ ID NO: 20851 - protein, 163 aa, Zea mays
  misc_feature: Ceres CLONE 1389670-F
  misc_feature (48)..(163): Pfam Name: Thiolase_N Pfam Description: Thiolase, N-terminal domain
  misc_feature: SWISSPROT Homolog: EC 2.3.1.16 Acetyl-CoA C-acyltransferase
MEKAIDRQRVLLAHLLPSLSAASSQPQLAASACAAGDSAAYQRSSSFGDDVVVVAAYRTPICKAKRGGFKDTYPEDLLTVVLKAVLDNTRINPADIGDIVVGTVLGPGSQRANECRMAALFAGFPGNRPGRTVNPPGSSGLKQETEGPTGKKAGKKGIRNGGG

SEQ ID NO: 20852 - DNA, 757 bp, Zea mays
  misc_feature: Ceres CLONE 1389671-F
  misc_feature: Encodes the peptide sequence at SEQ ID NO. 20853
  misc_feature (369)..(369): n is a, c, t, g, unknown, or other
  misc_feature (427)..(427): n is a, c, t, g, unknown, or other
  misc_feature (430)..(430): n is a, c, t, g, unknown, or other
  misc_feature (508)..(508): n is a, c, t, g, unknown, or other
  misc_feature (513)..(513): n is a, c, t, g, unknown, or other
  misc_feature (530)..(530): n is a, c, t, g, unknown, or other
  misc_feature (544)..(544): n is a, c, t, g, unknown, or other
  misc_feature (593)..(593): n is a, c, t, g, unknown, or other
ggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacgganaaagaggacgacgcggtggtgcagccgcagaccttcccgcccttcgaccccgctcggnggnggcgcgtcccccgggcgtcggcgcctccccggcggcagcattcctggcagcagcattccccgggtcagcatgcccggnagcgncagcagcctaccccggntcagcttgcccggnaggggagatgccctcttttttgggggggggttcccccgggttcaggggntttcgggggaatggccggggtcccccaccgccggtttcggccccggagacgccaacaaggcctgaacgccaaaaaggggggaaaaaaaggggggcgaccgggtactggtgaaaaccccccccccttcaggggaggggggggtcggggggtttccccaaccccat

SEQ ID NO: 20853 - protein, 52 aa, Zea mays
  misc_feature: Ceres CLONE 1389671-F
  misc_feature (5)..(5): Xaa is any aa, unknown, or other
  misc_feature (11)..(11): Xaa is any aa, unknown, or other
  misc_feature (32)..(32): Xaa is any aa, unknown, or other
MPGSXSSLPRXSLPGRGDALFFGGGFPRVQGXSGEWPGSPTAGFGPGDANKA

SEQ ID NO: 20854 - DNA, 740 bp, Zea mays
  misc_feature: Ceres CLONE 1389675-F
  misc_feature: Encodes the peptide sequence at SEQ ID NO. 20855
  misc_feature (633)..(633): n is a, c, t, g, unknown, or other
  misc_feature (680)..(680): n is a, c, t, g, unknown, or other
  misc_feature (681)..(681): n is a, c, t, g, unknown, or other
aagctggagctccccgcggtggcggccgctctagaactagtggatcccccgggctgcaggaattcgcacgagaccattacctagaacatcctaatcgaaaaacgaagagcagcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgcagtgcctatcgggtactggttctttaagagtcggaggtgaatttctttgcaggcactatcacgagcgcactatctacatcccacaacccaactggggaaatcacccaaaagtcttcaccctatctggcttttgacgtaggagctaccgctattatgantcctgcacatgcagccttcacttcgaaggactcctggaagacctcgnntctgctccttcagggtcaatggtactgctgcatgcctgtgctcacaccctactggagta

SEQ ID NO: 20855 - protein, 150 aa, Zea mays
  misc_feature: Ceres CLONE 1389675-F
  misc_feature: SWISSPROT Homolog: EC 2.6.1.1 Aspartate transaminase
MASQGSSVFAALEQAPEDPILGVTVAYNKDPSPVKVNLGVGAYRTEEGKPLVLNVVRRAEQMLINNPSRVKEYLPITGLAEFNKLSAKLIFGADSPAIQENRVATVQCLSGTGSLRVGGEFLCRHYHERTIYIPQPNWGNHPKVFTLSGF

SEQ ID NO: 20856 - DNA, 728 bp, Zea mays
  misc_feature: Ceres CLONE 1389677-F
  misc_feature (543)..(543): n is a, c, t, g, unknown, or other
  misc_feature (583)..(583): n is a, c, t, g, unknown, or other
  misc_feature (592)..(592): n is a, c, t, g, unknown, or other
  misc_feature (638)..(638): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
gagctccccgcggtggcggccgctctataatagtggatcccccgggctgcaggaattcgcacgagaccattacctagaacatcctaatcgaaaacccgtccctccactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttggcctccgccgttcttcgacaggggcgcgccccggtgcccactccgcgaaatccgagtcccttgtgcagctccgtagggtggaagagatccatcaggcggtgagcggtaggaggcgcccgtacaactgaggggacgggcaatggcggccgtggcaggcccactctgcacgtggctcgtcgccgcgtgcttgtctgcggcttgcgacgcaaaaagtacaagcagaagcattgctgccccggcgnaagcggcgcttggggcggcgtcatgctcgggctggcgcgnccgctcggngcgcggggtcgcggcttggcgcgctctggaatgggctatggctggntgccttacagctgaaaggagtgtcattgaaaagagaaaccgatatcaacaaggggggaggtgggttgcacctgggcatgggtggnnnaag

SEQ ID NO: 20857 - DNA, 656 bp, Zea mays
  misc_feature: Ceres CLONE 1389678-F
  misc_feature: Encodes the peptide sequence at SEQ ID NO. 20858
  misc_feature (434)..(434): n is a, c, t, g, unknown, or other
tccccgcggtggcggccgctctattactagtggatcccccgggctgcaggaattcgcacgagaccattacctagaacatcctaatcgaaaaacaagcaccagaccaattagctagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctacccgcgcggcatcgccgagttcgtcgccaccttcctcttcctctacatctccatcctcaccgtcatgggcgtctccaagtccacctccagtgcgcaccgtcggnatcagggcatcgcctggtccttcgggggaatgatcttcgccttcgtttactggaccgccgggatttccggggggaacatcaacccggggggggaccttcgggttgtcccgggggagggaaatttgcccccccccaagggggggggtttaaatcaaaagggaagggccggggggccaattgggggggggggggggcctaaaagggggttcccagaagggggtt

SEQ ID NO: 20858 - protein, 161 aa, Zea mays
  misc_feature: Ceres CLONE 1389678-F
  misc_feature (46)..(159): Pfam Name: MIP Pfam Description: Major intrinsic protein
  misc_feature (88)..(88): Xaa is any aa, unknown, or other
MEGKEEDVRLGANKFSERQPIGTAAQGTDDKDYKEPPPAPLFEPGELKSWSFYPRGIAEFVATFLFLYISILTVMGVSKSTSSAHRRXQGIAWSFGGMIFAFVYWTAGISGGNINPGGDLRVVPGEGNLPPPKGGGLNQKGRAGGPIGGGGGPKRGFPEGG

SEQ ID NO: 20859 - DNA, 697 bp, Zea mays
  misc_feature: Ceres CLONE 1389679-F
  misc_feature: Encodes the peptide sequence at SEQ ID NO. 20860
  misc_feature (494)..(494): n is a, c, t, g, unknown, or other
  misc_feature (554)..(554): n is a, c, t, g, unknown, or other
  misc_feature (599)..(599): n is a, c, t, g, unknown, or other
  misc_feature (602)..(602): n is a, c, t, g, unknown, or other
  misc_feature (697)..(697): n is a, c, t, g, unknown, or other
aagctggagctccccgcggtggcggccgctctataatagtggatcccccgggctgcaggaattcgcacgagacctttacctagaacatcctaatcgaaaaatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgcggccgggacggtgggcttcttctggctggtgaaccacggcgtggcagagggagctgatggggcgcatgctccgcgnggtgcgcagttcacgagggccccgtgggagcgagcaggcgctctactcccaggacctggntcgcaactgcgcttcgcctccacttttcgactctcaggccgctgncgncgacggcgcgaacgtctttctgcgagtggctccaacccgccgccgcggaagagctgcgcgagcactgaggacgtgatgctggatacggcgcgcgn

SEQ ID NO: 20860 - protein, 184 aa, Zea mays
  misc_feature: Ceres CLONE 1389679-F
  misc_feature: SWISSPROT Homolog: EC 1.14.11.20 Desacetoxyvindoline 4-hydroxylase
  misc_feature (152)..(152): Xaa is any aa, unknown, or other
MAPTTATKDDSGYGDERRRELQAFDDTKLGVKGLVDSGVKSIPSIFHHPPEALSDIISPAPLPSSPPSGAAIPVVDLSVTRREDLVEQVRHAAGTVGFFWLVNHGVAEGADGAHAPRGAQFTRAPWERAGALLPGPGSQLRFASTFRLSGRXRRRRERLSASGSNPPPRKSCASTEDVMLDTAR

SEQ ID NO: 20861 - DNA, 702 bp, Zea mays
  misc_feature: Ceres CLONE 1389683-F
  misc_feature: Encodes the peptide sequence at SEQ ID NO. 20862
  misc_feature (588)..(588): n is a, c, t, g, unknown, or other
  misc_feature (589)..(589): n is a, c, t, g, unknown, or other
  misc_feature (670)..(670): n is a, c, t, g, unknown, or other
  misc_feature (695)..(695): n is a, c, t, g, unknown, or other
aaactggagctccccgcggtggcggccgctctataactagtggatcccccgggctgcaggaattcgcacgagaccattacctagaacatcctaatcgaaaagtctttgggtgagcacaccgcgcagcaacgagaggggcaaacaagcttgctactgtgatttctcgtccgagcagcggcggaggagagagagagagcatggccgaccacaaggaggagcctgtgccggagtctgtgatggacaagatcaccgagaagttccacggcggggactcgtcgtcgtcgtcgtctgactcggacgacgagaagaaggggtcctcgttggcgtcggcggcggaagccatgaaggccaagatctaccgccttttcggccgggagaggcccgtccactccgtcctcggcggcggcaagcctgccgatcttatcctatggaggaacaggaagatctctgggcgggtacttgctggtgccacggccatctggctcctattcgaggtcatggagtaccatctcctcaccttggtgtgccactgtctcatcctctcgctggccatcctcttcctgtggtccaatgccctcactttcatcnnacagtccccaccgaacattcctgaggtcaaatccctgaggatgtggctgttaatggtgccctgtcactgagatatgagatncacaggggctttgctaccttaaggnagattgg

SEQ ID NO: 20862 - protein, 153 aa, Zea mays
  misc_feature: Ceres CLONE 1389683-F
  misc_feature (72)..(151): Pfam Name: Reticulon Pfam Description: Reticulon
  misc_feature (131)..(131): Xaa is any aa, unknown, or other
MADHKEEPVPESVMDKITEKFHGGDSSSSSSDSDDEKKGSSLASAAEAMKAKIYRLFGRERPVHSVLGGGKPADLILWRNRKISGRVLAGATAIWLLFEVMEYHLLTLVCHCLILSLAILFLWSNALTFIXQSPPNIPEVKSLRMWLLMVPCH

SEQ ID NO: 20863 - DNA, 738 bp, Zea mays
  misc_feature: Ceres CLONE 1389686-F
  misc_feature: Encodes the peptide sequence at SEQ ID NO. 20864
  misc_feature (519)..(519): n is a, c, t, g, unknown, or other
  misc_feature (520)..(520): n is a, c, t, g, unknown, or other
  misc_feature (531)..(531): n is a, c, t, g, unknown, or other
ggagctccccgcggtggcggccgctctatacctagtggatcccccgggctgcaggaattcgcacgagaccattacctagaacatcctaatcgaaaacgtgtttctaactccggtggctccaccaccagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcaggttgatattaaggctctgcacaagaacctagctgccagagaattgctataccaacaccagcataacaaaaggatgagctgccctgccatggaacagctccctctcccataccctgtactacaagcgttcttcccatataacgcctttcatgtgctcggggggcttgacagnnagggaaaaggntggggtttcccctatgaggcagaagttcctacgaaagaaactggtaaagggcccagggaactggttctactttgatttaggccgccctgggaaacaaaaaaaaaccccaggcccttttggcccctgccgggatggtgccccccttggccggggggaggcccccctttaattaaggggtgggtttcctccgcccgggaaaaaccttca

SEQ ID NO: 20864 - protein, 147 aa, Zea mays
  misc_feature: Ceres CLONE 1389686-F
  misc_feature (10)..(146): Pfam Name: Proteasome Pfam Description: Proteasome A-type and B-type
  misc_feature: SWISSPROT Homolog: EC 3.4.25.1 Proteasome endopeptidase complex
  misc_feature (119)..(119): Xaa is any aa, unknown, or other
  misc_feature (120)..(120): Xaa is any aa, unknown, or other
MSRRGDWVYENNGGTCVAIAGADYCVVAADTRLSVGYSILTRDHSKICDLADKCVLASSGFQVDIKALHKNLAARELLYQHQHNKRMSCPAMEQLPLPYPVLQAFFPYNAFHVLGGLDXXGKGWGFPYEAEVPTKETGKGPRELVLL

SEQ ID NO: 20865 - DNA, 672 bp, Zea mays
  misc_feature: Ceres CLONE 1389687-F
  misc_feature: Encodes the peptide sequence at SEQ ID NO. 20866
  misc_feature (533)..(533): n is a, c, t, g, unknown, or other
  misc_feature (546)..(546): n is a, c, t, g, unknown, or other
  misc_feature (547)..(547): n is a, c, t, g, unknown, or other
  misc_feature (611)..(611): n is a, c, t, g, unknown, or other
  misc_feature (654)..(654): n is a, c, t, g, unknown, or other
aagctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcgggcgcgggctggacctgacgctggaccgcacgtccggctccgggttccagtccaagagcgagtacctgggttcgcagatcgacatgcagatcaagctggtgccagcaactccgtggcacggtcacaccttctacctgtcgtccagggcgacgcgcacgacgagatcgacttncgagtcctgggcnnacgtgagcggggagccctacacgctgcacaccaacgtggtcacgcgcggacagggccagcgggnagcagcagttcccggcctctgggtcgacccctacactggcttncaacacctactccatccg

SEQ ID NO: 20866 - protein, 149 aa, Zea mays
  misc_feature: Ceres CLONE 1389687-F
  misc_feature (27)..(142): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature (103)..(103): Xaa is any aa, unknown, or other
  misc_feature (108)..(108): Xaa is any aa, unknown, or other
  misc_feature (129)..(129): Xaa is any aa, unknown, or other
  misc_feature (143)..(143): Xaa is any aa, unknown, or other
MRSFAPVFLSAVVAWLELAGTAQGGNFYQDTEMTWGDGRGKVVDGGRGLDLTLDRTSGSGFQSKSEYLGSQIDMQIKLVPATPWHGHTFYLSSRATRTTRSTXESWAXVSGEPYTLHTNVVTRGQGQRXAAVPGLWVDPYTGXQHLLHP

SEQ ID NO: 20867 - DNA, 738 bp, Zea mays
  misc_feature: Ceres CLONE 1389690-F
  misc_feature: Encodes the peptide sequence at SEQ ID NO. 20868
  misc_feature (456)..(456): n is a, c, t, g, unknown, or other
  misc_feature (604)..(604): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaaatttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccgganacttccttacggaccgtccttcgaccaaggtccacgctgctcctggcggtggctcttccctgggatacctgtttggtgggcactgatgccgctcaccaagctatcaccccccactgtcgccgcatgctttttctgaatcgtgaacagncgttgtcatttcatgtgtancccaacctccccgtccgcgtgggcccgtaagctgcgcctagatttcagggctaatcgtgtgcctggaacctcatcataagtcgtctctgtaccagctcctcgtttcgttgcacc

SEQ ID NO: 20868 - protein, 106 aa, Zea mays
  misc_feature: Ceres CLONE 1389690-F
  misc_feature (79)..(79): Xaa is any aa, unknown, or other
MSRGGSAGGGQSSLGYLFGSGEPPKPAVAPAVSAPPAAAGAPPAEKPPAAKPDGTSQIAAGVTSQTNNYHRADGQNTGXFLTDRPSTKVHAAPGGGSSLGYLFGGH

SEQ ID NO: 20869 - DNA, 722 bp, Zea mays
  misc_feature: Ceres CLONE 1389691-F
  misc_feature: Encodes the peptide sequence at SEQ ID NO. 20870
  misc_feature (444)..(444): n is a, c, t, g, unknown, or other
  misc_feature (529)..(529): n is a, c, t, g, unknown, or other
aaagctggagctccccgcggtggcggccgctctataactagtggatcccccgggctgcaggaattcgcacgagaccattacctagaacatcctaatcgaaaaattatacgcgccaccacacgcatcgcgtccgcctcccaccacctcgccattctccccctcccgcgccccgagaagcgctgcgggcctcacctgcccgtcctcctgcctctcaggaaccgcggttcaggaaggaagggaaggcaagtgcctgccggggctcagcaccgatggcgtacagggcggaggacgactacgactacctcttcaaggtcgttctcatcggcgactctggcgtcggcaaatccaacctgctctccaggttcacgcgcaacgagttcagcctagagtccaagtccaccatcggggtcgagtttgctaccaggagcatcagggtcgacgacnaggtcgtcaaggcccagatctgggacactgctggcccagagaggtatcgggcaattacaagtgcgtactatagaggggctggtgnagcacttgtcgtgtatgatgtgacacgccatgtgacctttgagaatggttgagaggtgttaaaggagctcccggatcacactgatgcaaactttgtcatcatgcgtggtggcaacaagctgatctgcgaacccttaaagctggatccgggaaggatgccaggcctttcccaaaaggaaaagcctttcctccgg

SEQ ID NO: 20870 - protein, 103 aa, Zea mays
  misc_feature: Ceres CLONE 1389691-F
  misc_feature (14)..(104): Pfam Name: Ras Pfam Description: Ras family
  misc_feature (59)..(59): Xaa is any aa, unknown, or other
  misc_feature (87)..(87): Xaa is any aa, unknown, or other
MAYRAEDDYDYLFKVVLIGDSGVGKSNLLSRFTRNEFSLESKSTIGVEFATRSIRVDDXVVKAQIWDTAGPERYRAITSAYYRGAGXALVVYDVTRHVTFENG

SEQ ID NO: 20871 - DNA, 716 bp, Zea mays
  misc_feature: Ceres CLONE 1389692-F
  misc_feature: Translation starting site: 172
  misc_feature (373)..(373): n is a, c, t, g, unknown, or other
  misc_feature (565)..(565): n is a, c, t, g, unknown, or other
  misc_feature (616)..(616): n is a, c, t, g, unknown, or other
  misc_feature (656)..(656): n is a, c, t, g, unknown, or other
cgctctagaactagtggatcccccgggctgcaggaattcgcacgagaccattacctagaacatcataatcgaaaaacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccanagggaaggaatgttgttttggagagcaagtatggttctcctaaaattgttaacgatggtgttacagttgccagagaggttgagctggaggaccctgtggagaacattggtgctaaattggtcaggcaagcagcagctaaagaccaatgatctagctggagatgggacaaccacctctgtggtccttgctcangggctgatcgctgagggtgttaaggttgtggcagctggtgctaatcctggntcagatactcgtggtatcgagaaaacagcgaaagcactangtgagaaactacggaaagtgtctaaggaggtcgaagatagtgagcttgcagaatgtgctg

SEQ ID NO: 20872 - DNA, 718 bp, Zea mays
  misc_feature: Ceres CLONE 1389694-F
  misc_feature (525)..(525): n is a, c, t, g, unknown, or other
  misc_feature (657)..(657): n is a, c, t, g, unknown, or other
  misc_feature (692)..(692): n is a, c, t, g, unknown, or other
aaagctggagctccccgcggtggcggccgctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtcggcctcggcacctgcgtctacctctggtccgcgtncaaatagcagggtcaccagctctgcgatttgggggctagggacagcgtatgcgcagtgcattggtcacgggaaggctcttaatctttcattggcaccggccttggagatgtccagatttgggataggtctcngtgtaagcggattagaatatgggaggccccaaacnaggactggggtatagcatggagctct

SEQ ID NO: 20873 - DNA, 720 bp, Zea mays
  misc_feature: Ceres CLONE 1389695-F
  misc_feature: Encodes the peptide sequence at SEQ ID NO. 20874
  misc_feature (455)..(455): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (464)..(464): n is a, c, t, g, unknown, or other
  misc_feature (470)..(470): n is a, c, t, g, unknown, or other
  misc_feature (471)..(471): n is a, c, t, g, unknown, or other
  misc_feature (488)..(488): n is a, c, t, g, unknown, or other
  misc_feature (490)..(490): n is a, c, t, g, unknown, or other
aagctggagctccccgcggtggcggccgctctattaatagtggatcccccgggctgcaggaattcgcacgagaccattacctagaacatcctaatcgaaaattttacacgcccccttctctctcgatttctcgcggagcggccctccacctttatcgccgccgccgccgttgctgtgttccgtctcttcgccgatggcttcggccaagttcggtgctgcccagcaggtggagaaccgaggcgcgctgtccaaaaggtcacgtaacgacgtgtctgtaagggagggggactggaattgtcctcagtgtggtaatgtcaacttcagttttagaaatgtttgcaaccgtggagcctgtggtgcaccccgtccatcaccgagtccaagtccaagaatgatgtcaggacctcctgcttctggatatgaccggtcacctcattttacgggagggaggtggngnnnncccncctccnnttccgcttggaactggnanctatggtgctccatatccccaccttgggatgcgatatggctatggtcccaccagaaggacctcctgggtcatacggtcttttctcttcataaggtccccctgggccaatggaggggttggggaatatgggccaggacctggagctaggccgcatttaagttttgggtttaagaggttctccaaaggccccgtttcaaacccaggggccggggggaaaaattggtcgtaaa

SEQ ID NO: 20874 - protein, 147 aa, Zea mays
  misc_feature: Ceres CLONE 1389695-F
  misc_feature (29)..(60): Pfam Name: zf-RanBP Pfam Description: Zn-finger in Ran binding protein and others
  misc_feature (88)..(88): Xaa is any aa, unknown, or other
  misc_feature (89)..(89): Xaa is any aa, unknown, or other
  misc_feature (91)..(91): Xaa is any aa, unknown, or other
  misc_feature (93)..(93): Xaa is any aa, unknown, or other
  misc_feature (99)..(99): Xaa is any aa, unknown, or other
MASAKFGAAQQVENRGALSKRSRNDVSVREGDWNCPQCGNVNFSFRNVCNRGACGAPRPSPSPSPRMMSGPPASGYDRSPHFTGGRWXXPXSXSAWNWXLWCSISPPWDAIWLWSHQKDLLGHTVFSLHKVPLGQWRGWGIWARTWS

SEQ ID NO: 20875 - DNA, 736 bp, Zea mays
  misc_feature: Ceres CLONE 1389697-F
aaagctggagctccccgcggtggcggccgctctataactagtggatcccccgggctgcaggaattcgcacgagaccattacctagaacatcctaatcgaaaaaccagtactagcagtggcgcaaaaacttttttattacaacttcccggcaggacccgtttcgttcggtccaagtctccaacccctagcagcccacccacatacaattccgtttgcccgggtcctctcctcgcccgcgaccgccgtttgactcccggacccgacccactcccaccaatcggaggcaaagatcgcgtgaaatcccgggtctcgcgcgcccatttcagccggacgctgaccaagacaaccccggcgatccccacacccgcacacacaaagacgcagaccacacaacggctcggcaagcggcagcaagcccagaccagagcgaaaacccaccgttccagcacccgattttgaaccaccgcgacactcccaagtcccacccaaatctacgacccctccgaccgaaacgagatctccgcctcccctcacggaaaggaaagaaacgctctccccccgggagaaaggggaaccgtcgccgcgtcgcggaaaactgaagcggggcacaggaggaggagaaccccgagccaggaaaagggtcccgggggcgatggagcggaccaccccctccgaggggaacgaactcttccggggcccaatgaacaacccgaggtagggagggccgggggcccaa

SEQ ID NO: 20876 - DNA, 711 bp, Zea mays
  misc_feature: Ceres CLONE 1389698-F
  misc_feature: Encodes the peptide sequence at SEQ ID NO. 20877
  misc_feature (418)..(418): n is a, c, t, g, unknown, or other
  misc_feature (462)..(462): n is a, c, t, g, unknown, or other
  misc_feature (654)..(654): n is a, c, t, g, unknown, or other
  misc_feature (660)..(660): n is a, c, t, g, unknown, or other
aagctggagctccccgcggtggcggccgctctagaactagtggatcccccgggctgcaggaattcgcacgagaccattacctagaacatcctaatcgaaaaggagtacgcacctatcagtcccaagttcccgccacacacctctccattcccctcccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctcgcgctcatcaagcagatgttncggcgctggcgcggagaaggttaagctggagaaacagacatggnaaatcgatactggaaacaagacatttgagatagaattggcgatgttgtcaagtgctcaccatgtggagatgacccccagtgatgctggctttcaggacaagtatggtggtcaggaggtcatcaaagagatggcgaagaacagggccattgatgccaagggcagagagcatttaaagtccttgtgtaaatganggcgancagctctcacgagaagcccagcattccctcccgcagactatggaaaagtat

SEQ ID NO: 20877 - protein, 66 aa, Zea mays
  misc_feature: Ceres CLONE 1389698-F
  misc_feature (59)..(59): Xaa is any aa, unknown, or other
MLWVDKYRPKTLDKVTVHDQVAQNLRKFVSEQDCPHLLFYGPSGSGKKTLILALIKQMXRRWRGEG

SEQ ID NO: 20878 - DNA, 705 bp, Zea mays
  misc_feature: Ceres CLONE 1389701-F
  misc_feature: Encodes the peptide sequence at SEQ ID NO. 20879
  misc_feature (486)..(486): n is a, c, t, g, unknown, or other
  misc_feature (496)..(496): n is a, c, t, g, unknown, or other
  misc_feature (544)..(544): n is a, c, t, g, unknown, or other
aaactggagctccccgcggtggcggccgctctagaactagtggatcccccgggctgcaggaattcgcacgagaccattacctagaacatcctaatcgaaaaactcactgctcgttgccggctgcccccgcggccccggccagtccatcccctcgctcgctccccaactccagcaggcagatcagatacatccatccattcgcggaccggaaggaaaggaaagggttgaactatgagcgccgtggcggtttcgtcgtcgctgaacccggacgcgccgctcttcatcccggcggcgctgctgcaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgacagctcgagcaggggcccccgtcgccgncgcccttaangacagattcggtgctcaaggcgctgaacatgacctccccgaagggcgncggcgacgccccgcgggggttccgggagaaacccaggaacgccgagagccgaccaaggacgccggcagcccccagagcaacgcttcgcgcgtgatccaccagcctcgctagggcccgtgggggaactcctcaagaaggctggtgcccctctgggagcctta

SEQ ID NO: 20879 - protein, 87 aa, Zea mays
  misc_feature: Ceres CLONE 1389701-F
MSAVAVSSSLNPDAPLFIPAALLQVEDFSPQWWDLITTTAWFRDHWSRERAHLDEMAEQIDAAGLLPDDEDLFYDDSSSRGPRRRRP

SEQ ID NO: 20880 - DNA, 699 bp, Zea mays
  misc_feature: Ceres CLONE 1389703-F
  misc_feature: Encodes the peptide sequence at SEQ ID NO. 20881
  misc_feature (559)..(559): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (603)..(603): n is a, c, t, g, unknown, or other
  misc_feature (604)..(604): n is a, c, t, g, unknown, or other
  misc_feature (617)..(617): n is a, c, t, g, unknown, or other
aagctggagctccccgcggtggcggccgctctagatatagtggatcccccgggctgcaggaattcgcacgagaccattacctagaacatcctaatcgaaaaccgctcgttccaacatcacaaactccacacggctctcctgtctccgctgcccgctccacctccctccatgccgtcggcttccctccgcctcgccgtcgtcggcgcgggcgcggcgggcctggttgccgcccgcgagctacgccgcgagggccatgcgcccgtcgtcttcgagcgcgccgccgccgttgggggcacttggctctacacgcctcccgccacgtcctccgacccgctcggcgccgcggcgacgcattccagcctctacgcatcgctccgcaccaacctgccacgcgagaccatgggcttcctcgacttccccttcgccgctggcgccgcgggctcccgagacccccgccggtttcccgggcacgaggaggtgctccgctacctggagggcgtcgcgcgccggttcgacctgctccggctcgtccgcttcgagaacggagtgctcagtgtgnagaggaagacgnnnaggagtgggctgtgacgtcgagaagctcgnngataggggagcgncgaagaggagtctatgatggcgtcgtggtctgcaatgtcacaacacgagccacgctcgccgtcatcccgtttgaggatgata

SEQ ID NO: 20881 - protein, 139 aa, Zea mays
  misc_feature: Ceres CLONE 1389703-F
  misc_feature: SWISSPROT Homolog: EC 1.14.13.8 Flavin-containing monooxygenase
  misc_feature (131)..(131): Xaa is any aa, unknown, or other
  misc_feature (135)..(135): Xaa is any aa, unknown, or other
MPSASLRLAVVGAGAAGLVAARELRREGHAPVVFERAAAVGGTWLYTPPATSSDPLGAAATHSSLYASLRTNLPRETMGFLDFPFAAGAAGSRDPRRFPGHEEVLRYLEGVARRFDLLRLVRFENGVLSVXRKTXRSGL

SEQ ID NO: 20882 - DNA, 733 bp, Zea mays
  misc_feature: Ceres CLONE 1389704-F
  misc_feature: Translation starting site: 249
  misc_feature: Pfam Name: HMG_CoA_synt_N Pfam Description: Hydroxymethylglutaryl-coenzyme A synthase N terminal
  misc_feature: SWISSPROT Homolog: EC 2.3.3.10 Hydroxymethylglutaryl-CoA synthase
  misc_feature (385)..(385): n is a, c, t, g, unknown, or other
  misc_feature (467)..(467): n is a, c, t, g, unknown, or other
  misc_feature (468)..(468): n is a, c, t, g, unknown, or other
  misc_feature (486)..(486): n is a, c, t, g, unknown, or other
  misc_feature (677)..(677): n is a, c, t, g, unknown, or other
aagctggagctccccgcggtggcggccgctctagaactagtggatcccccgggctgcaggaattcgcacgagaccattacctagaacatcctaatcgaaaaacgccctgccagagtccgacgcacgcctagggctcctggacacagcagagcccacgccttgactcgctccgttcgagtggagcgcacaggcaccggccggcgaccagagagggagcggatcgagggggctcggcttgagtggaggagatggaccgcaaggatgtcgggatcctcgccatggacatctacttcccgccctcctgcgtgcagcagaaagcacttgaggcccatgatggggcgagcaaaggcaagtacaccattgggcttgggcaagattgcatggncttttgcagcgaggtggaggatgtcatctcaatgagtttgacgggtgtcaattctctgctgaaaaaatacagattgatcccnnagctattggtcgcttggnagtgggaaagtgaacagttatagacaaaagcaaatccatcaaaacttggctgatgcagattttttgaggaggtggatatactgacattgaagggtgtgactccagcatgcatggtatggggggacaggcaccctactgaattgtgggattggggcccaaggtactcctgggatggccttatgggcttgtcntttgaccgaacgcgcggtttatggggaggaccactcctccacagggagtgctggtg

SEQ ID NO: 20883 - DNA, 736 bp, Zea mays
  misc_feature: Ceres CLONE 1389708-F
  misc_feature: Encodes the peptide sequence at SEQ ID NO. 20884
  misc_feature (395)..(395): n is a, c, t, g, unknown, or other
  misc_feature (417)..(417): n is a, c, t, g, unknown, or other
  misc_feature (523)..(523): n is a, c, t, g, unknown, or other
  misc_feature (639)..(639): n is a, c, t, g, unknown, or other
agagctggagctccccgcggtggcggccgctctagaactagtggatcccccgggctgcaggaattcgcacgagaccattacctagaacatcctaatcgaaaaccatccatccatccagttagttagttagtaagttagttgagggagaagaagcaggggaggggaagcgatgagcaacatgctgcgggctcgccgccgcctggacctcctgcaggtggtgctcttcgccgctgtgctcctcgtcgtcgtcgccgacgccggcgtgacgagccagtaccggcggaagctggaggcgacggtggagatgccactggacgccgacgtcttccgcgtcccgcccggggtacatgccccgcagcaggtgcacatcacgctgggtgaccaggagggcacgncgatgatcgtgtcgtgggtgancgccaatgagctgggcagcagcaccgtcatgtacagcgaggcgtcgccggacccggagaagatggagctccgggcggagggcacccacacgcgctacgactacttncactacaccctccggcttcatcccacactgcaccctcacaaaccctcagcatagcacccagtactactacggcatggggttcggccacacggtgaggagcttctgcgttcacacgncacccatggcgggccctgacgggcccttcaagttcggcctcattggcgacctgggccagacgttggactccacacgacgctgtcgcactacgagggg

SEQ ID NO: 20884 - protein, 135 aa, Zea mays
  misc_feature: Ceres CLONE 1389708-F
  misc_feature: SWISSPROT Homolog: EC 3.1.3.2 Acid phosphatase
  misc_feature (76)..(76): Xaa is any aa, unknown, or other
  misc_feature (83)..(83): Xaa is any aa, unknown, or other
  misc_feature (118)..(118): Xaa is any aa, unknown, or other
MSNMLRARRRLDLLQVVLFAAVLLVVVADAGVTSQYRRKLEATVEMPLDADVFRVPPGVHAPQQVHITLGDQEGTXMIVSWVXANELGSSTVMYSEASPDPEKMELRAEGTHTRYDYXHYTLRLHPTLHPHKPSA

SEQ ID NO: 20885 - DNA, 726 bp, Zea mays
  misc_feature: Ceres CLONE 1389714-F
  misc_feature: Encodes the peptide sequence at SEQ ID NO. 20886
  misc_feature (379)..(379): n is a, c, t, g, unknown, or other
  misc_feature (381)..(381): n is a, c, t, g, unknown, or other
  misc_feature (415)..(415): n is a, c, t, g, unknown, or other
aagctggagctccccgcggtggcggccgctctagaatagtggatcccccgggctgcaggaattcgcacgagaccattacctagaacatcctaatcgaaaaacccttccctcggtcccttccatctcctagccgccgccgccgccgccgctgcccaaaaccctacctaccctcttcttcccctcactctcctttcatctccattctaatggcggcccaacccgtccggcgaagctgctagtgcttgtatctactatcttcatcaggtacttcgcgatcctactgaagtattccccgccgccgctgccatggccacccctcaccctttcgaactccttggcgccgacgacaacgacgacccgacgcagctgattgcggcgncnggcggctgctgctcaaaaagccgagacgaaaaantccgccgtggcggctgctgggaaggctgcccagccctgcgggacaccaaggttcccgaccaagccggctccctccctcgagacggttccggatgcacccgagggtggctcatcagctcggggaggcttttgcccgtggggaacgtgcccgtgtcagaggggggacgggaatatgcccagacccggggtttcgggggggacatgggcaatgacttccggggaggttatggggggcggagcctatggggaatgggcgcttaaattggcggctctgaaaggaaaaagggaaaaaaacccctcgccccccggacg

SEQ ID NO: 20886 - protein, 122 aa, Zea mays
  misc_feature: Ceres CLONE 1389714-F
  misc_feature (25)..(25): Xaa is any aa, unknown, or other
  misc_feature (37)..(37): Xaa is any aa, unknown, or other
MATPHPFELLGADDNDDPTQLIAAXGGCCSKSRDEKXRRGGCWEGCPALRDTKVPDQAGSLPRDGSGCTRGWLISSGRLLPVGNVPVSEGGREYAQTRGFGGDMGNDFRGGYGGRSLWGMGA

SEQ ID NO: 20887 - DNA, 741 bp, Zea mays
  misc_feature: Ceres CLONE 1389715-F
  misc_feature: Encodes the peptide sequence at SEQ ID NO. 20888
  misc_feature (394)..(394): n is a, c, t, g, unknown, or other
agagctggagctccccgcggtggcggccgctctagaactagtggatcccccgggctgcaggaattcgcacgagaccattacctagaacatcctaatcgaaaaactctgcaaagcgcgcgaccggacggcccggttcgttctcgacctctcgtctcgctcatccgcccgcccccgaggaagtaaccctagcctagccttgctccgaccggtcgccgcggcgactgcgacgatgatggactgcgctggaggccgagaccccgtggaggacttcctcctcggcggcgccggcgccggcgacgacggagatctcgtcgccgtcttctgcgacgacggaggacttgggatggagggtaatccatggagatgcttgtggatttgagcaatctaatttggngaaaaggggtagagatgaaccatgttcatctgggccaaacatccaaggctggccgtgaaaaaatgaggagggaccagctggttggcagggtccctggaattaagttcaattatgaatccctggaaaggaagcaaggtagattaagcaaattttttgggtgatgcccccccggatggtggcccaactttagggggtggggcaaaaaagtttaagggatccaatgggaaagttgggggaaaatattccgggggttctggaggggggaaaaaaacccgccccccccggagaaaaaaaagggggactcttaaggggtaaaaaagggtttgggtgtgggaagcaaccaagct

SEQ ID NO: 20888 - protein, 49 aa, Zea mays
  misc_feature: Ceres CLONE 1389715-F
MMDCAGGRDPVEDFLLGGAGAGDDGDLVAVFCDDGGLGMEGNPWRCLWI

SEQ ID NO: 20889 - DNA, 746 bp, Zea mays
  misc_feature: Ceres CLONE 1389717-F
  misc_feature: Encodes the peptide sequence at SEQ ID NO. 20890
  misc_feature (357)..(357): n is a, c, t, g, unknown, or other
  misc_feature (427)..(427): n is a, c, t, g, unknown, or other
  misc_feature (521)..(521): n is a, c, t, g, unknown, or other
aaagctggagctccccgcggtggcggccgctctagaactagtggatcccccgggctgcaggaattcgcacgagaccattacctagaacaatctaatcgaaaatttcttctctcgttcacctcgcgtgcgcgaaccaactagggcgaccgctgccgccctacggcctacgcccagctgctcaggtcttattcgggcctttggcggcgagaaccgaccgcgccaggataatggctcaccgtggacacctagatggactgactgcccaagctccagcactgatgcgccatggttccttcgctgcaggcagcctttctagccactcacctttggagtcttcatctacactggagatgctgnagaaacagcttgccatgcaaactgcagaagtggaaaagcttatcatggagaatcagcggttagcatcaangcatggtgtctttgagcaggacatttgtgatacagagaaagagatgcaaataatccgcactcacctaggtgaagttcagacagagactgatttngcatatagagatttatgggagaggattagattagtggaggcagacatacatagtgggttgatgcgtgaaaaaggagcttcatcaggtgcatatggaggcaaagagacttattactggaaggcagatgctgaccctggagacagaggttgtgactaaggaatacggaaactctctgcctctggtgacagaaaaaccttcctgattgctagctgagctagatgggct

SEQ ID NO: 20890 - protein, 149 aa, Zea mays
  misc_feature: Ceres CLONE 1389717-F
  misc_feature (44)..(44): Xaa is any aa, unknown, or other
  misc_feature (67)..(67): Xaa is any aa, unknown, or other
  misc_feature (98)..(98): Xaa is any aa, unknown, or other
MAHRGHLDGLTAQAPALMRHGSFAAGSLSSHSPLESSSTLEMLXKQLAMQTAEVEKLIMENQRLASXHGVFEQDICDTEKEMQIIRTHLGEVQTETDXAYRDLWERIRLVEADIHSGLMREKGASSGAYGGKETYYWKADADPGDRGCD

SEQ ID NO: 20891 - DNA, 749 bp, Zea mays
  misc_feature: Ceres CLONE 1389722-F
  misc_feature: Translation starting site: 317
  misc_feature: Pfam Name: MIT Pfam Description: MIT (microtubule interacting and transport) domain
  misc_feature (506)..(506): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (572)..(572): n is a, c, t, g, unknown, or other
  misc_feature (573)..(573): n is a, c, t, g, unknown, or other
  misc_feature (577)..(577): n is a, c, t, g, unknown, or other
  misc_feature (580)..(580): n is a, c, t, g, unknown, or other
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaattttcccctcctccctcctcggctcgtctctgttcccctttccctcctgcgcaccccgtcttctcctccccgcgtcaaaccccagcacaaaaagcaaccgcccgccgcctcctcgctcctctcccgaatcagccgtcgcggtgcctaatccggccgaccccccctccgatccgcgggtgcccgccgcagaggcggcgcctccgggcctcccccgatgtatagcaacttcaaggagcaggcgatcgagtacgtcaagcaggcagtccaggaggacaatgccggcaactacgtcaaggcgttccctctctacatgaacgcgctcgagtacttcaaacccacctcaagtacgagaagaaccccaagatcaaggaggccatcaccgccaagttcaccgagtactccgncgccgcgaagagaatccgggcggtcctcgatggggggcggcgcagggctggnnnnccaacggtggnnaacncanctgtcgccacgcgccccaagaccaggggcaaagatgggggacggangccacccggaggggatgactcccgagcagtccaaggctgagggccggggctcaactccgccatcatcaccgagaagcccacattaaagtggaaccgacgttgcccggcctcgagaacggcagc

SEQ ID NO: 20892 - DNA, 747 bp, Zea mays
  misc_feature: Ceres CLONE 1389723-F
  misc_feature: Encodes the peptide sequence at SEQ ID NO. 20893
  misc_feature (1)..(1): n is a, c, t, g, unknown, or other
  misc_feature (484)..(484): n is a, c, t, g, unknown, or other
  misc_feature (516)..(516): n is a, c, t, g, unknown, or other
  misc_feature (650)..(650): n is a, c, t, g, unknown, or other
  misc_feature (687)..(687): n is a, c, t, g, unknown, or other
naaagctggagctccccgcggtggcggccgctctagaactagtggatcccccgggctgcaggaattcgcacgagaccattacctagaacatcctaatcaaaaaattcgaacggaggtccttttcttctttctcgtctgcttcctccttccctcgtcgtcctcgcgtcgcctccttcggccctccctattaatacctgcctcctcacaaccaggtcctgtcctcggggagccgaatccacacggaccacaccagaggacgcgggggacgccccggattcttcggattccaggatggaactacacagaaatagcactaatggttcctgcctcagtgcatgtgggccactgacagactactacattcctgattacatactgaagccggcctatgaaccggtcactgttgataatgtgccatggttgtcctgtggtagtcttcatcaactctagaagtggtggccacctggggaagcagtctgataanaacataccgtgaacttctcaatgaagcgccangtttttgatctctcagaagagctccctgataagggtctacatagattatacagcaactttgaaagctcaaagtctagtggtgaccatgttgctactcaaattcagaagagcttaaggctaattggttgcttggngggtgacggtacagcaagttggctgcttgggaagtanttagtgacctgaaactatcacatcccactcctgttgctaccgtaccctcttgggactgaa

SEQ ID NO: 20893 - protein, 64 aa, Zea mays
  misc_feature: Ceres CLONE 1389723-F
  misc_feature (4)..(4): Xaa is any aa, unknown, or other
  misc_feature (49)..(49): Xaa is any aa, unknown, or other
  misc_feature (61)..(61): Xaa is any aa, unknown, or other
MKRXVFDLSEELPDKGLHRLYSNFESSKSSGDHVATQIQKSLRLIGCLXGDGTASWLLGKXLVT

SEQ ID NO: 20894 - DNA, 733 bp, Zea mays
  misc_feature: Ceres CLONE 1389724-F
  misc_feature: Encodes the peptide sequence at SEQ ID NO. 20895
  misc_feature (409)..(409): n is a, c, t, g, unknown, or other
  misc_feature (410)..(410): n is a, c, t, g, unknown, or other
  misc_feature (433)..(433): n is a, c, t, g, unknown, or other
  misc_feature (451)..(451): n is a, c, t, g, unknown, or other
  misc_feature (458)..(458): n is a, c, t, g, unknown, or other
  misc_feature (462)..(462): n is a, c, t, g, unknown, or other
  misc_feature (464)..(464): n is a, c, t, g, unknown, or other
  misc_feature (465)..(465): n is a, c, t, g, unknown, or other
  misc_feature (471)..(471): n is a, c, t, g, unknown, or other
  misc_feature (472)..(472): n is a, c, t, g, unknown, or other
  misc_feature (566)..(566): n is a, c, t, g, unknown, or other
aaagctggagctccccgcggtggcggccgctctagaactagtggatcccccgggctgcaggaattcgcacgagaccattacctagaacatcctaatcgaaaagcctctgcgtcttccaccctttgccatttgcttgcaatgtctaatacctgagtgagagagcttcctcagtccatggaggtgtcgtcgaggctccaaagcctcctcagacccttcctactctgccgctcccgcgccgcagggatgaccctccaaaccctagctctttctccccgccgcctcctccgcgcatcccatcttccttcctcctccgaacgcgccgtctacctcctccctttccccatggcggcccatcccgtcttcttttcacagcaccttcgcctccgtctccccggccccgcccctgctnncaggagggaccacctcaactccnaggaacagggacccccgnccggccnttgncnntcgcanncgcagaggagctcgcctcggaagacgagtcctactacacgagcaccttctcgagatggcgcaggagacccagccacggtccgtccccgtcaggnaattctttctatgcacagcatcgacctggggagctggagccccagattccctcaatggattccacccaatcggggccaccaaataggtggcttaaaaaccccagtgcaggaaccccggagggttatagcgcggggcaaaaagaaaccttgcccaaatgggcgtttca

SEQ ID NO: 20895 - protein, 41 aa, Zea mays
  misc_feature: Ceres CLONE 1389724-F
  misc_feature (14)..(14): Xaa is any aa, unknown, or other
MAQETQPRSVPVRXFFLCTASTWGAGAPDSLNGFHPIGATK

SEQ ID NO: 20896 - DNA, 748 bp, Zea mays
  misc_feature: Ceres CLONE 1389726-F
  misc_feature: Encodes the peptide sequence at SEQ ID NO. 20897
  misc_feature (590)..(590): n is a, c, t, g, unknown, or other
  misc_feature (592)..(592): n is a, c, t, g, unknown, or other
  misc_feature (593)..(593): n is a, c, t, g, unknown, or other
  misc_feature (650)..(650): n is a, c, t, g, unknown, or other
caaagctggagctccccgcggtggcggccgctctagaactagtggatcccccgggctgcaggaattcgcacgagaccattacctagaacatcctaatcgaaaacttcccctgcacaggctgtcgtccacaatgcccgcgccgctgatactacccacagtcgcgcgcgagctggcagagctcctcgtcgccctctccgccgcccgcgcgctcccaaaaggacagcagctccacggccatctcctcaaggctggacacgtccccgccaccgcctcctcccacgcgctgctcgcgcaccacctccttacgttctacgcgcgctgcgcgctccctgacctctccctccgtgccttccttgacctccccgcgccgccccttcccgctgcatggtcttccctcatctcctccttcgctcagaacggcctcgccgccactgccttcgacactttccgccgcatggctccgccgcgggcgtccctgccaccgaccgctccatcccctttggctgcaaggccgttgccgctgccgagaccttgtcgcgccctccgttctcccctcacgcgctccacgggcttgctggcaagactccgtncnnctggggaaccgtgtttggttggctccggcgattgtcgacatgtatgcccaggtgcgnccactttgcagacgcccgccgggctattcgatgatatgccagaaacggatgggtggtttcttggctgcactcaaaatggggtaatgctggacgcgggt

SEQ ID NO: 20897 - protein, 206 aa, Zea mays
  misc_feature: Ceres CLONE 1389726-F
  misc_feature (154)..(154): Xaa is any aa, unknown, or other
  misc_feature (155)..(155): Xaa is any aa, unknown, or other
  misc_feature (174)..(174): Xaa is any aa, unknown, or other
MPAPLILPTVARELAELLVALSAARALPKGQQLHGHLLKAGHVPATASSHALLAHHLLTFYARCALPDLSLRAFLDLPAPPLPAAWSSLISSFAQNGLAATAFDTFRRMAPPRASLPPTAPSPLAARPLPLPRPCRALRSPLTRSTGLLARLRXXGEPCLVGSGDCRHVCPGAXTLQTPAGLFDDMPETDGWFLGCTQNGVMLDAG

SEQ ID NO: 20898 - DNA, 693 bp, Zea mays
  misc_feature: Ceres CLONE 1389727-F
  misc_feature: Encodes the peptide sequence at SEQ ID NO. 20899
  misc_feature (444)..(444): n is a, c, t, g, unknown, or other
caaagctggagctccccgcggtggcggccgctctagaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacaaggaggaggaggacgaggcgaagggcgcggagaagatgtgcggcatctgctatctcgacggccggcgggccatccgcggcgagctcgactgctgcgcccatttcttttgctttgtctgcatcatggcttggggccgcgtcaagtcccgctgtcccttctgcagggcccgcttccacaccatccgccgcccgcccgtcgccggncggttccccgacgagcgaatcgtctcgatccaagagcgcaaccaggtacaccatcctcagggcaacgggagcagcatagtggggcggagatccttacgtgacacataattgcaccggtttgcagcagcttccagcgatgactagctgctgctactctgcgagctctgcgactcagctgacacacttactggtgtcgggctggggacaccgtgcagaagggggactgggtctgcaaagactgcgggagaa

SEQ ID NO: 20899 - protein, 128 aa, Zea mays
  misc_feature: Ceres CLONE 1389727-F
MAALADIDSSALPPSESSKGKGKMDKEEEDEAKGAEKMCGICYLDGRRAIRGELDCCAHFFCFVCIMAWGRVKSRCPFCRARFHTIRRPPVAGRFPDERIVSIQERNQVHHPQGNGSSIVGRRSLRDT

SEQ ID NO: 20900 - DNA, 715 bp, Zea mays
  misc_feature: Ceres CLONE 1389729-F
  misc_feature: Encodes the peptide sequence at SEQ ID NO. 20901
  misc_feature (344)..(344): n is a, c, t, g, unknown, or other
  misc_feature (385)..(385): n is a, c, t, g, unknown, or other
  misc_feature (386)..(386): n is a, c, t, g, unknown, or other
  misc_feature (388)..(388): n is a, c, t, g, unknown, or other
  misc_feature (391)..(391): n is a, c, t, g, unknown, or other
  misc_feature (397)..(397): n is a, c, t, g, unknown, or other
  misc_feature (407)..(407): n is a, c, t, g, unknown, or other
  misc_feature (422)..(422): n is a, c, t, g, unknown, or other
  misc_feature (448)..(448): n is a, c, t, g, unknown, or other
  misc_feature (481)..(481): n is a, c, t, g, unknown, or other
  misc_feature (500)..(500): n is a, c, t, g, unknown, or other
  misc_feature (613)..(613): n is a, c, t, g, unknown, or other
  misc_feature (692)..(692): n is a, c, t, g, unknown, or other
agagctggagctccccgcggtggcggccgctctagaactagtggatcccccgggctgcaggaattcgcacgagaccattacctagaacatcctaatcaaaacatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggcgccggncgcgaatcggcggcggtgcaatgggtggaggccgccgccgnncnccnaacagncaccagccgncggcggcctaacggnagcggaggggagcaccggcacctggncgcgctcgccggcgccgggcggggcgccctggncaccacccgggccgggggncccagcagcccaaacgggaaagggaaggacgcggaagctggtgaaacaaatggcggggccggtggcgggggcggacgaaggcagggaggacttcttcgactggccccctcggnttgcacgggcgaggaaagcccgaacgggggcgtgcgggggggttccaagggaaagacgggccccgcggcgggattcgangggagtccgcaaggggggtcctg

SEQ ID NO: 20901 - protein, 55 aa, Zea mays
  misc_feature: Ceres CLONE 1389729-F
  misc_feature (22)..(22): Xaa is any aa, unknown, or other
  misc_feature (48)..(48): Xaa is any aa, unknown, or other
MAGPVAGADEGREDFFDWPPRXARARKARTGACGGVPRERRAPRRDSXGVRKGGP

SEQ ID NO: 20902 - DNA, 707 bp, Zea mays
  misc_feature: Ceres CLONE 1389730-F
  misc_feature (167)..(167): n is a, c, t, g, unknown, or other
  misc_feature (398)..(398): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (424)..(424): n is a, c, t, g, unknown, or other
  misc_feature (435)..(435): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcgaaaaattcctcgctcaccaagccaacagccaaatccaattcgccgacgactctctttattcctcccgcntcgccgccgccgccaccgcctgaggggaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtacaccgctgcatcggtctcgacccctgaaccccgnccgcactgctnnncttgattgatttncatcgggtcgntcggggccccctcccgtctgggatctgtgcgcgagagcgccgcagcgcgcgagaattcgccccttcccttctccatagaagcaggaaacnagccgatccgtccctgagcgccccgccgatgggccgcccgggggcctataaactcttggaagggggaaaccccggaaaggcccccccccggggggccaaaaacccccggggggtttgggggggggggaccccccctcgggggggccgccccgtggctttcatcctccccgggggggacgggg

SEQ ID NO: 20903 - DNA, 772 bp, Zea mays
  misc_feature: Ceres CLONE 1389731-F
  misc_feature (255)..(255): n is a, c, t, g, unknown, or other
  misc_feature (257)..(257): n is a, c, t, g, unknown, or other
  misc_feature (317)..(317): n is a, c, t, g, unknown, or other
  misc_feature (359)..(359): n is a, c, t, g, unknown, or other
  misc_feature (360)..(360): n is a, c, t, g, unknown, or other
  misc_feature (717)..(717): n is a, c, t, g, unknown, or other
aaagctggagctccccgcggtggcggccgctctagaactagtggatcccccgggctgcaggaattcgcacgagaccattacctataacatcctaatcgaaaaagaaaatcctggctcgtgcgatgcgacctcttggctctcgctaggttgtatgtgtgtgtgtgtttaaaagcctaatctaccgcaccagcggcctctagtgtctcctcctcctctatccctcgcaaagcaaacacacacgcgtctcttcttcgngntgtccaccaccagcagcaccccgtctccgtcccggaccacgacgcccggcgtgacatgcngaaagacgtagatggcgccaatgccaccgtcgtccgttgaanngagacgctcgtacgaggttccggggcctccccgttcccgccttgcctgcccgctccgggggacgttgaccccctacctaggtctcccctttcgaacctcgccttcttgagggcggccggtcccttttttgccctttattagtgcaacggtcccccgtccccattacccgatttttttgggggagaaaccgggggtttcaacggaatttggggggaaaccccggggagaacaaaaaaaggttccccccgggggtctgggggtccgggggggaattttggatttggggaaaaaaccagccacccttttttttttttttgggcccccccccggggggggagtttgttgcactatgggganccttttttttttggaaaaaatatctacccccttttttttacccccttgctttgtt

SEQ ID NO: 20904 - DNA, 772 bp, Zea mays
  misc_feature: Ceres CLONE 1389735-F
  misc_feature: Translation starting site: 365
  misc_feature (332)..(332): n is a, c, t, g, unknown, or other
  misc_feature (345)..(345): n is a, c, t, g, unknown, or other
  misc_feature (369)..(369): n is a, c, t, g, unknown, or other
  misc_feature (392)..(392): n is a, c, t, g, unknown, or other
  misc_feature (393)..(393): n is a, c, t, g, unknown, or other
  misc_feature (396)..(396): n is a, c, t, g, unknown, or other
  misc_feature (455)..(455): n is a, c, t, g, unknown, or other
aaagctggagctccccgcggtggcggccgctctagaactagtggatcccccgggctgcaggaattcgcacgagaccattacctagaacatcctaatcgaaaagagaaaaagtcagatccgtgttccgtgtccgcgtccagtgtgtccgctactccgctccccctcagtcctcagttcctcacctagcggtagcgtgcgcgcgggagacgtagatggcggcttcggaggcggcagcggcggcggcaacaccggtgacgccgacagaggggacggtgatcgcgatcacagcctggaggagtggagcatccagatcgaggaggcccacagcgccnagaagctggtggntgattgacttcactggcacatggntgtcctcccgtgcgccgcatggnntcnattttttgctgaattggccaagaagcccccaaatgttgttttcctgaaaagtgatgtcnatgaaatgaaaaccattgcttgacaaattcggggaaaaggctgtgcaaatttcctgttcttggagggaggggcacctccagggaaggggtcttttggccccccaagggaaaagtttccagaggagtttgtaactaccggggcccccaaaaaaaagggggggccgcaaaaggatatttcccccaaaaaaaaaggagggccccccccccatttttaaaaaaaatggggttttggggggggggatcttcaggaggggagggccccctgtggggggctccctcttagaaaaaaaaaaccccccgggtaaaaagaggcgcct

SEQ ID NO: 20905 - DNA, 698 bp, Zea mays
  misc_feature: Ceres CLONE 1389740-F
  misc_feature: Encodes the peptide sequence at SEQ ID NO. 20906
aagctggagctccccgcggtggcggccgctctagaactagtggatcccccgggctgcaggaattcgcacgagaccattacctagaacatcctaatcaaaaaactgcctacgatagcagcagcggcaccggccgcataagtaggttgggggggagggctggagtgcgcttcaagcacgagagcgctgttgctgcgtctgaaccgatcccattatttgtttggtttcgttgtacgagcgatctctctcctgggcgggctccggcacgttgtaatattcggtcttctcggcgcagcagcaacttgttcttggtgactgctacttcgctggtctgggccgtttgccgttgctgctgcggacaagtatgggatagtgctggtgggctgggcagttcttgcttcttacactggtagtggtggtctggtctccgtgggagcatttggtctaaaagagcgggagctgtggggctcttctttcgtattcaagatgaagttcatgaaggttggatcgaatccggatacctttcaggacgatgggaaatgaagtcagtattgcggcatctggaatggggagcgacatcactgttcggatagggactacaaagttttacctccaccaggttccgctccctctcaggggtggtcgctttcagaagttgattcaacccctgggggagaaaaatattgggatccccctccctg

SEQ ID NO: 20906 - protein, 56 aa, Zea mays
  misc_feature: Ceres CLONE 1389740-F
MGNEVSIAASGMGSDITVRIGTTKFYLHQVPLPLRGGRFQKLIQPLGEKNIGIPLP

SEQ ID NO: 20907 - DNA, 1710 bp, Zea mays
  misc_feature: Ceres CLONE 1389741
  misc_feature: Encodes the peptide sequence at SEQ ID NO. 20908
accgtctcttctgttctgccctgctcgtgctcgtgcattcacccaccggggcgggcgtctctctcaccgccttgccacgccagcacgccactgtgctctgcctctgctcgactgctcctccatattaagaggccctcccgcgcgcccgcctctcgccgtgctcgtcgtcccttcgttacccgggtcagtgccgccgtcggtagcagaggagcagtaggtggccagtcagtcagccaattgtccgctcgtccactccgttcgagctctcctactcttcaccacccacccatccatccatccatccatcggcgagcgcgagagcacactgttgcattgctgatcgctccgtctccgctgccgacgaggacgaggaagaacgagggagagacgcagacaggctgcgttgcgccatgaggagagcaggggggctatcgcgcgcgggccacggcgcggcgccggcggcgggggtcatgcgggcggcggcgtccgcgttcttcgcggggtaccactgcttcacctccgtggcggcgctgctggcgctgccgttctcggcggcggtgctggtggccgaggcggcggcggcggcgccagcgccggcgccggtggcgctgcgcgcgctagcggcgcggctgcgcgccgtgttcgccgccgcggggttcccgccctcgcccttcttcgcgctgctcgaggccaagctgtcgcagaccgtcttcacgttcgccgccgcgctgccgttcgcgctcaccttcctgctgctcgccaaggcctgcgtcgccgccatgctccgggacgacgccgcgtcgccgaggcggcaccggcggcgcatgtggcccggcgtcgccgcgctcccggcgtgcggggccgtcgcgcgcgcgtacccggccgtgctcgccacgcacgtcctcggcgccttcctcatgctgtccgccaacgcggcggcgttctcgctgctgctgctggcgttcggcgcggccgacctgctggggctcacgtcccgcgcctggacgctggcgctctcggccgcgggcgccgtcgcctactcgctggcggtcggggtcgccgccgtggtctgcaacctcgccgtcgtcgtggccgccacggagcccgggtgcgcgggccacgccgcggtgctcagggcctgcgtcgcgatccggggccgggtgtccacggcgctcgcgctcgcgctgcctaccaacctcggcatggccgccgccgaggcgctcttcggcctccgcgtcgtcgcgcagcgacgcaaggacgggaggctcgcgccggccgtcgccgccgaggccttctccatcgcctacatccacgcggtctgcgtcgtgctggagatcatcgtcgcctgcgtgttctacaggagctgcaagaggagcgaagcggacgagctcagagagctcgagccagaggagaagggagacctccaggcttgatcacctattcacctatcaccttcaggcagctccagtctgctgcatgcacattgcacaagggaagaagaaaggaaaaccccacacacaaatagtagcgccatagtttgtctttctggtgaaaaccaacaggatcagatcatagggtacagagctgatccagagaaatatagtggcaagccgacatagatttctgcaaaatgtttcttttttttatgtaaagcaaattgtaaaagttgagttcaaataatatctgtctattccaaaaaaaaaaaaaaaa

SEQ ID NO: 20908 - protein, 340 aa, Zea mays
  misc_feature: Ceres CLONE 1389741
MRRAGGLSRAGHGAAPAAGVMRAAASAFFAGYHCFTSVAALLALPFSAAVLVAEAAAAAPAPAPVALRALAARLRAVFAAAGFPPSPFFALLEAKLSQTVFTFAAALPFALTFLLLAKACVAAMLRDDAASPRRHRRRMWPGVAALPACGAVARAYPAVLATHVLGAFLMLSANAAAFSLLLLAFGAADLLGLTSRAWTLALSAAGAVAYSLAVGVAAVVCNLAVVVAATEPGCAGHAAVLRACVAIRGRVSTALALALPTNLGMAAAEALFGLRVVAQRRKDGRLAPAVAAEAFSIAYIHAVCVVLEIIVACVFYRSCKRSEADELRELEPEEKGDLQA

SEQ ID NO: 20909 - DNA, 701 bp, Zea mays
  misc_feature: Ceres CLONE 1389744-F
  misc_feature: Encodes the peptide sequence at SEQ ID NO. 20910
  misc_feature (269)..(269): n is a, c, t, g, unknown, or other
  misc_feature (383)..(383): n is a, c, t, g, unknown, or other
  misc_feature (392)..(392): n is a, c, t, g, unknown, or other
  misc_feature (393)..(393): n is a, c, t, g, unknown, or other
  misc_feature (413)..(413): n is a, c, t, g, unknown, or other
  misc_feature (457)..(457): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (548)..(548): n is a, c, t, g, unknown, or other
agagctggagctccccgcggtggcggccgctctagaatagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcgntggggctcaagcgctccgccacgcagaccatcactctgccgccgcccgacacgcggctggctgtgcgcgatgtcatgcgctccacgatcccgtcgcagcccgccgtggcgccgncgtccacgnnagaggcagcgcccgccgcgncgttgcaggggttcctgtgcctggaggaggtggacgggaggcgntggaactacgtggtggacgtggnnnccgcaaggggaaggacagggccgggccgtccccgctggggccgccgtcagggcccggcccctgcantccccgcttccgctggcgaggaaaaatgccattcataagacctatggggggcctgaaggttcccagaaggggtactccttcaaggaccctacatgaccggggggctctaaaccattccttgggggagggggggaggggttaccacaaaacctt

SEQ ID NO: 20910 - protein, 109 aa, Zea mays
  misc_feature: Ceres CLONE 1389744-F
  misc_feature (5)..(5): Xaa is any aa, unknown, or other
  misc_feature (43)..(43): Xaa is any aa, unknown, or other
  misc_feature (46)..(46): Xaa is any aa, unknown, or other
  misc_feature (53)..(53): Xaa is any aa, unknown, or other
  misc_feature (75)..(75): Xaa is any aa, unknown, or other
  misc_feature (76)..(76): Xaa is any aa, unknown, or other
  misc_feature (98)..(98): Xaa is any aa, unknown, or other
MAPAXGLKRSATQTITLPPPDTRLAVRDVMRSTIPSQPAVAPXSTXEAAPAAXLQGFLCLEEVDGRRWNYVVDVXXARGRTGPGRPRWGRRQGPAPAXPASAGEEKCHS

SEQ ID NO: 20911 - DNA, 771 bp, Zea mays
  misc_feature: Ceres CLONE 1389746-F
  misc_feature: Encodes the peptide sequence at SEQ ID NO. 20912
  misc_feature (457)..(457): n is a, c, t, g, unknown, or other
  misc_feature (458)..(458): n is a, c, t, g, unknown, or other
  misc_feature (487)..(487): n is a, c, t, g, unknown, or other
aaagctggagctccccgcggtggcggccgctctagaactagtggatcccccgggctgcaggaattcgcacgagaccattacctagaacatcctaatcaaaaatcgctctctcctttgcacccctagctagctagtactactgctgctcctccgacttgctcttcgcgcagcaggacggagaaacaagaaccatccctccccctaccggctaccgctgctactcatggtcgcgcgcactgcctcctggtgccgccgcgtatgatccagacatgaatagggcgcacagcagcagctccaagctcatcaacgagaagctcgtggaacaccggatctccactgcgaagcactgcccccactgcggcgagaaaatcgacagcaaacccggattggggtggggctgcccggcaggcgtcaaggttcgatccaactggaccagggagctgattcgagcacctcnnaggcgaaaggtgaaggatgaaaggctccnagatctcacccctcttcatcggacgagttcataacccacaatagatggggggaggacgggattatggttaccccccaccccgaagaaaacttcccgggggggggaaaaggggaagggccctaaggaaaggaccttctttccaccgggggcggccaaagggccttaaaccgcccgggccccggggggaaaagggggggaaatatcccggcggggggtggggccctcccccaaaggggggaaaaacaagggggcaaaaaaaaacccggaaaaagaccggggggggg

SEQ ID NO: 20912 - protein, 83 aa, Zea mays
  misc_feature: Ceres CLONE 1389746-F
  misc_feature (63)..(63): Xaa is any aa, unknown, or other
  misc_feature (73)..(73): Xaa is any aa, unknown, or other
MNRAHSSSSKLINEKLVEHRISTAKHCPHCGEKIDSKPGLGWGCPAGVKVRSNWTRELIRAPXRRKVKDERLXDLTPLHRTSS

SEQ ID NO: 20913 - DNA, 744 bp, Zea mays
  misc_feature: Ceres CLONE 1389747-F
  misc_feature: Encodes the peptide sequence at SEQ ID NO. 20914
  misc_feature (570)..(570): n is a, c, t, g, unknown, or other
  misc_feature (581)..(581): n is a, c, t, g, unknown, or other
  misc_feature (592)..(592): n is a, c, t, g, unknown, or other
  misc_feature (593)..(593): n is a, c, t, g, unknown, or other
  misc_feature (662)..(662): n is a, c, t, g, unknown, or other
  misc_feature (664)..(664): n is a, c, t, g, unknown, or other
  misc_feature (744)..(744): n is a, c, t, g, unknown, or other
aaagctggagctccccgcggtggcggccgctctagaactagtggatcccccgggctgcaggaattcgcacgagaccattacctagaacatcctaatcgaaaaatatattcacctgagccaggtcgctgtttcatcatcgtgcttgactgcagtctgcagggggtgtggccgcgctgcagcctgcctgtcaatctcgatcgatcaaggggtggcgtgccgagatggcggaccggccgtcgcttcctgctctcattattgctatcgccgttcttgctggcagttactgccgcgtggcgagctcggcctcgccggcggtggaagatgagctgcgcggtggaggaggagccggcggtccgacgacgatgcggcggcgcgcggcgtcggtgatggtgcccatcaccatcctcaagtccgctgttagcgacggagctgtgtgcatggatggaacgccacctgcttaccacttggatcctggctccggagcgggcagcagaagctggattgtgaacttagaggggaggtgcgtggtgcaacagcgccaagacatgccggctcacccagagctccggncgtggctcgtncgacacatggnncaagagatccccttcaccggcatcatgagcagcagccgtaccgtgaatcctgatttctacatctggaancngggtcaaggtcgctactggtgacggtggatctttttgcggcgaggccttcgacagggacactgggatctacttccgaggn

SEQ ID NO: 20914 - protein, 154 aa, Zea mays
  misc_feature: Ceres CLONE 1389747-F
  misc_feature (117)..(117): Xaa is any aa, unknown, or other
  misc_feature (124)..(124): Xaa is any aa, unknown, or other
  misc_feature (147)..(147): Xaa is any aa, unknown, or other
  misc_feature (148)..(148): Xaa is any aa, unknown, or other
MADRPSLPALIIAIAVLAGSYCRVASSASPAVEDELRGGGGAGGPTTMRRRAASVMVPITILKSAVSDGAVCMDGTPPAYHLDPGSGAGSRSWIVNLEGRCVVQQRQDMPAHPELRXWLVRHMXQEIPFTGIMSSSRTVNPDFYIWXXGQGRYW

SEQ ID NO: 20915 - DNA, 707 bp, Zea mays
  misc_feature: Ceres CLONE 1389748-F
  misc_feature (441)..(441): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcgaaaataaggatgaaagagctgcatctgataagcaacctgaacctgtatctaggcagcataaacatttgaactttcctccgttcactacccagattcacaaaaaagagtgcaacagagaatcctaatgttgtaaatcaggttgatataatgaaatcagttgcaggtggttttagttcgcagttacctcgtgcaccaaaggaaccttctctcctagatgagagatctctattggcttgcattgtacgtgcagttcctgctgggactgagggtggaatcaggataagttcaactctgccaaataggcttgggaaaatgttggctccccttcactggcatgactatnagaagcaatacgggaagctcgacgattttgtggctagtcatccagagctgtttgtgattgagggagacttcattcaccttcgtgatggagcacagcagattatttctgccactacagctgctgcaaaaatagctgctgcgacagcatcttctgcctcttactcatccttactggcttctgggtgcgttactcctgtggcacaaatactcgncaaaagagggagcccgcagttgatttcagatcatcaaatgcaattccctctggaa

SEQ ID NO: 20916 - DNA, 695 bp, Zea mays
  misc_feature: Ceres CLONE 1389749-F
  misc_feature: Encodes the peptide sequence at SEQ ID NO. 20917
  misc_feature (360)..(360): n is a, c, t, g, unknown, or other
aaagctggagctccccgcggtggcggccgctctagaactagtggatcccccgggctgcaggaattcgcacgagaccattacctagaacatcctaaaaaaatcgatcagtcgcgtgtctaggtttcctctctcaccatagcgcccgctctgtcgcccttcgttcacctctccttcctctcgtccctgcctgccagggagaggggaagtcagaggcacgaagtgccgcagagcagacgcccgtgaaccattgtagctgtccctgtcgtcgtcgtcgtccacgaacccacacgagaaaaggatggagaagaacccgaccatcctcatgaacaggtacgagctcggtcgcacgctcaggcaggncaccttcgcccaggtgtacacgggcgtgacctcgcgtctgacgagagcgtgttcatcaggtcatctaccaggaaacgtgatgcgcgtcccatgatcgacagatcagcggaaatcttcggtatggggctcggccgcccccccaaggtatgcaattgcaagaagtgttggccagcaaaagcaaaatatacttccccatggaagtacgtcccgggggggggaaggtttttcccccggttcccccgcggcgggtttaagggaggaaccccggaagaaaggtattccccccacttcgggggggggggcgtctttttttggcccaagggggggggggaaaa

SEQ ID NO: 20917 - protein, 51 aa, Zea mays
  misc_feature: Ceres CLONE 1389749-F
  misc_feature (21)..(21): Xaa is any aa, unknown, or other
MEKNPTILMNRYELGRTLRQXTFAQVYTGVTSRLTRACSSGHLPGNVMRVP

SEQ ID NO: 20918 - DNA, 705 bp, Zea mays
  misc_feature: Ceres CLONE 1389751-F
  misc_feature: Encodes the peptide sequence at SEQ ID NO. 20919
aaagctggagctccccgcggtggcggccgctctagaactagtggatcccccgggctgcaggaattcgcacgagaccattacctaaaacatcctaatcgaaaaaacggacccccattcgcatccgcctccttttccttggagccgaagaagagggaaaggaagggaggacagccgccgccgccgccatcaccaccgtcaggatgcattccacgaacctcctgctcgaggagcccatccggatggcctccatcctcgagccctccaagcccagctacttcccggcgatgaccaagatcgtcggcactctcggccccaagtcgcgttccgtcgacacgatctccgcctgcctcaaggccggcatgtccgtcgcccggttcgatttctcgtggggggacgccgcgtaccaccaggagacgctggagaacctcaagctctccatcaagtccaccaagaagctctgcgctgtcatgctcgacaccgtgggcccggagctgcaggtggtgaacaagagcgagaccccgatctccctcgaggagaatggcacggtcgctctcacccctcagcgggggccagacgcctcctccagcttggctgcccatcacttctctggactcgccaaggcggtgacacaggggcaacaatattcgtgggacaatacttgttcactgcaggagaccacctcagttttgggtgggaaggttctga

SEQ ID NO: 20919 - protein, 168 aa, Zea mays
  misc_feature: Ceres CLONE 1389751-F
  misc_feature (30)..(163): Pfam Name: PK Pfam Description: Pyruvate kinase, barrel domain
  misc_feature: SWISSPROT Homolog: EC 2.7.1.40 Pyruvate kinase
MHSTNLLLEEPIRMASILEPSKPSYFPAMTKIVGTLGPKSRSVDTISACLKAGMSVARFDFSWGDAAYHQETLENLKLSIKSTKKLCAVMLDTVGPELQVVNKSETPISLEENGTVALTPQRGPDASSSLAAHHFSGLAKAVTQGQQYSWDNTCSLQETTSVLGGKVL

SEQ ID NO: 20920 - DNA, 641 bp, Zea mays
  misc_feature: Ceres CLONE 1389752-F
  misc_feature: Encodes the peptide sequence at SEQ ID NO. 20921
aagctggagctccccgcggtggcggccgctctagaactagtggatcccccgggctgcaggaattcgcacgagaccattacctagaacatcctaatcgaaaagttccgcttcgtcccagcctctagttcttcctttcctccagagtgatggacaaatgctactcagattggcccccgattccgcctttccatccatcgcgaagaacgccgccgcaatcccacgcctccccgatcacgatcaggcggaagatcgcgtccttcgtgctccactgctccagatcctgcgctcccctcctcgagcccaagaacctgcccgatgagttcgaggacgaaccggcgacgccgccgccgccgctgccggacgccgccccgaagatgtcgatttctaacaaggtcatccgaggtctctgcgctgacccgcagaccgagcagatggccttcgagggctacaggagggcgctgctgcagcccgagttccgtgtggagaagaagacggccaacgcgctgaccctgcagctgatcaggtagaagcatcgactctccctgcagctgctggtcgaggacttcatgccccacggagtgctcccagagaagcgaacgtgcgcgcgcctcgtcgcctgctgcatcatgccggggaggtta

SEQ ID NO: 20921 - protein, 50 aa, Zea mays
  misc_feature: Ceres CLONE 1389752-F
MSISNKVIRGLCADPQTEQMAFEGYRRALLQPEFRVEKKTANALTLQLIR

SEQ ID NO: 20922 - DNA, 728 bp, Zea mays
  misc_feature: Ceres CLONE 1389755-F
  misc_feature: Translation starting site: 253
  misc_feature: Pfam Name: Peptidase_S10 Pfam Description: Serine carboxypeptidase
  misc_feature: SWISSPROT Homolog: EC 3.4.16.6 Carboxypeptidase D
  misc_feature (395)..(395): n is a, c, t, g, unknown, or other
  misc_feature (428)..(428): n is a, c, t, g, unknown, or other
  misc_feature (448)..(448): n is a, c, t, g, unknown, or other
  misc_feature (464)..(464): n is a, c, t, g, unknown, or other
  misc_feature (527)..(527): n is a, c, t, g, unknown, or other
  misc_feature (653)..(653): n is a, c, t, g, unknown, or other
  misc_feature (655)..(655): n is a, c, t, g, unknown, or other
caaagctggagctccccgcggtggcggccgctctagaactagtggatcccccgggctgcaggaattcgcacgagaccattacctagaacatcctaattgaaaaattggctgtcagtcacttccagtcctggcccactcctccgatgctccaatcatcaacactctctacctgtgtccgtgtgctctgctactctgcaccaccaaccaaccagtgctgccctccgccgatccactgacctaccgcgagcgccaatggcgaccgccgcggtcctggccgccacattagcgctgttcctccgcgccgccgccgcaacggccgcgacggctgcggcggaggcgaaccggatcggcaggctgcctggccagccgccggtcaacttctccatgtactccgnctacgtcacccgtggacgcgggggcggggcggncccctctctactggttcatncgaggcgccggcgtgncccgcggagtccgcgccgctcgtggctgtgctcacgggggggcccgggtgctcctccgtcggntacggggcgtcaaaggagctcggcgcctttcggatcaacgccgacgggaggacgctctacttgaaaccctacccctggaaataagtggggaaacatggttgtcttggactcgccgggccgcggtcngntactcataactcaactcccacctccgatttggaaactgcccggagaaaaaaaacaggccatggctcgtaaaat

SEQ ID NO: 20923 - DNA, 675 bp, Zea mays
  misc_feature: Ceres CLONE 1389756-F
  misc_feature (374)..(374): n is a, c, t, g, unknown, or other
  misc_feature (406)..(406): n is a, c, t, g, unknown, or other
  misc_feature (408)..(408): n is a, c, t, g, unknown, or other
  misc_feature (426)..(426): n is a, c, t, g, unknown, or other
aaagctggagctccccgcggtggcggccgctctagaactagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagaatcgaggcgcagcaatccgagcacgcagctagtaggggaggtatccnagaaaagttgcagattttgctgggggcaacgnancgagaacagttactgcanaaagaaagggcaaggtgggggaggcgccgagatgagggatgctatcagctctgatggataattggaatcttgctcgggccggcatcaccggtgggcgtcccgcaaagatcggatgccaccggccgcaggacggcctctgtgtacaaggacgcggcaggtcgtcaatgggagtcctcatggcggtggcaggccataacttatggagacatagccgggtgatcgggccgttacactcggacctgactgagg

SEQ ID NO: 20924 - DNA, 695 bp, Zea mays
  misc_feature: Ceres CLONE 1389760-F
  misc_feature: Encodes the peptide sequence at SEQ ID NO. 20925
  misc_feature (583)..(583): n is a, c, t, g, unknown, or other
  misc_feature (625)..(625): n is a, c, t, g, unknown, or other
  misc_feature (672)..(672): n is a, c, t, g, unknown, or other
  misc_feature (695)..(695): n is a, c, t, g, unknown, or other
aagctggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgatgccgccaagacatggatggcgattcctgctccaaagcgaggagagatcgttaggcaaatcggtgatgcactgagagcaaagctccatcaccttggcaggcttgtgtcacttgagatggggaaaattcttcctgagggatcggtgagggtcaggaatcatcgacatgtgtgattatgctgtggggctaagtcgccaactaaatggatccattataccatctngacgaccaaccatatgatgatggaggtgtggatccccttggnagtgtgggtgtataacggcatttaatttcccttgggctgggcttggntgaatgcttgcatggctttggcn

SEQ ID NO: 20925 - protein, 124 aa, Zea mays
  misc_feature: Ceres CLONE 1389760-F
  misc_feature: SWISSPROT Homolog: EC 1.2.1.3 Aldehyde dehydrogenase (NAD(+))
MGAFAKEEHQFLAELGLAQRNPGAFACGAWGGSGPTVTSTSPTNNQVIAEVVEASVHDYEEGMRACFDAAKTWMAIPAPKRGEIVRQIGDALRAKLHHLGRLVSLEMGKILPEGSVRVRNHRHV

SEQ ID NO: 20926 - DNA, 739 bp, Zea mays
  misc_feature: Ceres CLONE 1389762-F
  misc_feature: Encodes the peptide sequence at SEQ ID NO. 20927
  misc_feature (85)..(85): n is a, c, t, g, unknown, or other
ggaggggcccccccccccccccctcacccaaaaacacatctgggcccccccccccaaactggcactccccgcgggggcggccgcnctacaatagtggatcccccgggctgcatgtattcgcacgagaccattacctagaacatcctaatcgaaaaatccacgctgcctcggccggcacctacctcccccacttcgccgccggtgggtggagtcgggccggagcagccgctagctcgcctctgttaccccaaaaaagacaaaaaaaataaagagagagtaccaagcaagccgccggcagctcgggcagccatggggcacggcgtcagctgcgctcgcacgggcgacgagcacaactacttccgcgcggcgcaggacggggacctcgacgccctggacgcgctcctcgccgccgacccctccctcgcccgccgcgccacgctctacgaccgtctctccgcgctgcacatcaccgccgccaatggccacctcgaggtgatgcccatgatcttgaatcacggggtaccgccggacgccgtgaaccggaacaagcacaccccgctgatgctcgcggcgatgcacggtaagatcgactgcgcagcggaaactcctgcagagacggtgactaatatccctgattccaacatccctgccacgggcgggaccctgcgctggcaccacggccgtccttacttgcgggccaccttacaagcttgccctgccggggcaccatccccttcgg

SEQ ID NO: 20927 - protein, 143 aa, Zea mays
  misc_feature: Ceres CLONE 1389762-F
  misc_feature (46)..(78): Pfam Name: Ank Pfam Description: Ankyrin repeat
  misc_feature: SWISSPROT Homolog: EC 2.4.2.30 NAD(+) ADP-ribosyltransferase
MGHGVSCARTGDEHNYFRAAQDGDLDALDALLAADPSLARRATLYDRLSALHITAANGHLEVMPMILNHGVPPDAVNRNKHTPLMLAAMHGKIDCAAETPAETVTNIPDSNIPATGGTLRWHHGRPYLRATLQACPAGAPSPS

SEQ ID NO: 20928 - DNA, 737 bp, Zea mays
  misc_feature: Ceres CLONE 1389763-F
  misc_feature (192)..(192): n is a, c, t, g, unknown, or other
  misc_feature (314)..(314): n is a, c, t, g, unknown, or other
  misc_feature (403)..(403): n is a, c, t, g, unknown, or other
aaagctggagctccccgcggtggcggccgctctagaatagtggatcccccgggctgcaggaattcgcacgagaccattacctagaacatcctaatcgaaaaatcatatggcatagccccaagcccccaacggatcgagcgcctccccgagtccccgttcccctgccccagctgaccgccgccgagacgtgtngcacaccgcctccccctccccgcgccacaaccttcgcctccacgcaattggccgcactcctttccaccctccgctacaggatagcgtgggcccggtcgcgccgccgacgggtggagaactgnagatccacccgcacgcggactgcttcctcactagtcatgggaaagtagggcgttgctcagtctcatgatttcttttggtagatccgaanacctaacaacgccaacttccccatccagaagtccctgcaggggcagaggatcgtggcgcccagcgtttacatcctcgtgggcaccctggcgctgcacctggtggtcagatggctccccgcctacggggtgggcctgggcctggtgggggggctacatcgcccctcacattaggtggggggcccttccgcccgtgcagggtgaagaaactcctccacagggcccggaaggaagaccccccggtccgaaatcaccaaccggggacttttcggggcccggaaacttatttgaagtcccgggcgggacccaccaaatggggggcattccaaaatggga

SEQ ID NO: 20929 - DNA, 745 bp, Zea mays
  misc_feature: Ceres CLONE 1389764-F
  misc_feature: Encodes the peptide sequence at SEQ ID NO. 20930
  misc_feature (81)..(81): n is a, c, t, g, unknown, or other
tttttgccccccccccgccccccccccctccaccaccccaaccccccccccaaaatggaactccccgcggaggcggccgcnctacaataatggatcccccgggctgcatttctccccacgagaccattacctagaacatcctaatcaaaaacataaataacacacttagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggaacgcggcgcctcgccctacgacgacgaccgcatccccgacatggcccgcttcgcggacacgctgtcggacacctccccggactcccccccccacagcttcgtgtcctaggaagaacccctcaactccccgcccgcactctgctgaatggttgaacacttgcattaagagacaggctactaacacgcggccccaacgacagaccacaccacccacaccgcccccacgacgaccctgaggcgcacccgccaacagcgcacccaaccccgcacgggtagacaaccccacacctaccgtctactccacaactccaaccaccc

SEQ ID NO: 20930 - protein, 112 aa, Zea mays
  misc_feature: Ceres CLONE 1389764-F
  misc_feature: SWISSPROT Homolog: EC 4.1.2.10 Mandelonitrile lyase
MSGRSRHFTMSTLLATSFFFVLLCSSLQVRGVNYTFVKDAALAPSVSYYDYIIVGGGTAGCPLAATLSERFRVLLLERGASPYDDDRIPDMARFADTLSDTSPDSPPHSFVS

SEQ ID NO: 20931 - DNA, 594 bp, Zea mays
  misc_feature: Ceres CLONE 1389771-F
  misc_feature: Encodes the peptide sequence at SEQ ID NO. 20932
gcggtggcggccgctctagaactagtggatcccccgggctgcaggaattcgcacgagaccattacctagaacatcctaatcgaaaaaattgtaaactgtgatcttccaggctgcaccaactccatctccaggtggaatggagttagcttgcctgcacactcagtcacggtggcgtccctataaggcgtaggcctgacgtcacccacgccctcgcctcgcacggggcggcgcggcggccggcggagggaatggcgaggcgaagcagaggcagcggcagcgtcacggacgcggcgtcgaaggcggacgcggcggcgatgcggatggtgtcccgcaggggcgccgtgcggctggtgctcgtgtcggccaccgcctgggccatgctcgggctcgtcgcgctcgccttccacctccggccatgcagctcccgcgtcgcattcctctcagctctttgcaaaaaagacagtaaaagttctctcctgtggttggaactccaagggggtttctatttccaaaaacctccaccccgggtgcccaaaaaaggggggggggggggagaacacaaaaggggttttggttataaccaacaaaaaagaa

SEQ ID NO: 20932 - protein, 115 aa, Zea mays
  misc_feature: Ceres CLONE 1389771-F
MARRSRGSGSVTDAASKADAAAMRMVSRRGAVRLVLVSATAWAMLGLVALAFHLRPCSSRVAFLSALCKKDSKSSLLWLELQGGFYFQKPPPRVPKKGGGGGEHKRGFGYNQQKR

SEQ ID NO: 20933 - DNA, 770 bp, Zea mays
  misc_feature: Ceres CLONE 1389772-F
  misc_feature (25)..(25): n is a, c, t, g, unknown, or other
  misc_feature (34)..(34): n is a, c, t, g, unknown, or other
  misc_feature (43)..(43): n is a, c, t, g, unknown, or other
  misc_feature (406)..(406): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (501)..(501): n is a, c, t, g, unknown, or other
  misc_feature (518)..(518): n is a, c, t, g, unknown, or other
  misc_feature (519)..(519): n is a, c, t, g, unknown, or other
  misc_feature (533)..(533): n is a, c, t, g, unknown, or other
  misc_feature (534)..(534): n is a, c, t, g, unknown, or other
  misc_feature (540)..(540): n is a, c, t, g, unknown, or other
  misc_feature (547)..(547): n is a, c, t, g, unknown, or other
  misc_feature (549)..(549): n is a, c, t, g, unknown, or other
  misc_feature (597)..(597): n is a, c, t, g, unknown, or other
  misc_feature (602)..(602): n is a, c, t, g, unknown, or other
  misc_feature (603)..(603): n is a, c, t, g, unknown, or other
  misc_feature (606)..(606): n is a, c, t, g, unknown, or other
  misc_feature (634)..(634): n is a, c, t, g, unknown, or other
  misc_feature (651)..(651): n is a, c, t, g, unknown, or other
  misc_feature (658)..(658): n is a, c, t, g, unknown, or other
  misc_feature (693)..(693): n is a, c, t, g, unknown, or other
  misc_feature (696)..(696): n is a, c, t, g, unknown, or other
tgtgggtggggtgtgccccttcccncccccctcnttacatctnatgcacaacccccccccaaactggagctccacgcggtggcggccgctctataatagtggatcccccgggctgcaggaattcgcacgagaccattacctagaacatcctaatcgaaaagtcgttctttctagaacctccgctccgcctaatcccttgaccgggtcaagcccgaacgagactagggaggttccagcgccgccggtgggggagatggcgctggagctgagcctggcctcggattcgccgccggcgggaggggggttggagcagttgtgggtcttcgccccacccggggaaggagcagcaaagggggcgggggggggatttctactgcaaatctccaatgcctcgggattctccttngttcttggggcacnnncctgtgtttggcacccgccttttaaaaaccttccccccaaggtcagggggcttcgctttttaaaattggccttaagctngttggaaggggcctttnnaataaatatttttnnaattanctgtcananaagaaaaaagggaagcgcggggtttacaatttccccctcaacaaagancatanntgnggttggttcctaaataaaactacgccgnaaaaaatttcccaatanaaataantccccgtttaatttggggggagaggattcctcctnaanacccctccggcccacataccacaacttcgccaccaattagcgggaacaaacacggcccccgcggcgcaaccacg

SEQ ID NO: 20934 - DNA, 653 bp, Zea mays
  misc_feature: Ceres CLONE 1389782-F
  misc_feature (470)..(470): n is a, c, t, g, unknown, or other
  misc_feature (508)..(508): n is a, c, t, g, unknown, or other
  misc_feature (514)..(514): n is a, c, t, g, unknown, or other
  misc_feature (556)..(556): n is a, c, t, g, unknown, or other
cgcggtggcggccgctctagaactagtggatcccccgggctgcaggaattcgcacgagaccattacctagaacatcctaatcgaaaaacagtgctgcatagccatacatgcatcgatccctagctctttgcttgccgcggatttctcctgctcatacaacacaagccatgaggggtttccagctgctactcatcatagtggcattgcttgccggggagttgcactgcgcaagagcagcatcagcagcagatgcaccggaggctgcaccacagtcccccgaagcaccaacagcagatgagcaaacgccaccgcaggcgcctgggccaacatcaccacctccacctccacgacgtcggggatcaccacatcgacggccaccagcaccgacggatcagcaggatccagcaccgccaaggttggtcgtgccaccacaggaacctcctgcaccggcaccacctggaatgacgatncaccgcactacgggctgtactacactccttgtacttgnagactncaccgtggaccctggaaaacacaaccatctgccccacacagncaggccaaatttcttgccctacggcttgaactcctaacgtcgccagccgactgtccgattcacaatggccgtttagccacagatatgttacctgaaa

SEQ ID NO: 20935 - DNA, 564 bp, Zea mays
  misc_feature: Ceres CLONE 1389786-F
  misc_feature (227)..(227): n is a, c, t, g, unknown, or other
  misc_feature (232)..(232): n is a, c, t, g, unknown, or other
  misc_feature (233)..(233): n is a, c, t, g, unknown, or other
  misc_feature (269)..(269): n is a, c, t, g, unknown, or other
  misc_feature (276)..(276): n is a, c, t, g, unknown, or other
cgcgggtgggcgggccgcttctaagaactagtggatcccccgggctgcaggaattcgcacgagaccattacctagaacatcctaatcgaaaaaaatagcaatttttccccctgggagcccgagacgcagcgcgaggtgcggccccgtcccctcgccaccggaggagcaggacgacgaggtggcgtcggcgcgaggtagtcgcgcgcctggaagagcggcggcatcgnagtcnncagcggaggcgaaggagtgaggggagagccctatangcaacgncgcggggggtcgtggtcgctgcacgcactcccaccatttggccccactccgagctcaaactcgggttgcggggttgggacgacccctccccttggttcccaggtctctaatggaaaaacggggatgggaaaaaaaggggaaaaaaatttaaaggccggaaacccaaaaaaatccccggaacccccccccccccccggggggttccgaatttttttaaaccccaccctcttccaaaaaaaaaaccctggtgggggggggccccccaaaaaaaaggggaaaaattttctt

SEQ ID NO: 20936 - DNA, 741 bp, Zea mays
  misc_feature: Ceres CLONE 1389798-F
  misc_feature: Encodes the peptide sequence at SEQ ID NO. 20937
ggggggggcccccccccccccccccccgctcctctccccctatgatgcaatttcaaactggagctccccgcggtggcggccgctctagaatagtggatcccccgggctgcaggaattcgcacgagaccattacctagaacatcctaatcgaaaaaaaaaaacgcacggggagcttggagacttcacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccgacgtgcgcgtgctcggcaggggcgccgcgcgcgtgacgccgcgaccgtgggcggctgtcggcggaaggagacgcttctccgtgcggatgtccgccgcgaccaccgaggccaccaccaccatcgccgtgggcgcctcggaggaccaggcgctggaggctaggaactccaagacggtggagggggtcatcctcggcggggggccccacgaccaggcctcttcccgcttaccagacgcagggctcaagcccgcagggcccaattgggcggggagtacagggctccatcgacggggccggatggagcaaccggcataaaaccggcggccgaccaacaaaggggcctaccatcctccaccgcaagtttgaaaccccggcaaatcccctcaaagcgccccccc

SEQ ID NO: 20937 - protein, 117 aa, Zea mays
  misc_feature: Ceres CLONE 1389798-F
MGLRVAATAPAPADVRVLGRGAARVTPRPWAAVGGRRRFSVRMSAATTEATTTIAVGASEDQALEARNSKTVEGVILGGGPHDQASSRLPDAGLKPAGPNWAGSTGLHRRGRMEQPA

SEQ ID NO: 20938 - DNA, 645 bp, Zea mays
  misc_feature: Ceres CLONE 1389801-F
  misc_feature: Encodes the peptide sequence at SEQ ID NO. 20939
  misc_feature (361)..(361): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (379)..(379): n is a, c, t, g, unknown, or other
  misc_feature (387)..(387): n is a, c, t, g, unknown, or other
  misc_feature (388)..(388): n is a, c, t, g, unknown, or other
  misc_feature (393)..(393): n is a, c, t, g, unknown, or other
  misc_feature (396)..(396): n is a, c, t, g, unknown, or other
  misc_feature (400)..(400): n is a, c, t, g, unknown, or other
  misc_feature (443)..(443): n is a, c, t, g, unknown, or other
  misc_feature (444)..(444): n is a, c, t, g, unknown, or other
  misc_feature (469)..(469): n is a, c, t, g, unknown, or other
tccccgcggtggcggccgctctagaactagtggatcccccgggctgcaggaattcgcacgagaccattacctagaacatcctaatcgaaaactctattagaatagccaggggcctcgctcctctccaccacgtactccactccatccatccatcatcgtctatccatgaagagcttgcaggaggagagggcggcgttggtgccgtcgccgtggccccagcaacagagaaaggacggcggcgagcatgatccggagcagctgatggatgaggatgacggtgacgatgaggaggatctgcaggatgagcagcacacaagaaacattaggacgtcgaccaagacggcggaagcatcgtcatcancgnnnagcgcggtgccgncgtggtgnnagcgncgncggncgcaaaagctggtgcccaccagaggtggtggcctggtcatcgnncgtctctcgggctggccttgctcgncgccgccggcgggggggaaacaccagtcggcggcggtggatcacctcgactatgcatcgccgtttctgctaggcagggggggcggggggggttggaacaaaattagtggctcctcaccaggtccttcaccgggaggggacctcggggccatacccttaaggtgggggggaaagggg

SEQ ID NO: 20939 - protein, 160 aa, Zea mays
  misc_feature: Ceres CLONE 1389801-F
  misc_feature (66)..(66): Xaa is any aa, unknown, or other
  misc_feature (67)..(67): Xaa is any aa, unknown, or other
  misc_feature (72)..(72): Xaa is any aa, unknown, or other
  misc_feature (74)..(74): Xaa is any aa, unknown, or other
  misc_feature (75)..(75): Xaa is any aa, unknown, or other
  misc_feature (79)..(79): Xaa is any aa, unknown, or other
  misc_feature (93)..(93): Xaa is any aa, unknown, or other
  misc_feature (102)..(102): Xaa is any aa, unknown, or other
MKSLQEERAALVPSPWPQQQRKDGGEHDPEQLMDEDDGDDEEDLQDEQHTRNIRTSTKTAEASSSXXSAVPXWXXRRRXQKLVPTRGGGLVIXRLSGWPCSXPPAGGKHQSAAVDHLDYASPFLLGRGGGGGWNKISGSSPGPSPGGDLGAIPLRWGGKG

SEQ ID NO: 20940 - DNA, 646 bp, Zea mays
  misc_feature: Ceres CLONE 1389807-F
  misc_feature: Encodes the peptide sequence at SEQ ID NO. 20941
  misc_feature (575)..(575): n is a, c, t, g, unknown, or other
tccccgcggtggcggccgctctagaactagtggatcccccgggctgcaggaattcgcacgagaccattacctagaacatcctaatcgaaaaatcgatcactacggttccatctcgcacccaactaggcctccgattattccgatcgccagcggatcagatttatgcagtcttactgccgccagctccagccatgccgcgcggcagcagcttggaccagagcctgagcgacgaggagcggtcggcaggtactggggcggtttggatccggcgtcgccggcaatgtccgggatgtccgactccgcgggcggcgggcgcgcgggcgcagagctgatggtggagcagttccacctcaaggtgctccacgccgtcctcgccgtgcgcacgccgcgcccgctcgccaccgccgccgctgccgcgtcgtcgtcgtcgtcgttcaggcggagggacaggtgattccatctcccgctccacgacccgccgccgccccgagcggccggtcgcctcgacgagctggcccccgggaagccgcgtgtggtggacgtcctcctgtgtcctgccaccgccagtgttgtgnaacccccaagggagtggtggaaaggtgaaccgtggcgtgcaaccctgggcaaacccccgagggcgaggagt

SEQ ID NO: 20941 - protein, 57 aa, Zea mays
  misc_feature: Ceres CLONE 1389807-F
MSGMSDSAGGGRAGAELMVEQFHLKVLHAVLAVRTPRPLATAAAAASSSSSFRRRDR

SEQ ID NO: 20942 - DNA, 635 bp, Zea mays
  misc_feature: Ceres CLONE 1389808-F
  misc_feature: Encodes the peptide sequence at SEQ ID NO. 20943
aaactggagctccccgcggtggcggccgctctagaactagtggatcccccgggctgcaggaattcgcacgagaccattacctagaacatcctaatcgaaaaaagaaccaaaggttcaagctccacaggcggcaagctccttcttcatccacgccctccctccgccttgagaaccataggtccgagctctgcaagccccttcccccttcctccacgccctacgttcttgattgattcctgtttgcttgtgattttgcatttcggaaatcgaatcttgttgttcttggggatcattggggggcgattttaggatactagagtctagggctaagaaattgtatggcatcttggagtagtaggggtggagtccttaggcagatgctataggcctattgccgggacctcgccgagttcggcacccagcctacgccgcgagatcgaggtcggacacgaggccactgcctgggctcgccgcccttgggtttcttgtcggtgctgctgctctttgggctcctctggccgaagagcttgagcatgaagcatgtgggttggatgcaggtgggctgagtgcaggtacttggggtcggagctcatggaagatctcaacagcatcgacgagaccgcgtagcctgcctg

SEQ ID NO: 20943 - protein, 76 aa, Zea mays
  misc_feature: Ceres CLONE 1389808-F
TGAPRGGGRSRTSGSPGLQEFARDHYLEHPNRKKNQRFKLHRRQAPSSSTPSLRLENHRSELCKPLPPSSTPYVLD

SEQ ID NO: 20944 - DNA, 644 bp, Zea mays
  misc_feature: Ceres CLONE 1389811-F
  misc_feature (530)..(530): n is a, c, t, g, unknown, or other
tggagctccccgcggtggcggccgctctagaactagtggatcccccgggctgcaggaattcgcacgagaccattacctagaacatcctaatcaaaaaatcccaaatagttactccactcccctcacccctcccgactcccgtgctctctctctctctctctctcggatccgaattgccagcgcaccagtcgagctcgcgggaactcgccggcaccggcgatggcctccgccctactggtcggacagggcggggcgcgccaccacgggtggaggtagacgcgcgccccactcgcgcccatacctcccaaccctaaccccagccagccccacccgcgcgccgacgggtccaagcccaagccgcggacggcagcctcctcgccgagggccgaatacgtgacgttccgcccggcgtccctgtaaccgtgagagtctcgctgactcatttaacgctgattcagggactgtacccgaatgagtgcccgcatactcattgtactcatctgatatctctagggaccgacgtcagcaanattccgatgacaccttaggaagccatcaagtaattttccacgggagtgtgggcaaggaataacatccctctgagaatattatgcatccctccggtcggaactacatagatacaa

SEQ ID NO: 20945 - DNA, 627 bp, Zea mays
  misc_feature: Ceres CLONE 1389812-F
  misc_feature: Encodes the peptide sequence at SEQ ID NO. 20946
  misc_feature (315)..(315): n is a, c, t, g, unknown, or other
  misc_feature (343)..(343): n is a, c, t, g, unknown, or other
  misc_feature (349)..(349): n is a, c, t, g, unknown, or other
  misc_feature (390)..(390): n is a, c, t, g, unknown, or other
aaagctggagctcaccgcggtggcggccgctctagaactagtggatcccccgggctgcaggaattcgcacgagaccattacctagaacatcctaatcgaaaaataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggnggcacggccgggtgcccgctggccgccncgctgncggagcgcttccgcgtgctgctgctggagcgcggcgcctcnccctacgacgacgaccgcttcgggtgactggcccgcttcgcggacctaccgtcgtatccctccccgggctcccccgcgcagcgcttcttgtcggaagaactacgacaactattcccgctctcgagggatgggcagtgagagccgctacacgaccgagtttctcaattaaggcccagagactacccatagccgtggatgtctgaagcacaaccccaatttcctttggcggggcgaaat

SEQ ID NO: 20946 - protein, 89 aa, Zea mays
  misc_feature: Ceres CLONE 1389812-F
  misc_feature: SWISSPROT Homolog: EC 4.1.2.10 Mandelonitrile lyase
  misc_feature (66)..(66): Xaa is any aa, unknown, or other
  misc_feature (68)..(68): Xaa is any aa, unknown, or other
MSGRSRHFTMSTLLATSFFFVLLCSSLQVRGVNYTFVKDAALAPSVSYYDYIIVGGGTAGCPLAAXLXERFRVLLLERGASPYDDDRFG

SEQ ID NO: 20947 - DNA, 645 bp, Zea mays
  misc_feature: Ceres CLONE 1389814-F
  misc_feature: Translation starting site: 171
  misc_feature: Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (417)..(417): n is a, c, t, g, unknown, or other
aagctggagctccccgcggtggcggccgctctagaactagtggatcccccgggctgcaggaattcgcacgagaccattacctagaacatcctaatcgaaaaagtcctctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccggcgctgccgcctacgcctcttccgccgcggcccaggcggcacctgccaccccgccgccggccaccgggaagaccgggggcggcaagatcaccgacgagttcaccggcgctggcgccatncggcaggtgtgccaggtgatcggcgccgtcgttgacgtgcgcttcgatgagggcctcccgcccatcctcacggggctcgaggtgctcgacaacaacatccgctcggggttcgaagtggcgcagcaccctgccggagaacatggtgcgcaacatcgcttaggacgggcacggaagggtttcgtccggggcccccgcggtctcaaaagtgggttccccatcaccgggggg

SEQ ID NO: 20948 - DNA, 663 bp, Zea mays
  misc_feature: Ceres CLONE 1389817-F
  misc_feature: Translation starting site: 140
  misc_feature (452)..(452): n is a, c, t, g, unknown, or other
  misc_feature (460)..(460): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (605)..(605): n is a, c, t, g, unknown, or other
  misc_feature (637)..(637): n is a, c, t, g, unknown, or other
  misc_feature (641)..(641): n is a, c, t, g, unknown, or other
ggagctccccgcggtggcggccgctctagaactagtggatcccccgggctgcaggaattcgcacgagaccattacctagaacatcctaatcgaaaaacaactcacatcgaggtctcagcttcaggaaagggaaggaagcatgttcgggcaccaccacggccacggcgggcaccaccaggccccgccgccgcacgagcagacgctgttcaggatcttctgccgcgccgacgaggcgtactgcctcaccgtgcgtcacgacgccgtcgtcctcgcgcccaccaacccccgcgacgagtaccagcactggtacaaggacatgaggcacagcacgaaggtgaaggacgcggagggccagccagcgttcgcgctcatcaacagggccaccggcctcgccatcaagcactcgctcggccagtcccattcccgtgaagctggtgccctacaacgcggantacctggnacgagtcgggtgcttgtggacggagagccacgacgtggggcaagggcttccgctgcatccgcatggtcaacaacatccacctcaacttcgacgccttccacggcgacaggacccacggcggcgtgcacgagnnnccaccgtgtgnttctcgggagggggttgcaaggcccccaacanaaanttggaaggtgcttccctggggg

SEQ ID NO: 20949 - DNA, 643 bp, Zea mays
  misc_feature: Ceres CLONE 1389820-F
  misc_feature: Encodes the peptide sequence at SEQ ID NO. 20950
  misc_feature (643)..(643): n is a, c, t, g, unknown, or other
tccccgcggtggcggccgctctagaactagtggatcccccgggctgcaggaattcgcacgagaccattacctagaacatcctaatcgaaaacgaataattcgaaagatccctccaggaaagatttttcttccctcctccgacgccccagaccaccaacacagtctataaagcagccctcagtcacacacagaacgcacaagcgcaagccggggaagaaaactccgtaggccagactgcgagttggatggccttcttcttggccctcgtgtgcatcctcatcttgctagccatcggctcctacgtccagtacactcgctggcaaaaggggaaaggccgcttcgacggccatgagaggtctgctcccttgaagctgcctcctggctccatggggtggccttaccttggcgagaccctccagctttactcacaggaccccagcttcttcttcgcttccaaacagaagaggtacggcgagatcttcaagacgcaccttctgtgttgcccgtgcgtgatgctgacgagcccgcaaggcgagggcggttcgtgactgcagacgcacgacgcacctgttcaaggcgacctacccgcgcagctaggatcgcattgatcgggcccggcgtttctcttcatccaccatggtcn

SEQ ID NO: 20950 - protein, 100 aa, Zea mays
  misc_feature: Ceres CLONE 1389820-F
  misc_feature: SWISSPROT Homolog: EC 1.14.13.93 (+)-abscisic acid 8'-hydroxylase
MAFFLALVCILILLAIGSYVQYTRWQKGKGRFDGHERSAPLKLPPGSMGWPYLGETLQLYSQDPSFFFASKQKRYGEIFKTHLLCCPCVMLTSPQGEGGS

SEQ ID NO: 20951 - DNA, 657 bp, Zea mays
  misc_feature: Ceres CLONE 1389824-F
  misc_feature: Pfam Name: TB2_DP1_HVA22 Pfam Description: TB2/DP1, HVA22 family
  misc_feature (269)..(269): n is a, c, t, g, unknown, or other
  misc_feature (512)..(512): n is a, c, t, g, unknown, or other
tggagctccccgcggtggcggccgctctagaactagtggatcccccgggctgcaggaattcgcacgagaccattacctagaacatcctaatcaaaacactcgggttggttagaagaacccaatgcaagtgtgagtgagctgacggcacggaggacgcgatcgcctctcctctcctctcgtctcctcttcttccggctctccctctccgcatgccattccaacgcattaccggtatttttagccgccggaggagacgggtagctgcgtanccactagcgagagagagagggaggggagaaaccatagctcctggccgttctgcctgcccatccaccgcggcgccggccgtccgtctcccgtccacatccctcctccgtctcgtgcaaggttcctgtgcgtagcgcagaggggtcggagtcggagtcggagtcggagaagatggatgggcgggtccctctcagggtcctcctggttgggctttggctatgcctatcctggctacgaatgctacnagactgttgaactgacaaaaacagagatgcgagctcatatgtttggtggcaggaatgggaattttagtgccctgtggacggttttggagagattcggagatttcacatatcatggctaccgtctactcgaaggaaagctggatgt

SEQ ID NO: 20952 - DNA, 652 bp, Zea mays
  misc_feature: Ceres CLONE 1389826-F
  misc_feature: Translation starting site: 209
  misc_feature: Pfam Name: Ribosomal_S17 Pfam Description: Ribosomal protein S17
  misc_feature (443)..(443): n is a, c, t, g, unknown, or other
  misc_feature (460)..(460): n is a, c, t, g, unknown, or other
  misc_feature (466)..(466): n is a, c, t, g, unknown, or other
  misc_feature (494)..(494): n is a, c, t, g, unknown, or other
  misc_feature (597)..(597): n is a, c, t, g, unknown, or other
tggagctccccgcggtggcggccgctctagaactagtggatcccccgggctgcaggaattcgcacgagaccattacctagaacatcctaatcgaaaaatagggttctaagcctcggccgtttcttcgtctccacagctcccgccgccgcggaccagcgcgtcactctaccgggttccggcgtctccccgtacccgtagcgcggcatccatggcggagcagacggaaagggctttcttgaagcagcccaaggtgtttctctgttccaagaaggccaccaaggtaaacaaacctggcaagggaggaaacagattctggaagaacattggccttggtttcaagacacccagggaagccattgaaggaacctacattgataagaagtgtccattcaccggcactgtgttcctatcaggggtcgcatcatcgccggaacatgcccagntgctaagatgaataggnaccatncattgtttcgtaggaattatcttccttncgtcagaagtaccagagggtatgagaagagacactccaacatccctgcgcacatttcaccatgcttccgtgtcaagggaaggaagatcatgtgatcatggggncagtgcaggccaagtgtcgaaaaaactgtaagggttcatgggtggtcaaagttat

SEQ ID NO: 20953 - DNA, 641 bp, Zea mays
  misc_feature: Ceres CLONE 1389830-F
  misc_feature: Encodes the peptide sequence at SEQ ID NO. 20954
  misc_feature (333)..(333): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (383)..(383): n is a, c, t, g, unknown, or other
  misc_feature (388)..(388): n is a, c, t, g, unknown, or other
  misc_feature (393)..(393): n is a, c, t, g, unknown, or other
  misc_feature (394)..(394): n is a, c, t, g, unknown, or other
  misc_feature (450)..(450): n is a, c, t, g, unknown, or other
  misc_feature (468)..(468): n is a, c, t, g, unknown, or other
  misc_feature (470)..(470): n is a, c, t, g, unknown, or other
  misc_feature (508)..(508): n is a, c, t, g, unknown, or other
  misc_feature (565)..(565): n is a, c, t, g, unknown, or other
  misc_feature (636)..(636): n is a, c, t, g, unknown, or other
  misc_feature (638)..(638): n is a, c, t, g, unknown, or other
  misc_feature (639)..(639): n is a, c, t, g, unknown, or other
tggagctccccgcggtggcggccgctctagaactagtggatcccccgggctgcaggaattcgcacgagaccattacctagaacatcctaatcaaaacatccagagagagacacggaggacctgggattggttgcgctgctgtgactcgctccgtgttccaagcgccttttgagcattcagggagatataaaattcctctttttacactacaatccccgctgaatcagcagcagcaactctctccctctccgttcttggtggaccgagacccttggccgtacgctctgcctcactcctccgtctcttgcttccttggcggccggcaggggcgcntccttctcagggctgaacgcactgtacgacaccgtcggcggtcgnnntgntgacntctgnnttaacgactaccacttccgcgtgctccgcaggctcggcgatgccggccctgcgggnctcgtcggtcttcctcgncnagggatggcgtcggccgccgcaaccgcctccgacgggnacgggttgggtcagagacccggcgccctcacaggatcgccgggaaaaaagggcatcnaagcattaaaacgtctcaggctgacgggaaagaaagcgtctcaagaaaaggggatagccgggaagggtacngnncg

SEQ ID NO: 20954 - protein, 54 aa, Zea mays
  misc_feature: Ceres CLONE 1389830-F
  misc_feature (12)..(12): Xaa is any aa, unknown, or other
  misc_feature (31)..(31): Xaa is any aa, unknown, or other
MASAAATASDGXGLGQRPGALTGSPGKKGIXALKRLRLTGKKASQEKGIAGKGT

SEQ ID NO: 20955 - DNA, 703 bp, Zea mays
  misc_feature: Ceres CLONE 1389834-F
  misc_feature: Encodes the peptide sequence at SEQ ID NO. 20956
  misc_feature (486)..(486): n is a, c, t, g, unknown, or other
  misc_feature (563)..(563): n is a, c, t, g, unknown, or other
  misc_feature (635)..(635): n is a, c, t, g, unknown, or other
aaagctggagctccccgcggtggcggccgctctagaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtggacatgctcccgttcgtgctcgcgaacctcgggcgcctctacgacgccatcaccgacgccctccacgtggtccgggtgcacgtaatgggttcccgccgggaccgtggctccgccccgcgcggacttccctagctgacgtgccgtaccccggtcggacgtccagcacctggcctggggtccaaaaccaacgtggngcttacgaacgaggcagccgaagacttttttgccgttagcatgatctcacctccatgggcgtacgaccctgctgggnttagcgagcgccccccctgcccaagggttaatttttctccgatcccttgccaactgactcagaactatccanccactgggggcttttatcggatttacaggttggcccagggaatttccgtcaggttcccaaatttggtg

SEQ ID NO: 20956 - protein, 88 aa, Zea mays
  misc_feature: Ceres CLONE 1389834-F
MGALRSLAISYPEFLVAGLCFVSLSALRHAMRERRQRAPLSWPVVDMLPFVLANLGRLYDAITDALHVVRVHVMGSRRDRGSAPRGLP

SEQ ID NO: 20957 - DNA, 619 bp, Zea mays
  misc_feature: Ceres CLONE 1389835-F
  misc_feature: Encodes the peptide sequence at SEQ ID NO. 20958
  misc_feature (217)..(217): n is a, c, t, g, unknown, or other
  misc_feature (258)..(258): n is a, c, t, g, unknown, or other
  misc_feature (268)..(268): n is a, c, t, g, unknown, or other
  misc_feature (275)..(275): n is a, c, t, g, unknown, or other
  misc_feature (324)..(324): n is a, c, t, g, unknown, or other
  misc_feature (332)..(332): n is a, c, t, g, unknown, or other
  misc_feature (333)..(333): n is a, c, t, g, unknown, or other
  misc_feature (401)..(401): n is a, c, t, g, unknown, or other
  misc_feature (560)..(560): n is a, c, t, g, unknown, or other
aaagctggagctccccgcggtggcggccgctctaaaactagtggatcccccgggctgcaggaattcgcacgagaccattacctaaaacatcctaatcgaaaaatcgatcccagccccaggccatggcgacgaggtggaggaggtcgcttgctctgggtcgccgtcgtccagttcctgaccctgtgcgtcgccgagcatctcgtagtggaagcatacnaaaagtcctacattgtgtatctgggatcactggcatatggncgtgatgctngtcgcgnaggagcatgctcgcgcaccccagtctcaccaccactcctggcatcgatnctcggggnngacgaccaccacaccatgaagggggggcggggaggtcattcttctactcctacgccagagcaagatcnatgggcttcgcgggcacctgggaagggaatccgtcgcggaaaaaaatcgcgacaacccctgaggggggtgggggcggtttttttaaaaacaaaaaaggttcaaagtgacaacccccgggggccctggggaatttctgggacctgggagggggggagggnacaccccccctccctgggttccttttgaaaccccccctttgtttctaaaaaaggaactt

SEQ ID NO: 20958 - protein, 195 aa, Zea mays
  misc_feature: Ceres CLONE 1389835-F
  misc_feature (73)..(73): Xaa is any aa, unknown, or other
  misc_feature (90)..(90): Xaa is any aa, unknown, or other
  misc_feature (92)..(92): Xaa is any aa, unknown, or other
  misc_feature (108)..(108): Xaa is any aa, unknown, or other
  misc_feature (111)..(111): Xaa is any aa, unknown, or other
  misc_feature (134)..(134): Xaa is any aa, unknown, or other
  misc_feature (187)..(187): Xaa is any aa, unknown, or other
KAGAPRGGGRSKTSGSPGLQEFARDHYLKHPNRKIDPSPRPWRRGGGGRLLWVAVVQFLTLCVAEHLVVEAYXKSYIVYLGSLAYGRDAXRXGACSRTPVSPPLLASXLGXDDHHTMKGGRGGHSSTPTPEQDXWASRAPGKGIRRGKKSRQPLRGVGAVFLKTKKVQSDNPRGPWGISGTWEGGRXHPPSLGSF

SEQ ID NO: 20959 - DNA, 680 bp, Zea mays
  misc_feature: Ceres CLONE 1389836-F
  misc_feature (359)..(359): n is a, c, t, g, unknown, or other
ccccgcggtggcggccgctctagaactagtggatcccccgggctgcaggaattcgcacgagaccattacctagaacatcctaatcgaaaaaggattccttacaggacctcacctccctactcgcgtattagtcgtcgtcgtcgtcctcctcccgacgtgtggtggtatcgtacttgcgtggcgtggaggtgcttccgaatttgtgatcgatttgcttggcagcgccgacacctagttttgcttcgacggcacccacctacggtacgctggcgtgcccaagcagtcatgcgactcgtaataatttggctacagagactagaggatgcgccggcgagagcctcgattgctcacgctgcggngatgggtagcaggtcgtcttcgtcaacaggcatctgcgtctccttcaatcaggacaacaggatgttttcttgtggaacaaagaatgggtttcagatctttgacgttccaaagggggggttctggttccaaaaaggtcttggggggatcccaattgggggaaagggtatttggccacaaccccattttgctttggcggaaccgggggaaaaacctgggagggccccccccggggttttggggcctgggcccccccaaagggggggttttaagggggggtggcgctttttaaaactttcttttgtggggggggggcgtataaa

SEQ ID NO: 20960 - DNA, 650 bp, Zea mays
  misc_feature: Ceres CLONE 1389837-F
  misc_feature (358)..(358): n is a, c, t, g, unknown, or other
  misc_feature (562)..(562): n is a, c, t, g, unknown, or other
  misc_feature (567)..(567): n is a, c, t, g, unknown, or other
  misc_feature (627)..(627): n is a, c, t, g, unknown, or other
tggagctccccgcggtggcggccgctctagaactagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcgttatcccggccgctggcgctggcgcgagagttggttggtggtggtgttcagcccccctccctcttcaggtttagggtggagcgatccgtgcaggccaacgcggngtgcgtgacccagaaagggaaaccgccgccttttttctcttctgccgccccgcttttccaatccctcctcatcctcatccgccccgccccgcacatcaccaaaaaggtccccgccttcttcttcctcttctccctctgccctgggctgtcgtttgctcgtgctcccccaccccctttctgattcagccagggttccttccgcgncgcgncgcgtcgccatgggcaactgctggggcgccaagatcagctccgacagcccctcccgcggngctcctccccgtcagggacgggg

SEQ ID NO: 20961 - DNA, 663 bp, Zea mays
  misc_feature: Ceres CLONE 1389838-F
  misc_feature: Encodes the peptide sequence at SEQ ID NO. 20962
  misc_feature (476)..(476): n is a, c, t, g, unknown, or other
  misc_feature (498)..(498): n is a, c, t, g, unknown, or other
  misc_feature (565)..(565): n is a, c, t, g, unknown, or other
tggagctccccgcggtggcggccgctctagaactagtggatcccccgggctgcaggaattcgcacgagaccattacctagaacatcctaatcgaaaaagtctctcctcgcctctctctcgcgcaaggcagagtagagtaaccaaccataccaccggcccgtgtcgatctctggcctctctcgtgcaaggaattaagcaggcaagaagccaaccttccaccatggccaaggcgagcagcaggctgctcttctcgctctcgctcgtcgtcctgctgctcctcgtggagaccactacttctccccatggacaggctgaagccatcgactgcggcgcgagctgctcgtaccggtgcagcaagtcggggcggcccaagatgtgcctgagggcgtgcggcacctgctgccagcgctgcggctgcgtcccgccgggcacctccggcaaacgaggacgtctgcccctgctacgccaacatgagnacccacgacggccagcacaagntgcccgtgacaatctccaccggtggttcccagcatcagcagctttgccaaaaagacatgacactacnttttatatgggagtactacctagcttctgctgctgctgtgtcaaaaaaaacgtgttgttccaatataatggggcgcgtgcatgcatgaataaataaag

SEQ ID NO: 20962 - protein, 146 aa, Zea mays
  misc_feature: Ceres CLONE 1389838-F
  misc_feature (5)..(79): Pfam Name: GASA Pfam Description: Gibberellin regulated protein
  misc_feature (86)..(86): Xaa is any aa, unknown, or other
  misc_feature (93)..(93): Xaa is any aa, unknown, or other
MAKASSRLLFSLSLVVLLLLVETTTSPHGQAEAIDCGASCSYRCSKSGRPKMCLRACGTCCQRCGCVPPGTSGKRGRLPLLRQHEXPRRPAQXARDNLHRWFPASAALPKRHDTTFYMGVLPSFCCCCVKKNVLFQYNGARACMNK

SEQ ID NO: 20963 - DNA, 686 bp, Zea mays
  misc_feature: Ceres CLONE 1389840-F
  misc_feature: Encodes the peptide sequence at SEQ ID NO. 20964
  misc_feature (287)..(287): n is a, c, t, g, unknown, or other
  misc_feature (403)..(403): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (485)..(485): n is a, c, t, g, unknown, or other
aaagctggagctccccgcggtggcggccgctctagaactagtggatcccccgggctgcaggaattcgcacgagaccattacctagaacatcctaatcaaaaaacgccaaagatttcctcttccgcctgcgcttccctttgccccgctctcccccagcctcgctcgccatataatacgggccggccggccggccagctgggtccccgcggatgggctcggtctcgcggggctagggtttggtcggtcgtctcgccggcgtcgaggccgccagcgctgctagctagctnctctcgcgttagggttccccgtagccatggtgctgcagcgcttctcgtggccgtacggcggccggagcgccaccttctgcggtagcttcaccgggtgggagagagtgtcccatgcnggctgcnnntgccgcgcgttcccagggcgtcttcgatctgcccccccggagtttaccagtaccgggtttttggttgaatgtngcctgggaggtgtagatgaaacaaaaacccttggtacggggatgaatatggacttgatccggcaagggagggccttggggaaaaaacatgggaacaacctggttgtggaagccaggagcctttctattcgaaggaacaaatatgggataaggggtaccatttttggaaaacattggccccccggagcattcattctcaaaa

SEQ ID NO: 20964 - protein, 124 aa, Zea mays
  misc_feature: Ceres CLONE 1389840-F
  misc_feature (33)..(33): Xaa is any aa, unknown, or other
  misc_feature (58)..(58): Xaa is any aa, unknown, or other
MVLQRFSWPYGGRSATFCGSFTGWERVSHAGCXCRAFPGRLRSAPPEFTSTGFLVECXLGGVDETKTLGTGMNMDLIRQGRALGKKHGNNLVVEARSLSIRRNKYGIRGTIFGKHWPPGAFILK

SEQ ID NO: 20965 - DNA, 682 bp, Zea mays
  misc_feature: Ceres CLONE 1389841-F
  misc_feature: Encodes the peptide sequence at SEQ ID NO. 20966
  misc_feature (391)..(391): n is a, c, t, g, unknown, or other
  misc_feature (433)..(433): n is a, c, t, g, unknown, or other
  misc_feature (447)..(447): n is a, c, t, g, unknown, or other
  misc_feature (530)..(530): n is a, c, t, g, unknown, or other
  misc_feature (553)..(553): n is a, c, t, g, unknown, or other
  misc_feature (678)..(678): n is a, c, t, g, unknown, or other
aaagctggagctccccgcggtggcggccgctctagaactagtggatcccccgggctgcaggaattcgcacgagaccattacctagaacatcctaatcaaaaacgatacaaaacacaaactctcggagacagggaagtagcgtagctagatccagagctcggcgccagagatacccgacatcctcgtcatgtctccggttgcaagcaagggagtagtgatggacggtgcggtggcggtggcggcagtggccgccgccgtgctgctgtgcctccatctgccggcggtggcgcgagccagctggcaggtggggttctacaacacgagctgccccaacgccgagtccctgggtccgccaggcggtgggccagcgcgttcgccaacgactccggcnatcgccgccggcctcatccgcctccatttccacgactgcttncgtcaggggctggnaatggcgtcggtgctggctgacctccgccaacaacaccggcgggagcgtgacgcgccgcccaacaacccgagccctccacggntttccaggtgatcgaacgcgggnaaagggcggcgggtggagcagagctgcccgcagaacggtggtcgtgcgcgggacatcgtggcccttcgcggggcgcgacagcatcaacctcacggacaacctgcccgtaccgggtgccctcgggnccgc

SEQ ID NO: 20966 - protein, 117 aa, Zea mays
  misc_feature: Ceres CLONE 1389841-F
  misc_feature: SWISSPROT Homolog: EC 1.11.1.7 Peroxidase
  misc_feature (82)..(82): Xaa is any aa, unknown, or other
  misc_feature (87)..(87): Xaa is any aa, unknown, or other
  misc_feature (115)..(115): Xaa is any aa, unknown, or other
MSPVASKGVVMDGAVAVAAVAAAVLLCLHLPAVARASWQVGFYNTSCPNAESLGPPGGGPARSPTTPAIAAGLIRLHFHDCXRQGLXMASVLADLRQQHRRERDAPPNNPSPPRXSR

SEQ ID NO: 20967 - DNA, 2833 bp, Zea mays
  misc_feature: Ceres CLONE 1389845
  misc_feature: Encodes the peptide sequence at SEQ ID NO. 20968
gccgcaacccctctctcattttcttcctcgtctacacctccttctctcctcctcgatacattcgagcacgcccggacgcggtcagaagggagaaagcagcaagcggcgccgggttccccctcccttcgtcgcccccgatcgacgccgatcggggccgactgctcgtgggggacgccgaccgaagcccgggcggcgctgcttcaatatacggaagcagtttctagttttcttcagttcgccgctgcagtttctagtttccagcggttcccaccagttgtctaataacttattgttgttgtacgtgaggttgcttttgtcgtatttgccaggttgcttttgttgtatttgccaggttgacacacttggtgttgtaaatcattgctatttttgggtcatgacttgtttttattgaaatcaattggctgccaaggttcactaaatctttgatgcaacataataggatcaccatgctgtcttcttcagagacttgccagcttggttctagttctagcaaccctgtcatggatcagcagaatttacttcccaacaactctaacgtggatgaacagattttactcccaaatgcattagagcatgaggactacccacactatttgctcaatagtcatgaggtgggaatgccaagtggaagcctgattggtcagcaaaatacaagcttgagcttgtgggaaccagctggatctagctcaatggagtgcttagttgatcatgacaactttttccaggcaaaaagagaacatcttgcctcttctcggtctattggtgccccgttaagtatagagaggaggagacatgaaggcactagttcattgccttcacacaacctaaacatagacctcaacattaatcaggctgatcaatttggctctgatgatgttgatcttgcacatggtaatggacaaccaagagcaaatactgtcacagcccacaggggctctttcataactgagcatattctgcatcatggagtttcttcggatgctataggaaattcttccaggaatgcagagtgttttgttggtgcagcaggccaagacagtcatcatgcagcctttaagagaaagtatcttgatggatgtcatgcagagtcttctgctaacggaagctcacgcaatcgtcaccagaataatagtactctgctacctcctccgaccacctgtgaaagttttactatacccaccgcaacaaattttagtgttccgtaccatcctgtggagcagctaaaccagagtactaatattgctgcaagctctactttgtctgatcactattcttcatacagtgatccacgtggaaacgaattcgtgcgaaatacacggatgcgaataaaccctagtgattatgatcaatcgctgcccagtctattacctgaggggagtttcaggtgctcggcttaccaatctacacagcagcagtcatcatttattccagcgcaacctagacaagttagctcttcttctggttctcatagtcgatctcatgtgcctgctgttactcagttttcacaaaatcttcgccgtccatcaactgttagttttgggtcaagaattgggaattcttccacttctggttctacaataccaatacctgcttcacaagatcctggtacaagcttgttgggaagcgattatcctgagccacttttgttaggttctttgtttacagctgattcaacaaatttcttatctgcatctggaagcataagtaaccagcaaaattctggatccagctctagttccatgctcaggcctgctgttaatgttggaacacaagtccctgagttcaacgtatctcagccaagtacaactttaagaggttcatctgatgtgttcaggaggtccttaatttctgctggcatttctcattctagaagttcaagcatcccattgcagcaccgtggaaattcatccacatcacatgagattaggaatcatcagccaggatcaagctctcgtgcacatcagcagcaccccttaagacccggtcattcctctgtagacaggcagagctctggttacttggaccttcagtcttttatgcagaccatagcttcaagggaaggaggcagaccaatgtcagagatccgcaatgtcttcgatcagattcgtcaggggagaaatgcacgattggaggatttgcttctcattgaccggtcacttattatgagacgagctaatttgattgatagacatcgggatatgaggcttgatgtggataatatgtcctatgaggaattgctggcactaggtgaacgcattgggtacgtaaacacaggacttactgaagaaaagattttgagtaacttgaaacaatggaaatgtgtcttaaaatcattggatgatcctccaacaagtgttgaaccatgctgtatttgccaggaagactatgtggaaggcgaggacctgggcaggctggattgtggtcatgacttccacaccgcatgtatcaaacaatggctggttataaaaaacctgtgcccaatctgcaagaaaacagcactggacacctaaaaacatggctgcctttttccttaggaaaaagccggtagcggcagggcaagtggttgccatctaaccacaccctcccatgactagcaaagtatgttacacctttcccatcatcaacatacatgtgggaatctatactataggtggtacatggcacttgcctgaagccaatggctgtagaccatggagttttatcctttgtttttttcaatcttagatttaggatttaaaatttattcaatgacatttgatttacttgggcaatctgcgatatttgctatcatcatcgcaaaaaaaaaaaaaaa

SEQ ID NO: 20968 - protein, 694 aa, Zea mays
  misc_feature: Ceres CLONE 1389845
  misc_feature (647)..(687): Pfam Name: zf-C3HC4 Pfam Description: Zinc finger, C3HC4 type (RING finger)
MQHNRITMLSSSETCQLGSSSSNPVMDQQNLLPNNSNVDEQILLPNALEHEDYPHYLLNSHEVGMPSGSLIGQQNTSLSLWEPAGSSSMECLVDHDNFFQAKREHLASSRSIGAPLSIERRRHEGTSSLPSHNLNIDLNINQADQFGSDDVDLAHGNGQPRANTVTAHRGSFITEHILHHGVSSDAIGNSSRNAECFVGAAGQDSHHAAFKRKYLDGCHAESSANGSSRNRHQNNSTLLPPPTTCESFTIPTATNFSVPYHPVEQLNQSTNIAASSTLSDHYSSYSDPRGNEFVRNTRMRINPSDYDQSLPSLLPEGSFRCSAYQSTQQQSSFIPAQPRQVSSSSGSHSRSHVPAVTQFSQNLRRPSTVSFGSRIGNSSTSGSTIPIPASQDPGTSLLGSDYPEPLLLGSLFTADSTNFLSASGSISNQQNSGSSSSSMLRPAVNVGTQVPEFNVSQPSTTLRGSSDVFRRSLISAGISHSRSSSIPLQHRGNSSTSHEIRNHQPGSSSRAHQQHPLRPGHSSVDRQSSGYLDLQSFMQTIASREGGRPMSEIRNVFDQIRQGRNARLEDLLLIDRSLIMRRANLIDRHRDMRLDVDNMSYEELLALGERIGYVNTGLTEEKILSNLKQWKCVLKSLDDPPTSVEPCCICQEDYVEGEDLGRLDCGHDFHTACIKQWLVIKNLCPICKKTALDT

SEQ ID NO: 20969 - DNA, 663 bp, Zea mays
  misc_feature: Ceres CLONE 1389847-F
  misc_feature: Encodes the peptide sequence at SEQ ID NO. 20970
  misc_feature (517)..(517): n is a, c, t, g, unknown, or other
  misc_feature (623)..(623): n is a, c, t, g, unknown, or other
  misc_feature (635)..(635): n is a, c, t, g, unknown, or other
tggagctccccgcggtggcggccgctctagaactagtggatcccccgggctgcaggaattcgcacgagaccattacctagaacatcctaatcgaaaaatccgaactccgaaaagccccccagcggcctcccctccgccccgcagccatggccgccaccggcgtggtcgccgagccgaagaccaagtacgatcgccagctcaggatatggggtgatcaaggccaggctgcactggagaaggctagcatatgcttgcttaactgtggtcctaccggaaccgaagcattgaagaatctcgtgcttggaggcataggaagtgtgactgttgttgatggctccaaagttgaatcatctgacctggggaacaattttctgttggatgaaggatgtttggggcaaccaagagctaaatctatatgttctttcctacaagagcttaatgacgctgttaaggccaagtgttgttgaggagtctccagcgcatttgatagatactaatccttcattcttttcccggnttacctgttgttattgctacccagcttcccagagagttttttactgaagctagattatatctgcaggaagcagataattcgttttggttgctgcacgttctagggnccaaaacggggntgggtcaagggttagcggaaggggagca

SEQ ID NO: 20970 - protein, 106 aa, Zea mays
  misc_feature: Ceres CLONE 1389847-F
MAATGVVAEPKTKYDRQLRIWGDQGQAALEKASICLLNCGPTGTEALKNLVLGGIGSVTVVDGSKVESSDLGNNFLLDEGCLGQPRAKSICSFLQELNDAVKAKCC

SEQ ID NO: 20971 - DNA, 656 bp, Zea mays
  misc_feature: Ceres CLONE 1389848-F
  misc_feature: Encodes the peptide sequence at SEQ ID NO. 20972
  misc_feature (656)..(656): n is a, c, t, g, unknown, or other
tggagctccccgcggtggcggccgctctagaactagtggatcccccgggctgcaggaattcgcacgagaccattacctagaacatcctaatcgaaaaaaaagctgacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctgatcatgcctccacgtgatcaggttgctcgagtggctaagatgttaggtgatgaatatggtactgcttcaaaatcaagagtagagttaatcgtcaatgctgtgttggctgccatcacctcgctcaggaggaggttgaagctctacaacaagtgctcctaaacgggattggttctgtacactggaactattgttactgaagacggaaaggaaaagaaagttactattgattttggagcatttcagcctatcaattatcactctaccttgggggaaacaagtccacactgaggcttaaatgagctcttggatcggatgaan

SEQ ID NO: 20972 - protein, 88 aa, Zea mays
  misc_feature: Ceres CLONE 1389848-F
  misc_feature (6)..(88): Pfam Name: eRF1_1 Pfam Description: eRF1 domain 1
MSDSHETDRNIEIWKIKKLIKALESARGNGTSMISLIMPPRDQVARVAKMLGDEYGTASKSRVELIVNAVLAAITSLRRRLKLYNKCS

SEQ ID NO: 20973 - DNA, 641 bp, Zea mays
  misc_feature: Ceres CLONE 1389850-F
  misc_feature: Encodes the peptide sequence at SEQ ID NO. 20974
  misc_feature (381)..(381): n is a, c, t, g, unknown, or other
  misc_feature (382)..(382): n is a, c, t, g, unknown, or other
  misc_feature (641)..(641): n is a, c, t, g, unknown, or other
tggagctccccgcggtggcggccgctctagaactagtggatcccccgggctgcaggaattcgcacgagaccattacctagaacatcctaatcgaaaacttccccttctcagcctttccctctcttctctgctctttgcatctctctcttgttcctcccttcctctctctaaaaaaagggttctgatccctttctagaagctcctgggtttctgttgccgacccgagctccccaggggcgctcaggaggcgccgagccggcgaccgctccggcggatctgaggagccgccgcggtcgctttgcctccggttccttgtaaactattcattgggaaaactctgaagaagagtttgttggctgcataacatctcctgaagcctgnnttgaagtttgctgataggaaagatcatgggcgctctctgtgatttctgtggggagcagaggtctatggtttactgccgatcagatgcagcatccttgtgtttatcatgtggacgtaatgtgcattcagctaatgctctttctcggcgtcatacaaggacacttttatggggaccggtgtgcttcaagcctgctaatggtccgctgtctaacagaaaatgcctcgctttgcaaaaatggggatgggaatgccaccttgcn

SEQ ID NO: 20974 - protein, 78 aa, Zea mays
  misc_feature: Ceres CLONE 1389850-F
  misc_feature (1)..(47): Pfam Name: zf-B_box Pfam Description: B-box zinc finger
MGALCDFCGEQRSMVYCRSDAASLCLSCGRNVHSANALSRRHTRTLLWGPVCFKPANGPLSNRKCLALQKWGWECHLA

SEQ ID NO: 20975 - DNA, 642 bp, Zea mays
  misc_feature: Ceres CLONE 1389852-F
  misc_feature: Translation starting site: 409
  misc_feature: SWISSPROT Homolog: EC 1.14.13.68 4-hydroxyphenylacetaldehyde oxime monooxygenase
  misc_feature (473)..(473): n is a, c, t, g, unknown, or other
  misc_feature (596)..(596): n is a, c, t, g, unknown, or other
tggagctccccgcggtggcggccgctctagaactagtggatcccccgggctgcaggaattcgcacgagaccattacctagaacatcctaatcgaaaaagctccaggagcagcaccaatcccccaagccgccatggccgccgaccccacgctgctgcttctcgtacctttcctcgccatccccctctacttcttcttggccaccagacgtaggacgccacgcgggggcgcgcggctcccgccggggccgtgggcgctgcccgtggtcgggcacctgcatcacctagcccggggcctcccgcaccgcgtcatgcgcgacctggcgaggcgccacggcccgctcatgatgctccggttcggcgagggccccggtggtggtggcctcctcgccggccgcggcgcgcgaggtgatgcgaacccacgacgcggcgttcgcgtcgcggcccatcgggcccgtgtcccggctctggttccngggcggcgagggcttcctcttcgcgccctacggcgacgactggcgccacctccggagggtccggacccaggagctcctcccggccggcggcggcaaatccttccgccccggggcgcgaggacnaacttcgcccgcctgctcgcctccgtcccctccaactccgggcccc

SEQ ID NO: 20976 - DNA, 656 bp, Zea mays
  misc_feature: Ceres CLONE 1389853-F
  misc_feature: Encodes the peptide sequence at SEQ ID NO. 20977
  misc_feature (381)..(381): n is a, c, t, g, unknown, or other
  misc_feature (481)..(481): n is a, c, t, g, unknown, or other
  misc_feature (514)..(514): n is a, c, t, g, unknown, or other
  misc_feature (570)..(570): n is a, c, t, g, unknown, or other
tggagctccccgcggtggcggccgctctagaactagtggatcccccgggctgcaggaattcgcacgagaccattacctagaaacttccttagctaacttcccagccccgacaccttggccgccgctccgtgcgcacccagttgctgaggttgcaacgctgcagccggcgaggatcggatgaaccaccaacccctcctataaatcctaaccgagtcctctgcttctgctctcatccatctgtagagtgcaacatgcagtgccccatggacactgctgctagtggaacctcgccagtgatgcaattccatagcaatgctgatgagtctatcgcccattcatctccattggcaactttaatacaacgttcacagcgccattgcntatgggggatggatccccaggcgaattttccccttgctgtgagcccctccattgttctccatggctctcatctttgtgatctaaggtccgaaagatctcngccatctggaggctacatggcgtatttttcgcnaaaccctgcaagttttgcaccagactttgcattgtcattttcgggagctttgcggnatttgatatgtgccagaaaaggaccatggtttaagcagatgaagcagaaaaaatccgggagtgctgaaaaccaacggtggtggagg

SEQ ID NO: 20977 - protein, 131 aa, Zea mays
  misc_feature: Ceres CLONE 1389853-F
  misc_feature (40)..(40): Xaa is any aa, unknown, or other
  misc_feature (73)..(73): Xaa is any aa, unknown, or other
  misc_feature (84)..(84): Xaa is any aa, unknown, or other
  misc_feature (103)..(103): Xaa is any aa, unknown, or other
MDTAASGTSPVMQFHSNADESIAHSSPLATLIQRSQRHCXWGMDPQANFPLAVSPSIVLHGSHLCDLRSERSXPSGGYMAYFSXNPASFAPDFALSFSGALRXLICARKGPWFKQMKQKKSGSAENQRWWR

SEQ ID NO: 20978 - DNA, 665 bp, Zea mays
  misc_feature: Ceres CLONE 1389856-F
  misc_feature (420)..(420): n is a, c, t, g, unknown, or other
  misc_feature (614)..(614): n is a, c, t, g, unknown, or other
aaagctggagctccccgcggtggcggccgctctagaactagtggatcccccgggctgcaggaattcgcacgagaccattacctagaacatcctaatcgaaaaatctccttccagccgagctctggcgctaggtttctctcccagtgtgcgcgctgcccttcttctccaggccgccgactcctgctcgtcgaatcccctctactcaccagggcgcttggcttcctccttccctgccgcaccgtgctcctctgctcctccctgctgccagctcggccgtgccctggccatgctccctgcgctcgccagccgtgcgcatctccctctatgcacgcgcgcctgcgtcctgcgccgcgaaccccgccgtggagcttcctcgagctcgccccatggcgcccggccgagctcctccctgtcgtgctncttgcttggcgtccattttctaaaaaggtcgcggtcttcctccccgagcttgccctagccccttgtatcccccatgggccggagcttcttccagctccagctcggctctctctcccatggctccctgcacgcaatctattcttcttgcggagctcccagcggcgcgccccgtcccctctgcttgctcgagccgnttcccaataggggggttggggagcgctttctctctgcttgcgcggcccggg

SEQ ID NO: 20979 - DNA, 659 bp, Zea mays
  misc_feature: Ceres CLONE 1389858-F
  misc_feature: Encodes the peptide sequence at SEQ ID NO. 20980
  misc_feature (282)..(282): n is a, c, t, g, unknown, or other
  misc_feature (333)..(333): n is a, c, t, g, unknown, or other
  misc_feature (397)..(397): n is a, c, t, g, unknown, or other
  misc_feature (402)..(402): n is a, c, t, g, unknown, or other
  misc_feature (403)..(403): n is a, c, t, g, unknown, or other
  misc_feature (408)..(408): n is a, c, t, g, unknown, or other
  misc_feature (409)..(409): n is a, c, t, g, unknown, or other
  misc_feature (474)..(474): n is a, c, t, g, unknown, or other
  misc_feature (475)..(475): n is a, c, t, g, unknown, or other
tggagctccccgcggtggcggccgctctagaactagtggatcccccgggctgcaggaattcgcacgagaccattacctagaacatcctaatcaaaaaacaccaaagatttcctcttccgcgtgcgcttccctttgccccgctctcccccagcctcgctcgccatataatacgggccggccggccggccagctgggtccccgcggatgggctcggtctcgcgaggctagggtttggtcggtcgtctcgccggcgtcgaggccgccagcgctgctagctagctnctctcgcgttagggttccccgtagccatggtgctgcagcgcttctcgtggncgtacggcggccggagcgccaccttctgcggagcttcaccgggtgggagagagtgtcccatggngctgnntcggnnccgtgttccaggtcgtcttcgatctgccccccggagtttaccagtaccggtttttggttgatggnngtctggaggtgtgatgaaacaaaaccctttgtacgggatgaatatggactgatccagaatggagggcttgggggaaacaatgaacaaccggttgtgcagccagaagccttctatcagagggaattaaaatggaaaagggtaaccatttttgaaaccaagggcccccggagccatcattctcaaa

SEQ ID NO: 20980 - protein, 63 aa, Zea mays
  misc_feature: Ceres CLONE 1389858-F
  misc_feature (2)..(2): Xaa is any aa, unknown, or other
MXVWRCDETKPFVRDEYGLIQNGGLGGNNEQPVVQPEAFYQRELKWKRVTIFETKGPRSHHSQ

SEQ ID NO: 20981 - DNA, 664 bp, Zea mays
  misc_feature: Ceres CLONE 1389860-F
  misc_feature: Translation starting site: 196
  misc_feature (469)..(469): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (486)..(486): n is a, c, t, g, unknown, or other
tggagctccccgcggtggcggccgctctagaactagtggatcccccgggctgcaggaattcgcacgagaccattacctagaacatcctaatcaaaaatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgagggtgacgtcgtcggtggcgccgtgcctcgtgtacgcgatgggcagcgcggcgtcgccctccgcgacgtgctgcagcgtagtgcgctcgctcaacagccgcgcgtcgtcggcggcgtaccggaaggccacctgcaactgactcagaagcatgacggcccgnctcgggcggggnnnncngcttggccaccgctgccacatccccgggaagtgcggcgcctcccgcggcgttgccatcaggccgggccgacggctgaaacatgatcaacggagtcgcatggaacctaggggaggtagggtcgcctccataaaggaaacccaaccctgccgacccccgcggtgcagcccaccgaaaaag

SEQ ID NO: 20982 - DNA, 995 bp, Zea mays
  misc_feature: Ceres CLONE 1389861-R2
tcgaggtcgacggtatcgataagcttttttttttttttttttggattccccaacatgtccatataaaatcaggggtttccaaaatttacaagcgcctgtttttcaaagcacaagtccggagtaaatccccaaaaaaacctttttgagggctaacacaacattttaaccggtatctgcctggaactatgccattgcctccgaaaatggaaatgaagtgatttcatacagggcatcttttttttggggaaaacaacggagcataaacttttgccaagttaacatatttaaaattcccccccttgtttttccaggcacctaaccctaattcgatcggtggggaatccaaaaaactgggggagtttatgcgtttgcaaacatggttcgacaaccccccccttttcaaggttgtaattgggccaatgcgaattgttccaacaagcaacctttttgtcctgttattgatattttccgagcgtgcgggggttcccatcaccctggaaatccgggaaagttaccttttggggcccattctggggggggtagaaaagcgatcttccatttgtttttaccattgggggggagaaggggtttttttgaggtgagaacaccccccccgcgctcttttttctctcccaagaaatttttgactatttccggaaaaaaatagtattatatgtgggtctgtttgaaggattggttttggtccaaaaagggcaattaggaactcttggcccttatagttgggcttaaatattttagagggcgcgggaaaagcttttaccctgggtatttttcccccccaaacccgaaagagagatgtggcttagatgggggcccccgttgttgaagagagaaacggggggggatcacatcaaatattgatagtgggcccacctcttttccctttgttttaccgcgaaaaaaaaaagtccccgtgggtgaatctatagtcccacaaaaggggtgtaaccgcggatgccttgagagtgtcgcct

SEQ ID NO: 20983 - DNA, 826 bp, Zea mays
  misc_feature: Ceres CLONE 1389861-R
  misc_feature: SWISSPROT Homolog: EC 2.3.1.48 Histone acetyltransferase
tgtcctattaaatcagtggtttccagaagtacaagcgcctgtttttcgaagcacaagtccagagtaaatcaccaaaaaaacctttatgagtgctaacacaacaatttaaccggtatctgcctggaactatgccattgcctccgtaaatggtaatgaagtgatttcatacatggcatctatcttttggagaaaacaacagagcataaacatttgccaagttaacatatatgaaattccaccccttgtttttccaggcacctgatcctaattcgatcggttgggaatccagaaagttagggcagttgatgcggttgcaaacatggctcgacgaggggcccacttcaatgctgtaataggaccaatgcgactgttccaacaagcaacctcttgtactgtattgatgttccaagcgtgcagtgttccatcacctgatcctgaaattacatattgaccatctggagtgaaagcagcttcatttgttacattgggagatggctctaaactaaaaccacacctcttatccccaacatatgcatccagaacatatatatggttgttagttgttgtcaaaagcatagacttgccatcattgctaaatttgatgtcagaaacttcagctgtatctccaccaaccaagaaagtgtcgaatggacccttgtcataagatcgggaatcaaataaattaatagcaccaccttccattgctacagcaaaaacaagtccctgttgatcatatgcaacagaaagtctaccacgcagccttagtatgccctgacaagcatttacccgaagatcccatattctgacactgtgatcaagggatccc

SEQ ID NO: 20984 - DNA, 687 bp, Zea mays
  misc_feature: Ceres CLONE 1389863-F
  misc_feature: Encodes the peptide sequence at SEQ ID NO. 20985
  misc_feature (401)..(401): n is a, c, t, g, unknown, or other
  misc_feature (402)..(402): n is a, c, t, g, unknown, or other
  misc_feature (431)..(431): n is a, c, t, g, unknown, or other
  misc_feature (438)..(438): n is a, c, t, g, unknown, or other
  misc_feature (448)..(448): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (521)..(521): n is a, c, t, g, unknown, or other
  misc_feature (522)..(522): n is a, c, t, g, unknown, or other
  misc_feature (547)..(547): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
aaagctggagctccccgcggtggcggccgctctagaactagtggatcccccgggctgcaggaattcgcacgagaccattacctagaacatcctaatcgaaaaagatccattgttcacgacctcaccctattcagatcccaagcggccacgcccaagcccaaaccctacccacccatctcaaccagcgatgatggcagcggagccctcgccgtcggttccctccaccgccgctgaagacatggaaaccctcgccctcgactcatcctcttcgtccgccgccgctacggcctccgcctccgaccccctccttcggccacctacctccccgaccgccgccgcgagcgacgaccccttcgtcatcgacgacttcctcgacgaggacgacttcaccgcccggcgcnncagcgtcgccggccgcccgcccccgcggncttggcngatgcggcgntccccagtgttccccaagatcaccgtatccgatcccagaagcagcgagctannnnnggggggggggggttttnncggtgttaatccccgggatccgggnagctactttttcttactcatcaccaccccgtttgcgggcgcggnnnnggggaaaaaccaagggggggggggccttcccggggaagggggggggcccttccgggggagggcccttgccggagatttcaccgggggttttat

SEQ ID NO: 20985 - protein, 82 aa, Zea mays
  misc_feature: Ceres CLONE 1389863-F
  misc_feature (21)..(21): Xaa is any aa, unknown, or other
  misc_feature (22)..(22): Xaa is any aa, unknown, or other
  misc_feature (28)..(28): Xaa is any aa, unknown, or other
  misc_feature (51)..(51): Xaa is any aa, unknown, or other
  misc_feature (52)..(52): Xaa is any aa, unknown, or other
MRRSPVFPKITVSDPRSSELXXGGGGFXGVNPRDPGSYFFLLITTPFAGAXXGKNQGGGGLPGEGGGPFRGRALAGDFTGGF

SEQ ID NO: 20986 - DNA, 651 bp, Zea mays
  misc_feature: Ceres CLONE 1389864-F
  misc_feature: Encodes the peptide sequence at SEQ ID NO. 20987
  misc_feature (430)..(430): n is a, c, t, g, unknown, or other
  misc_feature (431)..(431): n is a, c, t, g, unknown, or other
  misc_feature (443)..(443): n is a, c, t, g, unknown, or other
  misc_feature (520)..(520): n is a, c, t, g, unknown, or other
  misc_feature (567)..(567): n is a, c, t, g, unknown, or other
aaagctggagctccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaaccctaaccgccgacggtggccatgatggccaccgagcccttgtccccggggaatctcgtcgaggacgtcgaaacactacccctggactcctcctccactctcgcggctacgacggacccgctgctccgcccacctcccccctcgtccaccttctcctcccaccgccggtgagaaccatggcgcttttctggacgaggaggnnatgaggacgtgntggatgacttcacgcctccgctggctccccatgccgctacggcccgcgacgaagtcccgcgaggggtcaccggtggntcgctgagatcactgtctccgagcctaggaagcacgcggagcccggnaccggaagccgtgggcgtcattcccggctcggccagctacgtctcctactcatcgccactcggggcccgacggaggcgagttcc

SEQ ID NO: 20987 - protein, 49 aa, Zea mays
  misc_feature: Ceres CLONE 1389864-F
MMATEPLSPGNLVEDVETLPLDSSSTLAATTDPLLRPPPPSSTFSSHRR

SEQ ID NO: 20988 - DNA, 682 bp, Zea mays
  misc_feature: Ceres CLONE 1389865-F
  misc_feature (293)..(293): n is a, c, t, g, unknown, or other
  misc_feature (329)..(329): n is a, c, t, g, unknown, or other
  misc_feature (330)..(330): n is a, c, t, g, unknown, or other
  misc_feature (388)..(388): n is a, c, t, g, unknown, or other
  misc_feature (398)..(398): n is a, c, t, g, unknown, or other
aaagctggagctccccgcggtggcggccgctctagaactagtggatcccccgggctgcaggaattcgcacgagaccattacctagaacatcctaatcgaaaaatatacccccgtcccatcgtatacgaatcacagacaaagcacgagcggtggtagctggccagccaccatggctccaccacctctgttcccgctcccgcctctcctcatcctcctcgtcatcgtgcctctgttccccaccgccgcgccgacggccacgacgctgccgctgtaccgccacctaccgcacgtangccgaggccgtggcatcgcaccaccacccgctgtcnncgctggacgtccgcgtcgctgggcccccgcgcgtgcacctcaagcggccgggaccccnatcacacagncagaaaggatccagcggccacccgtcagtaccagcacccgccggggtgtaccggatttcctacggggggtaaccccttcagggggtcaatcgggaaggcggccgaaaccgtttcccgggggggttaaaaccggaaccaacttccgggggggtgcctgggaccccaaattaaaagggccgaaaatggttcctccccttccccttcgggggggccgggttttaccacaaaaaaatctccctctccccccggggggggggggccgcaccccccctccgcgaatggtc

SEQ ID NO: 20989 - DNA, 652 bp, Zea mays
  misc_feature: Ceres CLONE 1389866-F
  misc_feature: Encodes the peptide sequence at SEQ ID NO. 20990
  misc_feature (543)..(543): n is a, c, t, g, unknown, or other
  misc_feature (571)..(571): n is a, c, t, g, unknown, or other
aagctggagctccccgcggtggcggccgctctagaactagtggatcccccgggctgcaggaattcgcacgagaccattacctagaacatcctaatcgaaaaacagcgaaccacccatggacctcgccaccactgccgtctccctccaccttttcctcacccggtccgcctccgtgttctgtgtacgccgcgtcctcccatgcctcctcctccgaggcacttcgtccacctcacgcctccccggtacttcaacatcaccttcgcggagcccgcgacgtcctaaaaggacccgtacgcgcagccgatgctcccgtgcatcgtccgtgtggaggacgataagccccgcctcagcacctccccgtcgcgggacgataatctagtccatcgcgctcgcgtaggtggagtacaagaaggccgccaagaaggaaaccctcaagggcaaaaatggagcagttgccgcctccgccgcgtctgcttgcaatgtcagcgtcaagcctatggaaaggacgcccgccacgaccgtgccgcccaagttctccaaganagtcaggaggtcatacaatggagatatncagggagcggtagccgcaacggctcgacaatggtccttgccggccgcaagagtggcatcaagaaaggacagggaggagctc

SEQ ID NO: 20990 - protein, 87 aa, Zea mays
  misc_feature: Ceres CLONE 1389866-F
MDLATTAVSLHLFLTRSASVFCVRRVLPCLLLRGTSSTSRLPGTSTSPSRSPRRPKRTRTRSRCSRASSVWRTISPASAPPRRGTII

SEQ ID NO: 20991 - DNA, 606 bp, Zea mays
  misc_feature: Ceres CLONE 1389867-F
  misc_feature: Pfam Name: ILVD_EDD Pfam Description: Dehydratase family
  misc_feature (346)..(346): n is a, c, t, g, unknown, or other
  misc_feature (348)..(348): n is a, c, t, g, unknown, or other
  misc_feature (349)..(349): n is a, c, t, g, unknown, or other
  misc_feature (357)..(357): n is a, c, t, g, unknown, or other
  misc_feature (452)..(452): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (491)..(491): n is a, c, t, g, unknown, or other
  misc_feature (495)..(495): n is a, c, t, g, unknown, or other
  misc_feature (512)..(512): n is a, c, t, g, unknown, or other
  misc_feature (590)..(590): n is a, c, t, g, unknown, or other
tccccgcggtggcggccgctctagaactagtggatcccccgggctgcaggaattcgcacgagaccattacctagaacatcctaatcgaaaaaacccggctgtgctgtctcgtcgccttcctcccctcctgccggctgctgccgccgccagccgctgcaggcacgcttgccctctgctccctgtccatccactcatcattccccgtcatccaccaattcacaacccaaaaccctaaacccatttacctcaacgccaccgccgccgccgcgatgcagtccatggcgcccacctctccctcactcccggtggcaggccccgttccccgccgccgcctccagcgcgccgngnnccgccgcnggtctccgacgagcccaaactcaacaagtacagcgcgcgcatcacggagccccaagtcgcaggcccgcctcgcaggcgtgctcctacggggtggncctcccgcggacgccgacctcgnnnaggcggaggtcggngtcnctttcggggtggtacgnggggaacccctggcacatgcacctgctccgccctcgcgaggccgcccgcgacggcgtccgggaggccggaatggtccncttttcgattcaaccg

SEQ ID NO: 20992 - DNA, 629 bp, Zea mays
  misc_feature: Ceres CLONE 1389870-F
  misc_feature (228)..(228): n is a, c, t, g, unknown, or other
  misc_feature (242)..(242): n is a, c, t, g, unknown, or other
  misc_feature (323)..(323): n is a, c, t, g, unknown, or other
  misc_feature (454)..(454): n is a, c, t, g, unknown, or other
ggagctccccgcggtggcggccgctctagaactagtggatcccccgggctgcaggaattcgcacgagaccattacctagaacatcctaatcgaaaaatcaagttttgtagtgttgttagtgtttctaccgtatgtctgatttgtactttattagtacttaagtctgtctttgagaaatataagatactagtctgttcactgaagaatgtggccttaaacactagtttngatttcagggtggnttatgtctttatcgcctcttctggaaccagaggagaaaactgtgcgctccagccagaaaaatggataggagtggaactcgnctactactccccggtcttccgtggccaccagaggccaatgagggaggtaataccccgttaataagaaatctctagaatctgctctggatgattcgaatgagctgcccaattctggtgaaacccctggtggncacagggaaatgtgcctggcggacagaaaagataaatttgggggtactgggcccgcgtggtttccatatacctttccccggagatggtgcgtggtggagactaagatttgaccttctggttgtgggttctgccccctttttgtatcccccgaaatggggatggcgcctgcgccaa

SEQ ID NO: 20993 - DNA, 682 bp, Zea mays
  misc_feature: Ceres CLONE 1389873-F
  misc_feature: Translation starting site: 225
  misc_feature: SWISSPROT Homolog: EC 1.1.1.40 Malate dehydrogenase (oxaloacetate-decarboxylating) (NADP(+))
  misc_feature (342)..(342): n is a, c, t, g, unknown, or other
  misc_feature (360)..(360): n is a, c, t, g, unknown, or other
  misc_feature (361)..(361): n is a, c, t, g, unknown, or other
  misc_feature (392)..(392): n is a, c, t, g, unknown, or other
  misc_feature (432)..(432): n is a, c, t, g, unknown, or other
  misc_feature (524)..(524): n is a, c, t, g, unknown, or other
  misc_feature (569)..(569): n is a, c, t, g, unknown, or other
  misc_feature (570)..(570): n is a, c, t, g, unknown, or other
  misc_feature (626)..(626): n is a, c, t, g, unknown, or other
  misc_feature (682)..(682): n is a, c, t, g, unknown, or other
tggagctccccgcggtggcggccgctctagaactagtggatcccccgggctgcaggaattcgcacgagaccattacctagaacatcctaatcgaaaaacatccgtcttcctcctgtaaccagatctgaacccgcggcgacagaaacaaacgctcgctcgctcgttcgttgtccgttcattgtcttcgccggcgccgagggaccctgagagggcaggcggacgagatggcgggcggcggcgttgaggacgtgtacggcgaggaccgcgctaccgaggagcagctgcatcacgccgtgggccttctccgtcgcaagcggctacaccctgctgcgcgacccgcgncacaacaagggcctggcnncttctcggaggcgggagcgcgacgcgcactnactctccggggcctgctgcccgcgggcgctgtgggcgtcncagggagcttgcagggagaaagaagctcatggcagaacctggcgccggtacgagcagcccgctgcaccgctacttccgccatgatgggaccntgcaggagccgcaacgagaggctcttctacaagctcctcatcgannaacggtcgaggagctggctcccccgtcgtctacacgccccaccggtcggcgagggnatgccagaaagtacggcagcatctacggccggcccggcagggggctgtacatcagn

SEQ ID NO: 20994 - DNA, 659 bp, Zea mays
  misc_feature: Ceres CLONE 1389876-F
  misc_feature: Encodes the peptide sequence at SEQ ID NO. 20995
  misc_feature (388)..(388): n is a, c, t, g, unknown, or other
  misc_feature (473)..(473): n is a, c, t, g, unknown, or other
aagctggagctccccgcggtggcggccgctctagaactagtggatcccccgggctgcaggaattcgcacgagaccattacctagaacatcctaatcgaaaaccacagcctccccagcatcagtgaagctcgctcaccgtcattcgacgacgccctcccgcacacacgaccatggccgcggcgatgaccggcagtgctcgcgccagcaccggctccttgctcgtgcttctcttcgtcgcgctggccggcgcgaccgccggggcgagtgccaccgttgccttcagcagcggcgacagcaacgcggcggcgctgctgacgacgccagcatcggcgtccccggggcagctgaacggcatcatccagtgccttatgggctgcttcacgcaggntggttcggctggttcgttcggatgcatgggcaagcagggcgctgacctgccgctctgcatcatcagctgcgaccagaagaagcgntcgtgtgcatggtcagctgcgggccttgcgccgtcaccgccatcaccgtcgccgcccacgcccaaaccaccagcacccaagccgcccacgcccaagccgcccggccgctaaaaacccccggcgtaaggccggcggtggcgtcaccggacgacatctgggctgaatatgtcgacatgtgcctgccag

SEQ ID NO: 20995 - protein, 137 aa, Zea mays
  misc_feature: Ceres CLONE 1389876-F
  misc_feature (73)..(73): Xaa is any aa, unknown, or other
MAAAMTGSARASTGSLLVLLFVALAGATAGASATVAFSSGDSNAAALLTTPASASPGQLNGIIQCLMGCFTQXGSAGSFGCMGKQGADLPLCIISCDQKKRSCAWSAAGLAPSPPSPSPPTPKPPAPKPPTPKPPGR

SEQ ID NO: 20996 - DNA, 739 bp, Zea mays
  misc_feature: Ceres CLONE 1389877-R
  misc_feature: Pfam Name: Pterin_bind Pfam Description: Pterin binding enzyme
  misc_feature: SWISSPROT Homolog: EC 2.5.1.15 Dihydropteroate synthase
  misc_feature (1)..(1): n is a, c, t, g, unknown, or other
ncgattgggtaccgggccccccctcgaggtcgacggtatcgataagcttttttttttttttttttcttttttttttttttttttttttttttttttttttttttttttttttttttttttgaggagcagcttcttgactttattccttggggacccaagaaaaagcattatctctggttcattacaacaacgatacttcacaaatcacatttttcgacatcacttttttcttgtataaaactggagcgatagttcagtttctgcaacttcccttacgcttacgcaatggatcacaaacctttgcggcgtctaccccatatccagcattatggactcttacaatgttagcaccattcaaaatcccagctgtcacggctgcaacagtaacaacatctctctcaactggattggcacgattgcatatttcacccaaaaagcttttccttgaaggtcccagtaatattggcacatgtgaagcacctatacccattttacccatctcccccccaatggattccaatcccataattacttcaaggttatgttcaaatttcttggaaaagccaatgccaggatcaagaaccagcctccacaatggaatcccagaaaactctgcttctctcacctgtgtgtatagctccaaagcaacttccttgcagacattatcatagtgaacattttggtcgctttgcatagttgacggatctcccctcatgtgcattgcaacatatggaactcc

SEQ ID NO: 20997 - DNA, 662 bp, Zea mays
  misc_feature: Ceres CLONE 1389877-F
  misc_feature: Encodes the peptide sequence at SEQ ID NO. 20998
  misc_feature (377)..(377): n is a, c, t, g, unknown, or other
  misc_feature (400)..(400): n is a, c, t, g, unknown, or other
  misc_feature (423)..(423): n is a, c, t, g, unknown, or other
  misc_feature (428)..(428): n is a, c, t, g, unknown, or other
  misc_feature (434)..(434): n is a, c, t, g, unknown, or other
  misc_feature (435)..(435): n is a, c, t, g, unknown, or other
  misc_feature (450)..(450): n is a, c, t, g, unknown, or other
  misc_feature (489)..(489): n is a, c, t, g, unknown, or other
  misc_feature (538)..(538): n is a, c, t, g, unknown, or other
  misc_feature (563)..(563): n is a, c, t, g, unknown, or other
  misc_feature (584)..(584): n is a, c, t, g, unknown, or other
  misc_feature (613)..(613): n is a, c, t, g, unknown, or other
  misc_feature (615)..(615): n is a, c, t, g, unknown, or other
  misc_feature (633)..(633): n is a, c, t, g, unknown, or other
  misc_feature (660)..(660): n is a, c, t, g, unknown, or other
tggagctccccgcggtggcggccgctctagaactagtggatcccccgggctgcaggaattcgcacgagaccattacctagaacatcctaatcgaaaactgggaggcagagacgaaagcctactagcttccctttgggtcggtctcgcgctcccgctgcgcgtctgtctgtctgtctgtcttggagcctcatcaatggctaccatcagagaggagtccgactacgacagcagccggtcctcgctgacggcgccgggcggctcccgccggagctggatcagcgacattggcagcgccagctcggtctcggcgcgctccgtggcggggcgaggctgggacgcgccggcgtgccgccaccgccacaagcctcacaaggcgnaacccaggccgagtgggaggccnatcgggcgcgtccgccgccgccngcggnccgcgnntcggcctggagcacnttccgcctggtgcggcgcctggggcagcggcgaccctcngggaacgtctacctctgccagctgcgcgagccctggtcccaccacgggngtgcctgtacgccatgaaaggtggnggacaaggaccgcgctggcgntccgcaagaaagctgcggcgccgggaagngnaaccccaaaatcctcccnggggtccgacacccctttcctccccanaa

SEQ ID NO: 20998 - protein, 155 aa, Zea mays
  misc_feature: Ceres CLONE 1389877-F
  misc_feature (62)..(62): Xaa is any aa, unknown, or other
  misc_feature (77)..(77): Xaa is any aa, unknown, or other
  misc_feature (79)..(79): Xaa is any aa, unknown, or other
  misc_feature (81)..(81): Xaa is any aa, unknown, or other
  misc_feature (86)..(86): Xaa is any aa, unknown, or other
  misc_feature (99)..(99): Xaa is any aa, unknown, or other
  misc_feature (124)..(124): Xaa is any aa, unknown, or other
  misc_feature (131)..(131): Xaa is any aa, unknown, or other
  misc_feature (140)..(140): Xaa is any aa, unknown, or other
  misc_feature (141)..(141): Xaa is any aa, unknown, or other
  misc_feature (147)..(147): Xaa is any aa, unknown, or other
MATIREESDYDSSRSSLTAPGGSRRSWISDIGSASSVSARSVAGRGWDAPACRHRHKPHKAXPRPSGRPIGRVRRRXRXAXRPGAXSAWCGAWGSGDPXGTSTSASCASPGPTTGVPVRHERWXTRTALAXRKKAAAPGXXTPKSSXGSDTPFLP

SEQ ID NO: 20999 - DNA, 696 bp, Zea mays
  misc_feature: Ceres CLONE 1389879-F
  misc_feature: Encodes the peptide sequence at SEQ ID NO. 21000
  misc_feature (696)..(696): n is a, c, t, g, unknown, or other
gagctccccgcggtggcggccgctctagaactagtggatcccccgggctgcaggaattcgcacgagaccattacctagaacatcctaatcgaaaaatgccacattgccaccaagccacagttccacctttcgattcatgcacactcagtcatgggcgctctccggagtttagccatctcatacccgaagttcttcgtgaccgcattgtgcttcgtctccctctcggccctgcgctacgcgatgccagagcggcgtcaacgcacctccctgagctggcctgtgttgcccatgctctcgttcgagatcccaaacctcgggccgctctacgaggccataacaaacgccatccccgggacccggtgaacgctcacgttaccggggacgcgttcctcaaacccggatacacctacttgacgggcgaccacgcgcccccaccagcattggctgcgccgccaaccacccgcgcctaccacccggcacccaaaacttttccccgcgctcgcccgaacatcgatggggcgacgggagttctagctacatcagaacaagcgagaaagggatatatccttaacacgccccctcacgcccgacaaacgcacgcaccaccacatccgacgcactacccaacagccatccccccaaaacagcaacaacaacacgaagagcaacagaccacccaaacagccaccccccccn

SEQ ID NO: 21000 - protein, 70 aa, Zea mays
  misc_feature: Ceres CLONE 1389879-F
MGALRSLAISYPKFFVTALCFVSLSALRYAMPERRQRTSLSWPVLPMLSFEIPNLGPLYEAITNAIPGTR

SEQ ID NO: 21001 - DNA, 698 bp, Zea mays
  misc_feature: Ceres CLONE 1389880-F
  misc_feature: Encodes the peptide sequence at SEQ ID NO. 21002
  misc_feature (330)..(330): n is a, c, t, g, unknown, or other
  misc_feature (381)..(381): n is a, c, t, g, unknown, or other
  misc_feature (480)..(480): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (539)..(539): n is a, c, t, g, unknown, or other
  misc_feature (540)..(540): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (554)..(554): n is a, c, t, g, unknown, or other
  misc_feature (555)..(555): n is a, c, t, g, unknown, or other
  misc_feature (557)..(557): n is a, c, t, g, unknown, or other
  misc_feature (558)..(558): n is a, c, t, g, unknown, or other
tccccgcggtggcggccgctctagaactagtggatcccccgggctgcaggaattcgcacgagaccattacctagaacatcctaatcgaaaaatcttttcctttcctatccctcgtctcgtctcgtcttcgttcccctttcctcctgcgcaccccgtcttctcctcaccgcgtcaaaccccagcacaaatcaaccgcccgccgcctccgctcccctcccgtcccgaatcagccgccgcggtgcccaatccggccgatcccccctcctatccgccgcagagtcggcgcctctgggcctaccccgatgtatagcaacttcaaggagcaggcgnatcgagtacgtcaagcaggcggtccaggaggacaatgccggcaactaccgntcaaggcgttccctctctacatgaacgcgctcgagtacttcaagacccatctcaagtacgagaagaaccccaaggatcaaggaggccatcaccgccagnttcaccgagtactccgccgcggcgagggagaaatccgggccgccctcgacaagnnnngnnggcggggnnnccgnngnncccaacggaaggtggaacggaagcccgtcgcccacgcgcccccaagacccagggggcaagggaaccgggggacggggggccaaacgggagggggatgaaactcccgaagcagccccaaggcctcaaggggcggggggctc

SEQ ID NO: 21002 - protein, 117 aa, Zea mays
  misc_feature: Ceres CLONE 1389880-F
  misc_feature (10)..(10): Xaa is any aa, unknown, or other
  misc_feature (27)..(27): Xaa is any aa, unknown, or other
  misc_feature (60)..(60): Xaa is any aa, unknown, or other
  misc_feature (78)..(78): Xaa is any aa, unknown, or other
  misc_feature (79)..(79): Xaa is any aa, unknown, or other
  misc_feature (80)..(80): Xaa is any aa, unknown, or other
  misc_feature (83)..(83): Xaa is any aa, unknown, or other
  misc_feature (85)..(85): Xaa is any aa, unknown, or other
  misc_feature (86)..(86): Xaa is any aa, unknown, or other
MYSNFKEQAXRVRQAGGPGGQCRQLPXKAFPLYMNALEYFKTHLKYEKNPKDQGGHHRQXHRVLRRGEGEIRAALDKXXXRGXRXXQRKVERKPVAHAPPRPRGQGNRGTGGQTGGG

SEQ ID NO: 21003 - DNA, 647 bp, Zea mays
  misc_feature: Ceres CLONE 1389881-F
  misc_feature (390)..(390): n is a, c, t, g, unknown, or other
tggagctccccgcggtggcggccgctctagaactagtggatcccccgggctgcaggaattcgcacgagaccattacctagaacatcctaatcgaaaaaccggggtttcggacaagcgtctctctccctctctagtctctactgcttctccgacgacggcggctctccgagtccggtatcgccgtctccccatcgttgtcgtcggaattaggttcatcacagcgtcgcgttctcctatgtacgtcgtcacgctcaaaggctggaagcgccggccgtcgagcaacaaggctgtttggcccaagcacgcagtccacggaggggccactaccacacggagtggattccgccacccgagaagtcacatttacttcccccagccgccagacaatantacctaccagttccaggcagagacagccttccccttccgccatggcggcctccgccgcagctcatcgtagatctgcacgaaggttaggacgacgtacggagagggcagagctcgaggcgctcagggacgccccggtcgaaggaggctcacgcgcggtcctttggaccgacgtccgcgtctactcttgtccggcctccgggtttctccggggaaggatgaaggggctggtcgtttgccgagaaggacgtgatggaaca

SEQ ID NO: 21004 - DNA, 659 bp, Zea mays
  misc_feature: Ceres CLONE 1389884-F
  misc_feature: Translation starting site: 181
  misc_feature: Pfam Name: TruD Pfam Description: tRNA pseudouridine synthase D (TruD)
  misc_feature (207)..(207): n is a, c, t, g, unknown, or other
  misc_feature (401)..(401): n is a, c, t, g, unknown, or other
  misc_feature (455)..(455): n is a, c, t, g, unknown, or other
tccccgcggtggcggccgctctagaactagtggatcccccgggctgcaggaattcgcacgagaccattacctagaacatcctaatcaaaaacacaggaaatcgatttacaattactctgaggggtgttactgcagaatctgaagacatgataaaaattgcagtagatggcctaggaaagaatggatttatcaactactatggtttgncagcggtttggaagtggttcaataccaacacatcttgttgggtctgctttgcttagaggagagtggaaggttgctgtaaacttgattcttgatccaagggaaggagagcgtgatgacatcaatgaggtgcgcaaacgttacaaagaacatggtgacattgatatggcactgagaaacttccctcgaccctcgtnagctgagagggccatacttcaatgtctgaagaaatgccctggtaaccatctacnagcactcaagggtataccaagaacactggagaatgatgtacgtacatagttaccaaagttatctgtggaatcatggctgccagtatgagagtggaaagcatctcacagggttgtagaaggtgacttagtgtataacaaagaatgcccttcagaagaatcaacttccgtagatattctggaaactgatgatgaccatacaaattc

SEQ ID NO: 21005 - DNA, 659 bp, Zea mays
  misc_feature: Ceres CLONE 1389889-F
  misc_feature: Encodes the peptide sequence at SEQ ID NO. 21006
  misc_feature (168)..(168): n is a, c, t, g, unknown, or other
  misc_feature (264)..(264): n is a, c, t, g, unknown, or other
  misc_feature (293)..(293): n is a, c, t, g, unknown, or other
  misc_feature (297)..(297): n is a, c, t, g, unknown, or other
  misc_feature (300)..(300): n is a, c, t, g, unknown, or other
  misc_feature (303)..(303): n is a, c, t, g, unknown, or other
  misc_feature (308)..(308): n is a, c, t, g, unknown, or other
  misc_feature (313)..(313): n is a, c, t, g, unknown, or other
  misc_feature (316)..(316): n is a, c, t, g, unknown, or other
  misc_feature (388)..(388): n is a, c, t, g, unknown, or other
tggagctccccgcggtggcggccgctctagaactagtggatcccccgggctgcaggaattcgcacgagaccattacctagaacatcctaatcaaaaattttccaaatccgtctacgccctcacgcacgcggcccaactagcctaacaaaccctagctagatttagaanaaaagtttgtccccaatccgaaccgacgaggagctcgccgccgtgagatgtccgagtacgacgagcgctaccagggcacgccgacatgcccgcagncgaaggcggctatccgcaggccgagtacngcgncgncgncgcgnctggncgncgggggttcgccgcccgcagacaagcaggccttcggggttctccgaccacggcgaggggcgctcctcccagnaccaggatgagaacacatcacatgggcagtgggtcctcggaatctcgagaaagggaccgagaacgcgataagggcaaggattaggagcgtgacaaggagttcttgggccagaaaaagggggggggaccgagacaggggttaaagggtcctgggaaaaaaaaggaacaaaacaaagaatttcgttccgcccccccagggacccattaggagcgccacgagaaaaggaaaacaccggggtttgtttttgttgattgtggaccgccccccgggg

SEQ ID NO: 21006 - protein, 72 aa, Zea mays
  misc_feature: Ceres CLONE 1389889-F
  misc_feature (4)..(4): Xaa is any aa, unknown, or other
  misc_feature (14)..(14): Xaa is any aa, unknown, or other
  misc_feature (15)..(15): Xaa is any aa, unknown, or other
  misc_feature (16)..(16): Xaa is any aa, unknown, or other
  misc_feature (17)..(17): Xaa is any aa, unknown, or other
  misc_feature (19)..(19): Xaa is any aa, unknown, or other
  misc_feature (45)..(45): Xaa is any aa, unknown, or other
MPAXEGGYPQAEYXXXXAXGRRGFAARRQAGLRGSPTTARGAPPXTRMRTHHMGSGSSESRERDRERDKGKD

SEQ ID NO: 21007 - DNA, 675 bp, Zea mays
  misc_feature: Ceres CLONE 1389893-F
  misc_feature: Encodes the peptide sequence at SEQ ID NO. 21008
aagctggagctccccgcggtggcggccgctctagaactagtggatcccccgggctgcaggaattcgcacgagaccattacctagaacatcctaatcgaaaaattgattttgagtgcatctttcgccgtcgtcgcgcgtgatctctccttgtcgctgaccgcacccgcctgtcccgccattcttgcgctccggatacagggccctcatagagcctccgataaatctgccccccgcattggatgtgtcgccgcacatctcatgctggaggaaattgtccacttcatttgacttctcactctacgactgataacagagtgtctttgaaggcgcggaaaagacttacgtgatctgtcgatcgaatgaagataggaacacgtctgctgtgaactacacgaccagctcactacagatgcgagctcacccataatacttgttgaacagcgacttctaaccaagccacagtctgtgattcctggacagtgatgacaagatattagtatcggagaagggtgttctcttgaatgaagtccatctggttccttgagatagacaccccctttgttaagcaacaacggaagatcaggaaaacagaagttgtttcttgggagcagggagtaaatcggcgtcggcaaaaagcagttgggggatagggggcccttcggttggttgtacagg

SEQ ID NO: 21008 - protein, 42 aa, Zea mays
  misc_feature: Ceres CLONE 1389893-F
MKSIWFLEIDTPFVKQQRKIRKTEVVSWEQGVNRRRQKAVGG

SEQ ID NO: 21009 - DNA, 684 bp, Zea mays
  misc_feature: Ceres CLONE 1389894-F
  misc_feature: Encodes the peptide sequence at SEQ ID NO. 21010
  misc_feature (260)..(260): n is a, c, t, g, unknown, or other
  misc_feature (430)..(430): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (446)..(446): n is a, c, t, g, unknown, or other
  misc_feature (449)..(449): n is a, c, t, g, unknown, or other
tggagctccccgcggtggcggccgctctagaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacaaggaggaggaggacgaggcgaaggncgcggagaagatgtgcggcatctgcttatctcgacggccggcgggccatccgcggcgagctcgactgctgcgcccatttctttttgctttgtcgcatccatggcttggggcccgcgccaaaggtcccgctgtcccctttctgcagggcccgcttccacaccatccgccgnccgnnncgtnnnnccnggncggtttcccccgaacgagcgaaaatcgtcctcgatcccaagaggggcaacccagttacaccatcctccaggggaaaacggagcagcaaatgggggggggggaaaaatcctttaggtgaacacatattggggaccgggtttggcaacaactctccggggatggaataagttgctgggtaaatctgggggagttccggggaaatcaactggacccacctttaatgggggggcggggt

SEQ ID NO: 21010 - protein, 167 aa, Zea mays
  misc_feature: Ceres CLONE 1389894-F
  misc_feature (50)..(50): Xaa is any aa, unknown, or other
  misc_feature (108)..(108): Xaa is any aa, unknown, or other
  misc_feature (110)..(110): Xaa is any aa, unknown, or other
  misc_feature (111)..(111): Xaa is any aa, unknown, or other
  misc_feature (112)..(112): Xaa is any aa, unknown, or other
  misc_feature (113)..(113): Xaa is any aa, unknown, or other
MVSLRSDAPDPPPHPSWLPSPTSTPRHFRRPSHPKARARWTRRRRTRRRXRRRCAASAYLDGRRAIRGELDCCAHFFLLCRIHGLGPAPKVPLSPFCRARFHTIRRPXRXXXXVSPERAKIVLDPKRGNPVTPSSRGKRSSKWGGGKNPLGEHILGTGFGNNSPGME

SEQ ID NO: 21011 - DNA, 652 bp, Zea mays
  misc_feature: Ceres CLONE 1389899-F
  misc_feature: Encodes the peptide sequence at SEQ ID NO. 21012
  misc_feature (386)..(386): n is a, c, t, g, unknown, or other
  misc_feature (421)..(421): n is a, c, t, g, unknown, or other
  misc_feature (444)..(444): n is a, c, t, g, unknown, or other
tggagctccccgcggtggcggccgctctagaatagtggatcccccgggctgcaggaattcgcacgagaccattacctagaacatcctaatcgaaaaagttcgccaccatcgtgctccgtacacgctccgctccggccatggccgccgccgcggcctccttttcggccctgccgttccttctacttttgctgctggtgccgtcgctcgacggcgcctccaatgtgacgtacgaccaccgctccctcatcatctccggccgccgccgcctcgtcatctccacctccatccactacccccgcagcgtccccgagatgtggcccaagctggtggctgaagccaaggacggcggcgccgactgcatcgagacctacgtcttctggaacggncatgagatcgccccaggccagtactacttcgaggnaccggttgacctggtggggttcntggaagtcgttaaagacgctgggctgctcctgatcctgcgcatcgggccctatgtcgccggcgagtggattattggagcgggcccggggtggtttccctacgggccaggaaaggtttttccggacaaacaggggccctttcagaacctttggaggggttccccaaccacattgcgggaaatagagaaaaaaaaaccagctcttccctt

SEQ ID NO: 21012 - protein, 171 aa, Zea mays
  misc_feature: Ceres CLONE 1389899-F
  misc_feature (35)..(167): Pfam Name: Glyco_hydro_35 Pfam Description: Glycosyl hydrolases family 35
  misc_feature: SWISSPROT Homolog: EC 3.2.1.23 Beta-galactosidase
  misc_feature (95)..(95): Xaa is any aa, unknown, or other
  misc_feature (103)..(103): Xaa is any aa, unknown, or other
MAAAAASFSALPFLLLLLLVPSLDGASNVTYDHRSLIISGRRRLVISTSIHYPRSVPEMWPKLVAEAKDGGADCIETYVFWNGHEIAPGQYYFEXPVDLVGFXEVVKDAGLLLILRIGPYVAGEWIIGAGPGWFPYGPGKVFPDKQGPFQNLWRGSPTTLREIEKKKPALP

SEQ ID NO: 21013 - DNA, 651 bp, Zea mays
  misc_feature: Ceres CLONE 1389900-F
  misc_feature: Encodes the peptide sequence at SEQ ID NO. 21014
  misc_feature (376)..(376): n is a, c, t, g, unknown, or other
tggagctccccgcggtggcggccgctctagaactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcgtctgtctgcgcacgcgcgaggtcagtgagtgagcattgcggtggtccgatcgcccgcggggggccatggcgtctgtggcgggatcgggcggcgggcaagcgcgggggccggntgggttgaagacttacttcaagacccccgaggggcggcacaagctgcagtacgagaaaacgactccccccgccgtcgtgcactacaaccacaacggcaagacgtcgccccagatgacggtggcatattttgaaggagaagcagcaaggccagggtttcacgccttcacaccaagtggctggtagtggggatgcggtctgcagctgcgagactgcttggaactgggaaatggtagccggacacttagcttcgggagcaatggtacccaggagggct

SEQ ID NO: 21014 - protein, 76 aa, Zea mays
  misc_feature: Ceres CLONE 1389900-F
  misc_feature (16)..(16): Xaa is any aa, unknown, or other
MASVAGSGGGQARGPXGLKTYFKTPEGRHKLQYEKTTPPAVVHYNHNGKTSPQMTVAYFEGEAARPGFHAFTPSGW

SEQ ID NO: 21015 - DNA, 626 bp, Zea mays
  misc_feature: Ceres CLONE 1389901-F
  misc_feature: Encodes the peptide sequence at SEQ ID NO. 21016
  misc_feature (255)..(255): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (422)..(422): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (447)..(447): n is a, c, t, g, unknown, or other
  misc_feature (448)..(448): n is a, c, t, g, unknown, or other
  misc_feature (452)..(452): n is a, c, t, g, unknown, or other
  misc_feature (453)..(453): n is a, c, t, g, unknown, or other
  misc_feature (477)..(477): n is a, c, t, g, unknown, or other
  misc_feature (478)..(478): n is a, c, t, g, unknown, or other
tggagctccccgcggtggcggccgctctagaactagtggatcccccgggctgcaggaattcgcacgagaccattacctagaacatcctaaaaaaaaaacggttaaacccatgccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgnctgcggaggtgcctgcggcgccacaggaagcgaagtcgaagccgaagccacggcggtacccgaagcatacccccggcgagtcggtgggcgttgctgaggagatgcgctttgtcgccatgcgcctgcgtaaccccagcgcaccacataaaagacaagtcgnnngacgnaggacgcgacgccggnnnngggggnngtcnnaggccgaggttgaggaggacaacnncggcgcctgaagggagaacccgggggggggaggggggggctccgggaagggaatggtcccaccttgggggggggttcggggataccggggggaagaaagtccgtcttggaacatcgaagggggtggggccaaaccacggatggccctg

SEQ ID NO: 21016 - protein, 80 aa, Zea mays
  misc_feature: Ceres CLONE 1389901-F
  misc_feature (49)..(49): Xaa is any aa, unknown, or other
MPLIDAAASAVAPPPPRRVAQLRFFSTRRPGILSLTATSCSPSPPPPVXCGGACGATGSEVEAEATAVPEAYPRRVGGRC

SEQ ID NO: 21017 - DNA, 660 bp, Zea mays
  misc_feature: Ceres CLONE 1389904-F
  misc_feature: Encodes the peptide sequence at SEQ ID NO. 21018
aaagctggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcctgcgtccgagcgagcgggtcgaggtacggcggaaccgctacaaggtggcggttcacgcgtaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaaagagttatcaaaacaggtgtagttccaagatttgtgcagtctctcaccagagaggatttcccccagctgcagtttgaagctg

SEQ ID NO: 21018 - protein, 101 aa, Zea mays
  misc_feature: Ceres CLONE 1389904-F
  misc_feature (1)..(60): Pfam Name: IBB Pfam Description: Importin beta binding domain
MVEIRKSRREESLLKRRREGLQAQVPAPPSGVEKKLESLPAMVSGVYSDDNNLQLEATTQFRKLLSIERSPPIERVIKTGVVPRFVQSLTREDFPQLQFEA

SEQ ID NO: 21019 - DNA, 655 bp, Zea mays
  misc_feature: Ceres CLONE 1389905-F
  misc_feature: Encodes the peptide sequence at SEQ ID NO. 21020
agagctggagctccccgcggtggcggccgctctagaactagtggatcccccgggctgcaggaattcgcacgagaccattacctagaacatcctaatcgaaaaaagatggccggcgaacccagcgccgccgtggcatcggggcccgaatccgcggccgaggccgaccgcctcctggcgctggccgagtcggagctctccgcgggcaggctccgagccgcgcgcaggcacgccctccgcgccgcccgcctgtacccgacctccccgcgcgccccggtgctggccaccgccgccaacgtgctcctcgccgacgcctcctcccaccacgccgcgctgctgctgcccgaacccgacgaccccgacgcctcgccgctctccgcctccgagctccgccgccactttaagtcgctcgtcaagtccctccgcgtaggcctcgacgccgccaccgcagccgcctacccctccgtcgcccgcgccgctgaggaggcactcggccgcgccaccgaggcctacgaggcgctcaccgcccctgcccctggggaccttctggaccgcctgcgccgggtggccgctcctccacgagttccagcgcaagtatggtgggaaaccggctcgcctgcccatcctggcgccgaacccttcatcgccgtgggaggcc

SEQ ID NO: 21020 - protein, 183 aa, Zea mays
  misc_feature: Ceres CLONE 1389905-F
MAGEPSAAVASGPESAAEADRLLALAESELSAGRLRAARRHALRAARLYPTSPRAPVLATAANVLLADASSHHAALLLPEPDDPDASPLSASELRRHFKSLVKSLRVGLDAATAAAYPSVARAAEEALGRATEAYEALTAPAPGDLLDRLRRVAAPPRVPAQVWWETGSPAHPGAEPFIAVGG

SEQ ID NO: 21021 - DNA, 655 bp, Zea mays
  misc_feature: Ceres CLONE 1389906-F
  misc_feature: Encodes the peptide sequence at SEQ ID NO. 21022
tggagctccccgcggtggcggccgctctagaactagtggatcccccgggctgcaggaattcgcacgagaccattacctagaacatcctaatcaaaaacatttcctctctctctttctctaactccgggtccctctctcctctctctattctctccatccttgcttctgggaagctcatcagccatggacgatgccactgcagaagaagaagcttccatgttcgagaccagccatgtcctcggcgccctgctggactcctcgccgttgctggcgcgcgcctgggaccgctgcacagccgcctccgccgcagcgccgtgtctcgttcacggcgaatacggcggcaaggtgtacgtgggtttctctgtggtgcaggctgcgcttacggcgcaggcgcggcggtgaccggcggcgacgccgacatcttcgcgccgggagtctcggcggtgacccgggggagcggatggtcccgccccttgtcgccagcgaaccccgacccgtccggtaccggggagccggttggcttggcaacgatgaccctgcaccctttcctgaaaactcggttgccccctgattttaaaatgttccggaaccaaatcgggggccatgggattcctttttccccgggcccttcccttggggggcgccctttgccgcc

SEQ ID NO: 21022 - protein, 72 aa, Zea mays
  misc_feature: Ceres CLONE 1389906-F
MDDATAEEEASMFETSHVLGALLDSSPLLARAWDRCTAASAAAPCLVHGEYGGKVYVGFSVVQAALTAQARR

SEQ ID NO: 21023 - DNA, 629 bp, Zea mays
  misc_feature: Ceres CLONE 1389908-R
  misc_feature: SWISSPROT Homolog: EC 3.2.1.22 Alpha-galactosidase
cgaattgggtaccgggccccccctcgaggtcgacggtatcgataagcttttttttttttttttttaaacggctaaaagaagtcaggagacgtcattttattattttattcaccacgttcggatctcaaatctaagccaaactgagcgttgcaccatgtcaaatcattagacagatggtggtgagctcttgttgtcggagcagtcacaaggcagttacagtatctgaaatcatacaattaataactctagctggatccacgggcagatattggatggacagatctccagcggcgccgtcagctaggaacgggcgtgaggacgaagagcttgcacgagtgcggcccgaccaccgccgtgaggctgccggtgaaccagcccggtagcgtctcgtgcttccagacgtccctcgcctgcacggcgacgccgcggcggatgcccacgtccggccatgccgcggtgatggacgcggagcgcgtggccccccggttgagcagcaacaccgccttcctgtgccccgagagctgccctgcccatacctcgagatcgttgccgtacttgctcactttctgtccttggacacccagccgatcttggctgatcgcgatgacctccgcgttggagaggattcc

SEQ ID NO: 21024 - DNA, 672 bp, Zea mays
  misc_feature: Ceres CLONE 1389911-F
  misc_feature: Encodes the peptide sequence at SEQ ID NO. 21025
  misc_feature (565)..(565): n is a, c, t, g, unknown, or other
  misc_feature (566)..(566): n is a, c, t, g, unknown, or other
  misc_feature (591)..(591): n is a, c, t, g, unknown, or other
ggagctccccgcggtggcggccgctctagaactagtggatcccccgggctgcaggaattcgcacgagaccattacctagaacatcctaatcgaaaacaaagccacgttagccgagagctcctctgctcctctcgtgtctggccgaacaggcagagcgaccagtctccagagcgctccccatggcgtcaggagctgcggcgacccctgtcgttcagactgtggtgctgaaggttgccatccactgccatggctgcaagaagaaggtccggaaggtgctcaggggcatcgaaggcgtgcaggacgtgacggtggacgcctcgcagcacaaggtgactgtgacgggcaccgtggactccgacacgctcatcaagaggctgtacaagtccggcaagaagggagtgccctggcagtgtcacccgcccgccaagaacagcgagcccgcgccggaggccccgccggctccgcagcctgccggcacgcgcaaggaaatcgggtgctgcctggctgctgctggggcccgcgccgaacaagaagtcggagggaggcggtgaaggaagcgcaggcnnaaaaagctcccgaaggaggagaaanaagaagccgggagcaaggaggaccgggcccgcagagaagaaagcagccccgaagcagagtcgtcaaagggagggtggagaa

SEQ ID NO: 21025 - protein, 123 aa, Zea mays
  misc_feature: Ceres CLONE 1389911-F
  misc_feature (14)..(75): Pfam Name: HMA Pfam Description: Heavy-metal-associated domain
MASGAAATPVVQTVVLKVAIHCHGCKKKVRKVLRGIEGVQDVTVDASQHKVTVTGTVDSDTLIKRLYKSGKKGVPWQCHPPAKNSEPAPEAPPAPQPAGTRKEIGCCLAAAGARAEQEVGGRR

SEQ ID NO: 21026 - DNA, 641 bp, Zea mays
  misc_feature: Ceres CLONE 1389912-F
  misc_feature (254)..(254): n is a, c, t, g, unknown, or other
  misc_feature (257)..(257): n is a, c, t, g, unknown, or other
  misc_feature (302)..(302): n is a, c, t, g, unknown, or other
  misc_feature (314)..(314): n is a, c, t, g, unknown, or other
  misc_feature (315)..(315): n is a, c, t, g, unknown, or other
  misc_feature (327)..(327): n is a, c, t, g, unknown, or other
  misc_feature (499)..(499): n is a, c, t, g, unknown, or other
aagctggagctccccgcggtggcggccgctctagaactagtggatcccccgggctgcaggaattcgcacgagaccattacctagaacatcctaatcgaaaagcttttctttctttctttcttgatcgagacgatcgactgctttgtctcgcctccccaagcgagaagcgaccgactcccgccgccgttgccagccatggacggcggtgacgacctcgccgccctgcacgagcaggtcgccctcggattctccgncgncatctcgggctccgaaactcgacttggctttccagctcaggtcgncgaggggcatcnnagctcccctcgnttgccccatgggcgcgcccgtcatcatcgtcgaaggcggcccagagtattctgcgaggcacctaaggcctcgcggtgcagggcgccatttccgcgcgcaaaggaaggaacgcccggaacccaagggctgccaagacgcccaaggccgaaacggcccccaaaggccggggtgntttggaaaaaaccctcttttgcccgggaacttggtggcatccccgaggggaagggggaacccgaagggggaaatacttcgaggggccccgtggagatcttcgccctggccggcgggttcgcgtgctctccaaggcatggagg

SEQ ID NO: 21027 - DNA, 658 bp, Zea mays
  misc_feature: Ceres CLONE 1389915-F
  misc_feature: Encodes the peptide sequence at SEQ ID NO. 21028
aaagctggagctccccgcggtggcggccgctctagaactagtggatcccccgggctgcaggaattcgcacgagaccattacctagaacatcctaatcgaaaaacggcccaccccgatctcataatcgtcgtcttctcccacttcgacgcggctagggccggcgctaccatctcctcttctcttccggcggcttctccgtcccgtcgatcaaccgcgccgccttcgccagtataccccgcattgagccgtcatcgttacctgcgccgaccggcacctctgtagcctcttctccaggggttgcacgaggaggaaggaggttcgggcttcgccatgtcgaagtcgaacctagatgatttgcttctgcaggcagccggccggacggggaagaaccactcccggtcgagcaacccgcggtggaactctggaggaagcggctccgacggcttcgacgacgacgactcggacgccgcgccgacctactgcgaggaagaagccttcgtcggaggttccgctcaagaagcggcacagacagagtagggcgtggggcgtgccatttgccggatgggaggaccagtactcttaggacgaataggggcgtcgcatggggggagaaggactcgggcagggcctcttcggggggggtggcctataccaggtg

SEQ ID NO: 21028 - protein, 68 aa, Zea mays
  misc_feature: Ceres CLONE 1389915-F
MSKSNLDDLLLQAAGRTGKNHSRSSNPRWNSGGSGSDGFDDDDSDAAPTYCEEEAFVGGSAQEAAQTE

SEQ ID NO: 21029 - DNA, 672 bp, Zea mays
  misc_feature: Ceres CLONE 1389916-F
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (244)..(244): n is a, c, t, g, unknown, or other
  misc_feature (245)..(245): n is a, c, t, g, unknown, or other
  misc_feature (312)..(312): n is a, c, t, g, unknown, or other
  misc_feature (317)..(317): n is a, c, t, g, unknown, or other
  misc_feature (336)..(336): n is a, c, t, g, unknown, or other
  misc_feature (340)..(340): n is a, c, t, g, unknown, or other
  misc_feature (571)..(571): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (602)..(602): n is a, c, t, g, unknown, or other
  misc_feature (617)..(617): n is a, c, t, g, unknown, or other
  misc_feature (628)..(628): n is a, c, t, g, unknown, or other
  misc_feature (666)..(666): n is a, c, t, g, unknown, or other
aagctggagctccccgcggtggcggccgctctagaactagtggatcccccgggctgcaggaattcgcacgagaccattacctagaacatcctaatcgaaaaatcctcagtgctctctctctcctactcctgtgattctcctcttcagctcttctcgcccattccagctccgactgcgccggtgggggaccgcgcaccccagcggcgccaggnnncgtccacgggaatgggttggttcttgtggnnctactgccgctcggtggcccgggggaagcacggctgccccgggcgcgcccgcccggctgcgaggggncaggncccccccttcccggggggncggncccggcccgagaaacccccccaaaaaaaaaaaaagggggggggggcccccacacgggggaaaaaggggggttttgggggaacccccccccccccccccttttttggggaggaaaaaaaaaaccgggcgggggtttttggcgccccacccccctcttttttttttggggggggggcccccacaaaagggggggtgttttttttttgttgcccccacccgcgggggggggggnccaaaaaaaaataaaaaaaaaaaannnnccntttttggatgctttnagagagagggntggggagaaccccccctctttagggggggggattgctncggcgg

SEQ ID NO: 21030 - DNA, 646 bp, Zea mays
  misc_feature: Ceres CLONE 1389920-F
  misc_feature (318)..(318): n is a, c, t, g, unknown, or other
  misc_feature (452)..(452): n is a, c, t, g, unknown, or other
  misc_feature (644)..(644): n is a, c, t, g, unknown, or other
agagctggagctccccgcggtggcggccgctctagaactagtggatcccccgggctgcaggaattcgcacgagaccattacctagaacatcctaatcgaaaaccaaaaagcccaatcttttactcgtgctcttttcttcctttctttgtcccggtgcggcgtgtgctcgcgtggcgtcaagagcggcggcagctcggcggtgttcacggccgagtgctcccacgccttccacttcccctgcatcgcagcccacgcgcgctcctcctccgccaacggcgttctgtcctgccccgtctgcgcctcgccgtggcgccaggngcccttttctcgctccctccgcctcactgctccttcacgacgacaagcaccgaggaggaggcgacggccgcaagacgccgccgcccgccagctatacgacgacgacgagccgctgctggcgcccaagccgcggncaacggtggtcgcttcacccgatcccggagccgacgaggacgacgagtaggagcaggccgccgcccgagtccagggcttcctcccatgccccaggagtaggaccacctcgggcctggccatcaccgtggcgccggaggtcgcgctcgtgtcgtccggcccgcggcacggaaagtacgtggtggcccgccaantc

SEQ ID NO: 21031 - DNA, 672 bp, Zea mays
  misc_feature: Ceres CLONE 1389923-F
  misc_feature (382)..(382): n is a, c, t, g, unknown, or other
  misc_feature (401)..(401): n is a, c, t, g, unknown, or other
  misc_feature (599)..(599): n is a, c, t, g, unknown, or other
  misc_feature (600)..(600): n is a, c, t, g, unknown, or other
  misc_feature (610)..(610): n is a, c, t, g, unknown, or other
  misc_feature (614)..(614): n is a, c, t, g, unknown, or other
aaagctggagctccccgcggtggcggccgctctagaactagtggatcccccgggctgcaggaattcgcacgagaccattacctagaacatcctaatcgaaaagttcggttgttcctcttcccacttcccctctctctctcgtgcgtgtgtactacttctgaggccgaaaggtcagaagagagtgtccacctttcagttcgattttcgatgatttgagtccttccgccgcggggaatttgagcgttttccttgagaaatttgagtttcttcgagagtaatttgtgtgttttctcttgagagattcgtgcaaggatgtcgccttcgatccatttattgggtagtcaaattgttcctatatagcgtcaaagcatccaactttgancttctccgtggtggcttcnttctatcgtgtgtcatccagacaatttgatctttattttaattggggttggatgcttggttcaggttagggtagttggaaagggtagcataagacaccatcaattttggggggatttttggtttttctctgaaataattggcgggtcaaattagtcacccttcagtttatcagtttttcacttctcatttttattggnnagggatttgnttgnatttttagtgggcgggcagagctttctttcgatcatcggtcctcatttttatggattt

SEQ ID NO: 21032 - DNA, 642 bp, Zea mays
  misc_feature: Ceres CLONE 1389926-F
  misc_feature: Encodes the peptide sequence at SEQ ID NO. 21033
  misc_feature (413)..(413): n is a, c, t, g, unknown, or other
  misc_feature (430)..(430): n is a, c, t, g, unknown, or other
  misc_feature (433)..(433): n is a, c, t, g, unknown, or other
  misc_feature (595)..(595): n is a, c, t, g, unknown, or other
aaagctggagctccccgcggtggcggccgctctagaactagtggatcccccgggctgcaggaattcgcacgagaccattacctagaacatcttaatcgaaaaaagaattcgcacgcacagagcacttttgctaaatcgctagttcgtttcctaaaccctagcaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcggggccgatggctacctgtactgcgaggnagtgcgcgtggagaccnctnatgacggctgctgagcgcatccccttctacctctacagcaagccacagatcctccgcaacctcgccgatttacgagatgctctccggggggctccgctccatcatcgggtaatgccgggaagggccacaacaacctccccgtgctacgcgtcctgcgtgagnttggtttgggggggccgttcctcgtcagcgggaacgagctccgactc

SEQ ID NO: 21033 - protein, 91 aa, Zea mays
  misc_feature: Ceres CLONE 1389926-F
  misc_feature (81)..(81): Xaa is any aa, unknown, or other
  misc_feature (87)..(87): Xaa is any aa, unknown, or other
  misc_feature (88)..(88): Xaa is any aa, unknown, or other
MASASMLARSLLRTPDPTQTSHPNRRSAAVVSFPRRHRRLSVRASVSTASPSPPPQPAAAAAGVPKHCFRRGADGYLYCEXVRVETXXDGC

SEQ ID NO: 21034 - DNA, 660 bp, Zea mays
  misc_feature: Ceres CLONE 1389927-F
  misc_feature: Translation starting site: 222
  misc_feature (202)..(202): n is a, c, t, g, unknown, or other
  misc_feature (205)..(205): n is a, c, t, g, unknown, or other
  misc_feature (258)..(258): n is a, c, t, g, unknown, or other
  misc_feature (280)..(280): n is a, c, t, g, unknown, or other
  misc_feature (294)..(294): n is a, c, t, g, unknown, or other
  misc_feature (360)..(360): n is a, c, t, g, unknown, or other
  misc_feature (401)..(401): n is a, c, t, g, unknown, or other
  misc_feature (407)..(407): n is a, c, t, g, unknown, or other
  misc_feature (422)..(422): n is a, c, t, g, unknown, or other
  misc_feature (462)..(462): n is a, c, t, g, unknown, or other
  misc_feature (493)..(493): n is a, c, t, g, unknown, or other
  misc_feature (510)..(510): n is a, c, t, g, unknown, or other
  misc_feature (524)..(524): n is a, c, t, g, unknown, or other
  misc_feature (529)..(529): n is a, c, t, g, unknown, or other
  misc_feature (549)..(549): n is a, c, t, g, unknown, or other
  misc_feature (627)..(627): n is a, c, t, g, unknown, or other
  misc_feature (637)..(637): n is a, c, t, g, unknown, or other
  misc_feature (641)..(641): n is a, c, t, g, unknown, or other
aaaagctgaagctcaccgcggtggcggccgctctagaactagtggatcccccgggctgcaggaattcgcacgagaccattacctagaacatcctaatcgaaaactagcttcccactccgctcggccaccagctttgaccgcctcccctcccctccgctcctgttcttccataccccactcccccgcaggagcggcgcggcgncgncaaaggcaaaggcaagatggtcgggcgcgcgccgaaaaagagcgacaacaccnagtactacgagatcctcggggngccccaggcggcgncccaggacgaccccaagaaggcccaccggaagggccgctaacaagaaccaccccgacgaggggggngacccccaaaagccacgggggggggcggaggccaaaaaagnccccancacccccacaacccngggccccccgcgcccgccgggggaacacggcgccgcgcgncccgccggcgcgggcccccgccgcgcggacncccccccccccaccggncgccccccccgccnagccncagccggcgcgcgggcgcgnccggcgcggcggcggagcccggccccgacgcggccgggccgcgccgcgacggccgcgacgcgcggaggaggaggaagnggggagacanaggnaggaagccaaccaacgccc

SEQ ID NO: 21035 - DNA, 673 bp, Zea mays
  misc_feature: Ceres CLONE 1389941-F
  misc_feature: Encodes the peptide sequence at SEQ ID NO. 21036
  misc_feature (505)..(505): n is a, c, t, g, unknown, or other
  misc_feature (522)..(522): n is a, c, t, g, unknown, or other
  misc_feature (553)..(553): n is a, c, t, g, unknown, or other
  misc_feature (566)..(566): n is a, c, t, g, unknown, or other
  misc_feature (591)..(591): n is a, c, t, g, unknown, or other
  misc_feature (596)..(596): n is a, c, t, g, unknown, or other
aaagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgcgccgctgcgcgtccnggtggcgaacgtggcgnacctcccaggtcggctgcctcgacagctcgnagccatgcagggnacctgccccgtgctttctcgccagncccgnttcgctccccgtatcgtcactaaaaggccggaatttgtggggaggaagcccagtaccgcaggcgagatggacccccc

SEQ ID NO: 21036 - protein, 94 aa, Zea mays
  misc_feature: Ceres CLONE 1389941-F
  misc_feature (39)..(39): Xaa is any aa, unknown, or other
  misc_feature (45)..(45): Xaa is any aa, unknown, or other
  misc_feature (55)..(55): Xaa is any aa, unknown, or other
  misc_feature (68)..(68): Xaa is any aa, unknown, or other
MATAASSTPAARQPTLVCASLTARVPREMAAEVAPLRVXVANVAXLPGRLPRQLXAMQGTCPVLSRQXRFAPRIVTKRPEFVGRKPSTAGEMDP

SEQ ID NO: 21037 - DNA, 662 bp, Zea mays
  misc_feature: Ceres CLONE 1389942-F
  misc_feature: Encodes the peptide sequence at SEQ ID NO. 21038
  misc_feature (296)..(296): n is a, c, t, g, unknown, or other
  misc_feature (355)..(355): n is a, c, t, g, unknown, or other
  misc_feature (372)..(372): n is a, c, t, g, unknown, or other
  misc_feature (374)..(374): n is a, c, t, g, unknown, or other
  misc_feature (397)..(397): n is a, c, t, g, unknown, or other
  misc_feature (523)..(523): n is a, c, t, g, unknown, or other
aagctggagctccccgcggtggcggccgctctagaactagtggatcccccgggctgcaggaattcgcacgagaccattacctagaacatcctaatcgaaaagccgcttccaaatcccaataataccatcgcgtaaatccagatatcagggcagctggaactgaaggtggcgggagccgagtgatccggcggtgagctgagcggggcggaatggcggcggagcaggggcggtcgctggcggagacgcccacctggtccgtggcaaccgtcaccacgctcatggtcgctgcctgcttnctcgtcgagcgctccctctcgcgcttcgccaagtggctgcgcaagacccagcggaaggncatgctcgccgcgctcnanaagatccgcgaagagctgatgcntgctcgagtcatctcgctgctgctcagccagacggcgcgcttcatatcggagatctgcgtgccgtcctcgctcttcaccagcgcttctacatctgctccgagagcgactaccaggacctgctgcgncacacggacgccaaccagacggcgctcgacaagaacatgggtcggtggccaacggctgcacgtctgggggcgagggccatgatctttttgtttcgtacgaggggcttgagcagctgcaccggttctcttcatcgtggga

SEQ ID NO: 21038 - protein, 131 aa, Zea mays
  misc_feature: Ceres CLONE 1389942-F
  misc_feature (29)..(29): Xaa is any aa, unknown, or other
  misc_feature (49)..(49): Xaa is any aa, unknown, or other
  misc_feature (55)..(55): Xaa is any aa, unknown, or other
  misc_feature (63)..(63): Xaa is any aa, unknown, or other
  misc_feature (105)..(105): Xaa is any aa, unknown, or other
MAAEQGRSLAETPTWSVATVTTLMVAACXLVERSLSRFAKWLRKTQRKXMLAALXKIREELMXARVISLLLSQTARFISEICVPSSLFTSASTSAPRATTRTCCXTRTPTRRRSTRTWVGGQRLHVWGRGP

SEQ ID NO: 21039 - DNA, 616 bp, Zea mays
  misc_feature: Ceres CLONE 1389943-F
  misc_feature: Encodes the peptide sequence at SEQ ID NO. 21040
  misc_feature (12)..(12): n is a, c, t, g, unknown, or other
  misc_feature (292)..(292): n is a, c, t, g, unknown, or other
  misc_feature (300)..(300): n is a, c, t, g, unknown, or other
gctcttgaacangtggatcccccgggctgcaggaattcgcacgagaccattacctagaacatcctaatcgaaaagttccgcttcgtcccagcctctagttcttcctttcctccagagtgatggccaaatgctactcagattggcccccgattccgcctttccatccatcgcgaagaacgccgccgcaatcccacgcctccccgatcacgatcaggcggcagctcgcgtccttcgtgctccactgctccagatcctgcgctcccctcctcgagcccagaacctgcccgatgangtcgaggncgtaccggcgacgccgccgcctgcgctggcggacgccgccccgaaaggtgggattctaaccagtcatccgagggctctgcggtgacccgcaaaccgagcagctggccttcgagggctacaggagggcgctgctgcaccccgattccggcttggagaaaaagacggcccacgggctgaccttgcaattgataaggaaaaacaggggggcttccctggggctgggggttaaggaactcagggccccacgggggctcccggaaaaaggggaggggggggggggtttttccctggtgattaaggggggggggagggttcc

SEQ ID NO: 21040 - protein, 79 aa, Zea mays
  misc_feature: Ceres CLONE 1389943-F
  misc_feature (58)..(58): Xaa is any aa, unknown, or other
  misc_feature (61)..(61): Xaa is any aa, unknown, or other
MAKCYSDWPPIPPFHPSRRTPPQSHASPITIRRQLASFVLHCSRSCAPLLEPRTCPMXSRXYRRRRRLRWRTPPRKVGF

SEQ ID NO: 21041 - DNA, 656 bp, Zea mays
  misc_feature: Ceres CLONE 1389951-F
  misc_feature: Encodes the peptide sequence at SEQ ID NO. 21042
  misc_feature (392)..(392): n is a, c, t, g, unknown, or other
  misc_feature (443)..(443): n is a, c, t, g, unknown, or other
  misc_feature (450)..(450): n is a, c, t, g, unknown, or other
  misc_feature (563)..(563): n is a, c, t, g, unknown, or other
  misc_feature (569)..(569): n is a, c, t, g, unknown, or other
  misc_feature (580)..(580): n is a, c, t, g, unknown, or other
  misc_feature (588)..(588): n is a, c, t, g, unknown, or other
  misc_feature (649)..(649): n is a, c, t, g, unknown, or other
aagctggagctccccgcggtggcggccgctctagaactagtggatcccccgggctgcaggaattcgcacgagaccattacctagaacatcctaatcgaaaaacacaggcctcccggcctcccgtgcgctattctctatcagcttacccagcacacagtacacactctaatctccacacgacccaatagatatacggggctgaaggatgaagcttagagcaaaagggatcggcctcctgcttctccttgtcttgcttgctctttgctccaccattgaagtcggcgaggcaagaagaggcaagcattggaggtcgtcgaggagctcaccgggctcatcccagctcaagaaagacaagggaaagaagagcagctcccgccggcagtacggcgccnaccggccaggtccgaagccaccggtcagctcgacaccaagctctggtgctngccaggnaaatcatcagaatccttaccaccaagccccagtccaagcccgaatgcccctgacatccctccctatgcaggccctggcaatggcagcaggcattccactcccgagccgcggcntccagntgtgggaaggntcagcagnagccatcacagccgccgccagcgacctcggagggtgcagtattcaatgtggttgattttgnagccagg

SEQ ID NO: 21042 - protein, 37 aa, Zea mays
  misc_feature: Ceres CLONE 1389951-F
  misc_feature (12)..(12): Xaa is any aa, unknown, or other
  misc_feature (14)..(14): Xaa is any aa, unknown, or other
  misc_feature (20)..(20): Xaa is any aa, unknown, or other
MAAGIPLPSRGXQXWEGSAXAITAAASDLGGCSIQCG

SEQ ID NO: 21043 - DNA, 698 bp, Zea mays
  misc_feature: Ceres CLONE 1389954-F
  misc_feature: Encodes the peptide sequence at SEQ ID NO. 21044
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (91)..(91): n is a, c, t, g, unknown, or other
  misc_feature (92)..(92): n is a, c, t, g, unknown, or other
  misc_feature (147)..(147): n is a, c, t, g, unknown, or other
  misc_feature (148)..(148): n is a, c, t, g, unknown, or other
  misc_feature (150)..(150): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
ngggggggnnnnnnnnnnnnnnnnnnnnnnnnnnnnnnnnnnnnnnnnnggggnnnnttaaggnnnnnnnnngggggggggctgggggggnncaaaactggggctcaacgtggaggggggggggggtatattcaaatgatggctgtnngnggggnnnttcacacaagacaatgaggggagaaatggtggggggaaagataggacaagcattagtggtcgctcgtcactcgtcagtactcaatggaggaggcggtggcggggagggagagagaggggggaggcccaccggggggtcgccggaccagatggacacgccggataggccccgcgccggcgccggcgccgggttcgaggattctcctgtggtcaatttcatcaacaatctctcgcctataccaccacctaaacctttagactcagcacataatgggcagctattcaagtcatcaaatttgttttttgtttcttggagggggaagtagggggatggtaatccaacaaagggaactaaagttctgatcagggacgaatctggtcagcttcctcatgaattggactcacctagcagtgtgagaactcggatagggacctcagggtcttttagaatgatcagatggaaagacattgtggcagagaattggaatatcacttgggaactaaacgagggatctattgattcttcagatgatagatcaagg

SEQ ID NO: 21044 - protein, 58 aa, Zea mays
  misc_feature: Ceres CLONE 1389954-F
MDTPDRPRAGAGAGFEDSPVVNFINNLSPIPPPKPLDSAHNGQLFKSSNLFFVSWRGK

SEQ ID NO: 21045 - DNA, 639 bp, Zea mays
  misc_feature: Ceres CLONE 1389964-F
aaagctggagctccccgcggtggcggccgctctagaactagtggatcccccgggctgcaggaattcgcacgagaccattacctagaacatcctaatcgaaaacgtatatgaatcttctcagacagaattccagggaggggatgttcagaaggtgcttatttcgttgttgaaaatattgtgccaacactatggaaagcttcgttcatcctttgggtctgacccgtcacaagagggtatagatggcccagagatggcagtgacgaaacttttctcatcttgtaagagcagtgctaatatgaaagggtatggagctgttgtccattgcatgagaaatcttccctcagaaagccagattcagactactgcccaggaggttcaaagtctcttggtttctggtagaaggaaagaggcccttcaccaggcacaagaaggtcacctttggggccctgcactgatccttgctttacaacttggtgataagttttatgcggatactgtgaagaaaatggcccactgccattttgtttctggatcacccttgaggacactgtgccttcttattgctggacaacctgcagatgttttcagttttgagaatcctgttaacagtggtttgtcttctccccaacagcctgtaga

SEQ ID NO: 21046 - DNA, 647 bp, Zea mays
  misc_feature: Ceres CLONE 1389976-F
  misc_feature: Encodes the peptide sequence at SEQ ID NO. 21047
aaagctggagctccccgcggtggcggccgctctagaactagtggatcccccgggctgcaggaattcgcacgagaccattacctagaacatcctaatcgaaaagccgtccgcgccgcccaccccctcgaccgcgtccctcgctgctttgccctctccaccctccgccatcaccgccgcggcgtccttctgtaccggatccgtcgcagccaccgctccgcagatccgctgggttgacgtccagagagctgctccggggatgtcgtcctccgtttccagcgtcgagggcgacgccgccggagagttcacggaggtcgtaatcgtgcgtcacggcgagacgtcatggaacgcctcgcgcatcatacagggacacttggatgcagagcttaatgatattggaaggcagcaagctgttgcggttgctcatcgtctttctaaagaagtgaaaccagttgccatatactcttctgatctgaagcgagcagcagagactgcgcaaacaatcgcaagaatttgcaatgtgccaaatgtcgtgttcgatccagcactgagagaaagacacattggagatctgcaaggcatgacgcttcaagatgctgctacagagaggccagaggcatacaaagcttttatgtcccacaagagaaatc

SEQ ID NO: 21047 - protein, 130 aa, Zea mays
  misc_feature: Ceres CLONE 1389976-F
  misc_feature (18)..(128): Pfam Name: PGAM Pfam Description: Phosphoglycerate mutase family
  misc_feature: SWISSPROT Homolog: EC 5.4.2.1 Phosphoglycerate mutase
MSSSVSSVEGDAAGEFTEVVIVRHGETSWNASRIIQGHLDAELNDIGRQQAVAVAHRLSKEVKPVAIYSSDLKRAAETAQTIARICNVPNVVFDPALRERHIGDLQGMTLQDAATERPEAYKAFMSHKRN

SEQ ID NO: 21048 - DNA, 638 bp, Zea mays
  misc_feature: Ceres CLONE 1389982-F
  misc_feature: Translation starting site: 159
  misc_feature (337)..(337): n is a, c, t, g, unknown, or other
  misc_feature (339)..(339): n is a, c, t, g, unknown, or other
  misc_feature (367)..(367): n is a, c, t, g, unknown, or other
  misc_feature (418)..(418): n is a, c, t, g, unknown, or other
  misc_feature (443)..(443): n is a, c, t, g, unknown, or other
agagctggagctccccgcggtggcggccgctctagaactagtggatcccccgggctgcaggaattcgcacgagaccattacctagaacatcctaaaaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgccctcttcgcgcccccgatcgcccgattccttcagggncnaaagtacagatggtccagtgtttaccancagagtttctcgtacgtaccggggcaaatcattgacagttccagatcacgnagttgatgtgtgtcctttggaatcnatgagtatgtcccctgccatggatgagcctatttaagcagcttgaaaaagctgaaacctctaggcatgaggatcttgaaaggatttggcctccctggaaaaaaggttttgttttgttggggccccccccaatgggctcccaaaatccccttaagggggccaaaaacccgaaaaaacggtgggggggaaaaaggca

SEQ ID NO: 21049 - DNA, 631 bp, Zea mays
  misc_feature: Ceres CLONE 1389990-F
  misc_feature: Encodes the peptide sequence at SEQ ID NO. 21050
  misc_feature (458)..(458): n is a, c, t, g, unknown, or other
  misc_feature (529)..(529): n is a, c, t, g, unknown, or other
  misc_feature (570)..(570): n is a, c, t, g, unknown, or other
  misc_feature (571)..(571): n is a, c, t, g, unknown, or other
  misc_feature (588)..(588): n is a, c, t, g, unknown, or other
aaagctggagctccccgcggtggcggccgctctagaactagtggatcccccgggctgcaggaattcgcacgagaccattacctagaacatcctaatcgaaaaagagctccaatggccgccgctctcccgcactcccgcctccacctcccgctccacacgcccagtcccacctcccgccgccgcccctgcccccgttcccgccgccgccttccctccttcgtcgccgtctcgcgcctccagaacaccaccgccgcgacccacccggtcctcccgcccccggctccgcccccctccgccgcgctcctcgccgccgagggcgcctccctcgcgccgcgccgagagcaccgcttcccaggctcggtctcctccccaacaagcaccgcctctgcctctaacgaggcggagaacgccgccctgcttcgcgcccctccagttgccccggccgcccccgcccaagngctccgttgccgcgcctcggcgccgggaaagggccgggggcctgacctacatccacaaaaccccaccgggncggcaaggcgccccctttttgggcaacccccgcttttttcnnaaggccccccagcgccntggcggcggaaaccagacccagaaaattccccacaaatgcttc

SEQ ID NO: 21050 - protein, 173 aa, Zea mays
  misc_feature: Ceres CLONE 1389990-F
  misc_feature (116)..(116): Xaa is any aa, unknown, or other
  misc_feature (140)..(140): Xaa is any aa, unknown, or other
  misc_feature (154)..(154): Xaa is any aa, unknown, or other
MAAALPHSRLHLPLHTPSPTSRRRPCPRSRRRLPSFVAVSRLQNTTAATHPVLPPPAPPPSAALLAAEGASLAPRREHRFPGSVSSPTSTASASNEAENAALLRAPPVAPAAPAQXLRCRASAPGKGRGPDLHPQNPTGXARRPLFGQPPLFSXGPPAPWRRKPDPENSPQML

SEQ ID NO: 21051 - DNA, 642 bp, Zea mays
  misc_feature: Ceres CLONE 1389992-F
  misc_feature: Encodes the peptide sequence at SEQ ID NO. 21052
  misc_feature (525)..(525): n is a, c, t, g, unknown, or other
  misc_feature (548)..(548): n is a, c, t, g, unknown, or other
aaagctggagctccccgcggtggcggccgctctagaactagtggatcccccgggctgcaggaattcgcacgagaccattacctagaacatcctaatcgaaaagacgcccatgaggggcctgatctaatgtagcgttaggagaaagcctactgttccatctctttcttggagtacgagggcacgaaggcctaaccccctcgcccccaccagattcggggaattcgcgcctcatccgatcgtcaccggccgccgaagcgcaagaaacagcggccgggttaggactctggaggatacggcggctcggcggattcaggaagtgaggatattttcttggatttctgttcttgattgaggagaggatctcgtattagctactgcgttattcactggatgttggcaatggggtcagaagagtgggagctctatccttcttccgacataggttcgcaggtcatagaatacagacctgtgtctgaagacagcgatgacgatcagaatgggggatgtgcagtgtcgctggatggntgtctccctgatgatcttctggnagaaggtctttccttctttgcctgtgcagaatcataagatctgggtctttttgcaaaaggggcattgaattggggatgcccggaggaaccatga

SEQ ID NO: 21052 - protein, 64 aa, Zea mays
  misc_feature: Ceres CLONE 1389992-F
  misc_feature (53)..(53): Xaa is any aa, unknown, or other
MLAMGSEEWELYPSSDIGSQVIEYRPVSEDSDDDQNGGCAVSLDGCLPDDLLXEGLSFFACAES

SEQ ID NO: 21053 - DNA, 647 bp, Zea mays
  misc_feature: Ceres CLONE 1389996-F
  misc_feature: Pfam Name: Serpin Pfam Description: Serpin (serine protease inhibitor)
  misc_feature (585)..(585): n is a, c, t, g, unknown, or other
agagctggagctccccgcggtggcggccgctctagaactagtggatcccccgggctgcaggaattcgcacgagaccattacctagaacatcctaatcgaaaaacataccaccttctctctttccttcacacacgcagctcacgtacacgcgatgagcacaccgcgtcgcggcgggcagcaccacggcgacaagcgcaccgtgacacgagcagcctcccgaaacagcgacggacacggcgcaggcgacttgagcttcgggtccacggcggggcctcggttcgccgtcgccccgccgcgcccttgggcgccgccgcctgagcacgcggccgtcttcgcgcagccaccagacgatccgtcgacgttgaccatgctgtggggaccgcccggcgaggtgcccgttgccggcttcgctgcggcaccggaagggcgaccggatgcgttcgctggcagcgcgtcgtgcctgccgctcgcgaggcaggtcggcggccagcagggggcgcgcaacggcgcaacttcgtggggtcgccgctgtcgttccacgcggcgctcgcgctggtggccgcgggcgcgcggggcgagacccancgggagctcctgcgcttcttggactccgagtcgctggtcgagctgcaccgcgccgcggcgac

SEQ ID NO: 21054 - DNA, 624 bp, Zea mays
  misc_feature: Ceres CLONE 1389997-F
  misc_feature: Encodes the peptide sequence at SEQ ID NO. 21055
aaagctggagctccccgcggtggcggccgctctagaactagtggatcccccgggctgcaggaattcgcacgagaccattacctagaacatcctaatcgaaaaatttgagggtgacaaaatagtaaaaaactcgaccaggtgccccacggcggtgccggcgatggcaacccgctactggatcgtctctctccccgtgcagtctcccggcgccaccgcgacctcgctttggtcgcgcctgcaggatggcatctcccgccactccttcgacaccccgctgtaccggttcaacgtcccggacctccgcgtcggcaccctcgactccctcctcgcgctcagcgatgacctcgtcaagtcaaacgtgttcgtcaagggcgtttcgcacaagatccggaggcagatcgaagacctcgagcgcgccggaggcgtcgacagcggggccctcaccgtcgatggcgttcccgtcgacacctacctcaccaggttcgtgtgggatgagggcaagtaccccacaatgtcgtcgctcaaggagatcgtcggcagcatccagtcgcaggtcgccaagatcgaggatgacatgaaggttcgagcagcggaatataacaatgtaaggagccagcttactgc

SEQ ID NO: 21055 - protein, 154 aa, Zea mays
  misc_feature: Ceres CLONE 1389997-F
  misc_feature (5)..(154): Pfam Name: V-ATPase_C Pfam Description: V-ATPase subunit C
  misc_feature: SWISSPROT Homolog: EC 3.6.3.14 H(+)-transporting two-sector ATPase
MATRYWIVSLPVQSPGATATSLWSRLQDGISRHSFDTPLYRFNVPDLRVGTLDSLLALSDDLVKSNVFVKGVSHKIRRQIEDLERAGGVDSGALTVDGVPVDTYLTRFVWDEGKYPTMSSLKEIVGSIQSQVAKIEDDMKVRAAEYNNVRSQLT

SEQ ID NO: 21056 - DNA, 689 bp, Zea mays
  misc_feature: Ceres CLONE 1389998-F
  misc_feature: Encodes the peptide sequence at SEQ ID NO. 21057
  misc_feature (473)..(473): n is a, c, t, g, unknown, or other
  misc_feature (495)..(495): n is a, c, t, g, unknown, or other
  misc_feature (527)..(527): n is a, c, t, g, unknown, or other
  misc_feature (533)..(533): n is a, c, t, g, unknown, or other
  misc_feature (543)..(543): n is a, c, t, g, unknown, or other
  misc_feature (601)..(601): n is a, c, t, g, unknown, or other
  misc_feature (622)..(622): n is a, c, t, g, unknown, or other
aagctggagctccccgcggtggcggccgctctataatagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgccctgcgncagcatctccaccgcttgccgnagcgtcaggatctcccgtcgcagcgcccgcgncgtcgncatcctcagntcgtcggccctccacagcagccgcgacagcgcggccttgtagttgtccagcgccgcgncacacttcgggggccgggggntccctaaccgggccgccctgaaccgccgcgggcccgggccgttcaaattttcggtgggaacaaattg

SEQ ID NO: 21057 - protein, 109 aa, Zea mays
  misc_feature: Ceres CLONE 1389998-F
  misc_feature (66)..(66): Xaa is any aa, unknown, or other
  misc_feature (82)..(82): Xaa is any aa, unknown, or other
  misc_feature (101)..(101): Xaa is any aa, unknown, or other
  misc_feature (108)..(108): Xaa is any aa, unknown, or other
MLLTSCRQGRGMASLSCARADGVVRSGALPAKLLLCASCCFPTAAPVADGEVQVLALRQHLHRLPXRQDLPSQRPRRRHPQXVGPPQQPRQRGLVVVQRRXTLRGPGXP

SEQ ID NO: 21058 - DNA, 685 bp, Zea mays
  misc_feature: Ceres CLONE 1389999-F
  misc_feature: Encodes the peptide sequence at SEQ ID NO. 21059
aaagctggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcgggccttgtagctgtccagcgccgcgcccaactcgggcgtccgcgggctcctagccgggccgccctgagccgccgccgcgccgcgccgtcgcagctttccgctggcag

SEQ ID NO: 21059 - protein, 109 aa, Zea mays
  misc_feature: Ceres CLONE 1389999-F
MLLTSCRQGRGMASLSCARADGVVRSGALPAKLLLCASCCFPTAAPVADGEVQVLACRQHLHRLPRRQDLRRQRPRRRHPQLVGLHQQPRQRGPCSCPAPRPTRASAGS

SEQ ID NO: 21060 - DNA, 713 bp, Zea mays
  misc_feature: Ceres CLONE 1390001-F
  misc_feature: Encodes the peptide sequence at SEQ ID NO. 21061
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (44)..(44): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (713)..(713): n is a, c, t, g, unknown, or other
ggggggggccccccccccnnnanannannannannaaaggaggnngacaacnnnaccaaagctggagctccccgcggtggcggccgctctataactagtggatcccccgggctgcaggaattcgcacgagaccattacctagaacatcctaatcgaaaaacgatgacacaccactccacagcagtaggaagagggatagagcaaggccacacacacacacacaccactagtaggctagcctagccttttagtcgacgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcctggcagcagcattcccgggttcagcatgcccgggcagcggcagcagcctacccgggttcagcttgcccggcagcgggcagcatgccccctctttcggggggcgggctcccccggggcttccagggggtttcggggggggaattgcccggggatccgcccaccgggcggggttgccgn

SEQ ID NO: 21061 - protein, 127 aa, Zea mays
  misc_feature: Ceres CLONE 1390001-F
MARSSKMMVAAALLALALAVSTAEARNIKTTTTEKKDDAVVQPQTFPPFDRLGGGASPAFGGLPGGSIPGSSIPGFSMPGQRQQPTRVQLARQRAACPLFRGAGSPGASRGFRGGNCPGIRPPGGVA

SEQ ID NO: 21062 - DNA, 675 bp, Zea mays
  misc_feature: Ceres CLONE 1390003-F
  misc_feature (479)..(479): n is a, c, t, g, unknown, or other
  misc_feature (480)..(480): n is a, c, t, g, unknown, or other
aaagctggagctccccgcggtggcggccgctctagaactagtggatcccccgggctgcaggaattcgcacgagaccattacctagaacatcctaatcgaaaaaatgactctctccctagtccctacactttctcccccgtgtcccgttgctaaaagcttagagaaaaacctaatcggacagcactgtggccaagcagggcgcgggagatcgtacgccggcggcgaggtcctgcggtggcgggcctcggcagagtggtggtgctagcggagtgcagctgttgggttggtgggtaagagtgagaaggacatgaaggcgctgcggcgatccagcacctcgtcctcgccgacggccgcgtcctcccctccgtcctcatcgtggatccacatccggtcgctcctcgccgccgccgcgtcctcgtcctcgtcctcctccttcgcagcggctgcggttgggagcgcggtggcttgtgtggtgtcgnnctgcggtggccgcctcgtcttcttcctcggccggcgtcgtcctcgccgactcggaaagcggggtggtcttaaatctccatggtcccggaggaaaagaaaacgagcactttctcgtgaacagtgggggagagtttgttttcagcaaatgggaagcttcgtgatggttggaaggaagtttctcaagaaagttcgcag

SEQ ID NO: 21063 - DNA, 725 bp, Zea mays
  misc_feature: Ceres CLONE 1390004-F
  misc_feature: Encodes the peptide sequence at SEQ ID NO. 21064
ttttttttccccccccccccttgttgggtcttttattttttcgcgacacgtgacccaaactgtaactccccgcggtggcggccgctttagaactagtggatcccccgggctgcaggaattcgcacgagaccattacctagaacatcctaatcgaaaagtctttgggtgagcacaccgcgcagcaacgagaggggcaaacaagcttgctactgtgatttctcgtccgagcagcggcggaggagagagagagagcatggccgaccacaaggaggagcctgtgccggagtctgtgatggacaagatcaccgagaagttccacggcggggactcgtcgtcgtcgtcgtctgactcggacgacgagaagaaggggtcctcgttggcgtcggcggcggaagccatgaaggccaagatctaccgccttttcgggcgggagaggcccgtccactccgtcctcggcggcggcaagcctgccgatcttatcctatggaggaacaggaagatctctggcggggtacttgctggtgccacggccatctgggtcctattcgagggtcatggaagtaccatcctccccaccttggggggggcccactggtctcattcctctccgctgggcaaccctctttccaggggggcccaaatgcccccccaccttttccatcaacaagaccccccccacccggaaacaaattccctgggagggccaaaaaaacccccccgaaggg

SEQ ID NO: 21064 - protein, 157 aa, Zea mays
  misc_feature: Ceres CLONE 1390004-F
MADHKEEPVPESVMDKITEKFHGGDSSSSSSDSDDEKKGSSLASAAEAMKAKIYRLFGRERPVHSVLGGGKPADLILWRNRKISGGVLAGATAIWVLFEGHGSTILPTLGGAHWSHSSPLGNPLSRGAQMPPHLFHQQDPPHPETNSLGGPKKPPRR

SEQ ID NO: 21065 - DNA, 688 bp, Zea mays
  misc_feature: Ceres CLONE 1390006-F
  misc_feature: Encodes the peptide sequence at SEQ ID NO. 21066
aaagctggagctccccgcggtggcggccgctctagaactagtggatcccccgggctgcaggaattcgcacgagaccattacctagaacatcctaatcgaaaaacccttccaccacgcagtcactcccgggccgccgccgccgccgcctccgcgaaaaaccctagcaggcttcgccgctatcactccaaggggcgcgaccatggtggccacaaagaagacgaagaaatccacggacaacatcaataacaagctgcagcttgttatgaagagtggcaagtacactctcggctacaagaccgtcctcaggactctcaggaactctaagtcgaagctagtgatcatcgctaacaactgcccgccccttcgtaagtctgaaattgagtactatgctatgctggccaaggtcactgtccaccacttccatggaaacaatgtcgaccttggaactgcctgtggtaaatactttcgggtctgctgcctcagcattattgatcctggtgattctgatatcatcaagactacaccgggtgagcagtaaagaagcccctgcagtagggggatcttactgcatttgttcttctgtcttggtaaacagcatttacctgctagtaaactgagttattcggaacattgtcttgaattgatttttggcttcgggtgttttgacacttaaatagagctttacttt

SEQ ID NO: 21066 - protein, 112 aa, Zea mays
  misc_feature: Ceres CLONE 1390006-F
  misc_feature (12)..(106): Pfam Name: Ribosomal_L7Ae Pfam Description: Ribosomal protein L7Ae/L30e/S12e/Gadd45 family
MVATKKTKKSTDNINNKLQLVMKSGKYTLGYKTVLRTLRNSKSKLVIIANNCPPLRKSEIEYYAMLAKVTVHHFHGNNVDLGTACGKYFRVCCLSIIDPGDSDIIKTTPGEQ

SEQ ID NO: 21067 - DNA, 667 bp, Zea mays
  misc_feature: Ceres CLONE 1390009-F
cgctctcaactagtggatcccccgggctgcaggaattcgcacgagaccattacctagaacatcctaatcgaaaaataggaaaaacgactccacacggtccacggcgtcgtctccggcgaaccttcgcgagccctcggctcccctctaccaccgctgccgcgaccccgcctacggagcatcctcgggtagcgctctggcttcccgtgccggcggacgtcctgcaggaggcggcggcctccgtggcatgttgatgagggccgccgctgccctccctcgccgatcgtcgcggccctccggagccggggtcctcctcctcccgggctcccgcccctggggcctcctccagccgggctcctgcccccggtgtctccttcgaccccttcgatgtcgataccgacccgccatcgcggcttgagctgacgcccgagcagatcgggctctgcgttgacgcgctcgcgcatttcgagtacaaggggaagccgccgacatgacttgtccgacgagttccgaaagcctctcggcaatcggaaattacaactaaggaaaaccagctggtggagctcattagtcgggttactaaaaaaaaagcaccggtgtttttgagggacctccagcttgtggactaacccagggtacgggctaaaaacccccctgagcggccttccaa

SEQ ID NO: 21068 - DNA, 736 bp, Zea mays
  misc_feature: Ceres CLONE 1390011-F
  misc_feature: Encodes the peptide sequence at SEQ ID NO. 21069
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
gttcnnnnctntnncnccctctcgggcgcgcccgggtgggaggttttttcaagctgggactccccgcggtggcggccgctctagaactagtggatcccccgggctgcaggaattcgcacgagaccattacctagaacatcctaatcgaaaaacagaggacaggggtcaccacggttcctgtgccgccactctgcgggctgctcggcgagctctctcctcgcctgaagcgccgctgtccagatcccggcgaggaagatgccatcgggacgcgcttctggctgcacgggaggaccggcgtcatgaccgacgcgcggcctcgcagtgcaatgccggtgggggacgacagtgtgtcctctcgtcggggatcgatgagggccctcgcatgagaggccctactcgcggaggggttctcgtagtggacatccatttccccccggatcaccgtttcgagactccaaaggtatcttttgggaggaggtgccgccatgcaaacatcggtagaactggaagcagatgccgcggcattctgagggagcagcgtacgcctgctttggcaatctctaaggtgctgctttctatctactcgctgcttacggagcccatccgagacgatcctcttgtccctgagattgctcagatgcacaagacggatcggtctaagtacgaggcaacgggccgcagctggacccagatgtatgccatgagatgaaaatgaaatgacgttgaaactccctat

SEQ ID NO: 21069 - protein, 108 aa, Zea mays
  misc_feature: Ceres CLONE 1390011-F
  misc_feature (1)..(102): Pfam Name: UQ_con Pfam Description: Ubiquitin-conjugating enzyme
  misc_feature: SWISSPROT Homolog: EC 6.3.2.19 Ubiquitin--protein ligase
MRGPTRGGVLVVDIHFPPDHRFETPKVSFGRRCRHANIGRTGSRCRGILREQRTPALAISKVLLSIYSLLTEPIRDDPLVPEIAQMHKTDRSKYEATGRSWTQMYAMR

SEQ ID NO: 21070 - DNA, 654 bp, Zea mays
  misc_feature: Ceres CLONE 1390012-F
tccccgcggtggcggccgctctacaactagtggatcccccgggctgcaggaattcgcacgagaccattacctagaacatcctaatcgaaaaaccaccaccactgaacgacagcctagtacttaactcatcgactccggattgaagaactcgacaccatgaaggcgctgatcgatgaccttgctctcctggggctcactgagagcgccaactccagtacaagcggcgggtgcgcctagccagacactaccgtttcatctaccgcctccgctctatatgccgcctccgttctatctgccgccgcattagcagacgcagtcatgacaataccccactcaagcaccgcagataagcccgtgccagcagatcggagtctgcgtcgtcggcagcatctgcagcccgtacctgtctcagtgcgtctaggtcctgaagcacagtgcaagccgggaggggacgccctacggttccgcacagtagcaggcgctgcaagaacaaggctgccacaaaatcaggaagtgggaaccgtttgacccggaaccaaggaaaataaggggggggcccttggaacccttcctgggcaacacacaaccaaaggggaagttcccgggattttttgggcccccccgaaaacgccacaattgttacccccctttggg

SEQ ID NO: 21071 - DNA, 724 bp, Zea mays
  misc_feature: Ceres CLONE 1390017-F
  misc_feature (386)..(386): n is a, c, t, g, unknown, or other
  misc_feature (387)..(387): n is a, c, t, g, unknown, or other
  misc_feature (398)..(398): n is a, c, t, g, unknown, or other
  misc_feature (402)..(402): n is a, c, t, g, unknown, or other
  misc_feature (403)..(403): n is a, c, t, g, unknown, or other
  misc_feature (406)..(406): n is a, c, t, g, unknown, or other
  misc_feature (407)..(407): n is a, c, t, g, unknown, or other
  misc_feature (413)..(413): n is a, c, t, g, unknown, or other
  misc_feature (414)..(414): n is a, c, t, g, unknown, or other
  misc_feature (449)..(449): n is a, c, t, g, unknown, or other
cgctcataactagtggatcccccgggctgcaggaattcgcacgagaccattacctagaacatcctaatcgaaaagtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgttcttcaaggtctttggcctccgcccgttctggacaggggcacaccactgtcccaccggtgccactacgcgaaatacgagtccctcgtgcggctcccgtaggtggaagagatcatcanngcgtgagtggnaggnncgnngtccanncaccgggagggaaggggggcaatggggggcggggnaagcccactccggacggggctccccccccggggttatccggggaagggaactttaaaaacccaaaaaaaaaattttcggccacaggaaaacccgccttggagggggtttattgttgaaaaggccccccccttggggggggggcccggtttgggggccccataaaaaacatgagggttgccccaaaaaaggaaaaaaagggctttaaaaaaaaaacacccctattcccaaagaggggggggcgccgccatgtggctgaagggagaagactcggtcg

SEQ ID NO: 21072 - DNA, 654 bp, Zea mays
  misc_feature: Ceres CLONE 1390018-F
  misc_feature: Encodes the peptide sequence at SEQ ID NO. 21073
  misc_feature (446)..(446): n is a, c, t, g, unknown, or other
tccccgcggtggcggccgctctagaactagtggatcccccgggctgcaggaattcgcacgagaccattacctagaacatcctaatcgaaaagatctccccaatccgaccagaccggcaggcaccttcgactcgagcggagcaggcgaggcagagatggcgctgcgacgggcgctcctcagatcggtcaacttctcccccgacagcaaggctgcaattgagtacttttattctttctcaagggcacagtctgcttgttctctcaatggtgctggtctttgtcctgctagtagatcatttagcacccaggctgccactacgtcaagcacaccacagcctccacctccaccaccccctccagagaagactcactttggtggtctcaaagatgaggatcgcattttcaccaacctctatggtctgcatgacccttttctgaaaggcgcgntgaaagagaggtgacctggtataggaccaagggattggtgattaaggggggagactggatagtttatgaatgaagaaacaggccttcggggcggggagggggaggttttcccccggccggaagggccctttatgcccagggttcggaggacgccctctttattgcaccacagcctctacacaccccccgcacttgcaaaacacaaaag

SEQ ID NO: 21073 - protein, 101 aa, Zea mays
  misc_feature: Ceres CLONE 1390018-F
  misc_feature: SWISSPROT Homolog: EC 1.6.99.5 NADH dehydrogenase (quinone)
  misc_feature (98)..(98): Xaa is any aa, unknown, or other
MALRRALLRSVNFSPDSKAAIEYFYSFSRAQSACSLNGAGLCPASRSFSTQAATTSSTPQPPPPPPPPEKTHFGGLKDEDRIFTNLYGLHDPFLKGAXKER

SEQ ID NO: 21074 - DNA, 630 bp, Zea mays
  misc_feature: Ceres CLONE 1390019-F
  misc_feature: Translation starting site: 106
  misc_feature: Pfam Name: CYTH Pfam Description: CYTH domain
ggatcccccgggctgcaggaattcacacgagaccattacctagaacatcctaatcgaaaaaaaggaaccagtcctcctccgtctccatcttatcatccgccgccaatgctgcgccgcaacccaacccgcatcgagctcacctcctccgaccgcgacgagctcgaagaccacctccgcgccgccgcggcgagctccaccaaggatccttccggttacaccactccgtctccagtccttggcccgcagacctccaatcccctgctccaattcctccacccgaagcccggcgccgcgccatccaagtcccaacgcatcggcatcggcctctccaccccgccggctccggccccgaacccgcgaccaccccatctacctcatagaggttgagatcaagctccgcctccccgacgccgccgcgcaccgccgcctgtccgcgttcctcgcgccccgcctccgccgcacccacgcccagcggaacctcttcttcgacgacgccgcgcgcacgctcggagccgccaccgccgcgctccgcgtccgcctctacgacgggcccgacgaccgcggcccctcgcgcgccgtcctcgcgctcaagcgccgcccgcggatcgaggccggcgtcagccgcgtcga

SEQ ID NO: 21075 - DNA, 709 bp, Zea mays
  misc_feature: Ceres CLONE 1390020-F
  misc_feature (326)..(326): n is a, c, t, g, unknown, or other
  misc_feature (484)..(484): n is a, c, t, g, unknown, or other
  misc_feature (494)..(494): n is a, c, t, g, unknown, or other
  misc_feature (501)..(501): n is a, c, t, g, unknown, or other
tccccgcggtggcggccgctctagaactagtggatcccccgggctgcaggaattcgcacgagaccattacctgaacatcctaatcgaaaaacgaaatggttttgccttcgcttttgcttatgcgtacgcgcggagaatcacggcgcccaccttccaaccggacttgagtcacttgactccgccgcgttattccccgccagatctcattctcgccccaaccctaaccgccgacggtggtcatgatggccaacgatcctcttgtcccctgataatctctcttaggacgtcgaaacactacaccctggactcctactccactcgcgagnagtacgactcgatgcgctgctctgactacctcctccactctgccacctactctcccaccgaacgacgatcaccatcgtcgatagtgtgatcgagaatgaccaagtccgtaccttgtcaacaatcctcggtaccatcggccaggtccggggaccaaggnagttcatggnaatcccnttgctgccgggcgctgatgtgtccatagattggccagttcgggcgtcagtttctactctgcctacctcgtcggcgatagaagtgccctgaccacaagcacaacgatgaccaccaatacgtgtgggcagcccaggcggacgggttctcactctgcacccccaccgttttgataacatctggcaccccctccaaatttcggaaccccggg

SEQ ID NO: 21076 - DNA, 812 bp, Zea mays
  misc_feature: Ceres CLONE 1390023-F
cccccccccctaccctcccttcctattttatacttccactaatgaatcaaactggcactccccgcggtggcgaccgctctataatagtggatcccccgggctgcaggaattcgcacgagaccattacctagaacatcctaatcgaaaaacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaagttcccgagcagctcgaggaccgcggtgtcggtaagacttgctttgaagatcttgatcaccacaagagatttgctgaatttccggccactgtactttttccactggacatgtcctttcgcagcatagtcccgggatgttaagccaaggttttggtaacttaatcaaacgcatcccttgaggacaggaacttctgcttttgcctggccttgccaaaagtggctcgatccccggcgccatacctgcacacaaaccttgtgtccacttctctctattaatgtgtaattctatcctctcacccatatttcatactcgagatgtgattacaaatcagctacacttctttcatccgacctccccctctccaatttgtgataactccctccacccaccccctccccccccttaatccaccatcctcactccttctctataatcctattctccca

SEQ ID NO: 21077 - DNA, 736 bp, Zea mays
  misc_feature: Ceres CLONE 1390024-F
  misc_feature: Encodes the peptide sequence at SEQ ID NO. 21078
  misc_feature (624)..(624): n is a, c, t, g, unknown, or other
  misc_feature (658)..(658): n is a, c, t, g, unknown, or other
tccccgcggtggcggccgctctagaactagtggatcccccgggctgcaggaattcgcacgagaccattacctagaacatcctaatcgaaaaaaaggttctagacgctgactccattcacctactttgatgtccgtgatctcttcccatctgcatcaagggtttccttctccacctctgtggaacgctctagagaacaggggatggcggcggcggtcgagatggataggatctcataccagccacgaaagacggccgcatagcctcctccgcggacggagccggagcgcgagacgacgacggcggcgcccgtccccacgagcatgcagatcccgaggccacagcggcgcgcgacatccccactgcttgggaccttgagcacgggcgggcgcatggccaccgcgggctccatgccccagcgtggcatcgtgctctactgcctcctcgccctcttgtcgctgcttcctcgctttccggtgagttcgtcttcgaggagcgcttcgatgatgtgtcctgcaggcgctcaacaggaagaaccacaagccgctcttcgaggaactgctcaaggtcaaagaagagttgatgcttctgaggttcatcttcctactgttgatggtgtttcaggngatgacccagaggacatgcatccctggaagttgnacattcaggatgctgccatgcaagacattagacgatggggccaccaccaaggaaaatttcgttgctatcgggaatatc

SEQ ID NO: 21078 - protein, 138 aa, Zea mays
  misc_feature: Ceres CLONE 1390024-F
  misc_feature (113)..(113): Xaa is any aa, unknown, or other
MQIPRPQRRATSPLLGTLSTGGRMATAGSMPQRGIVLYCLLALLSLLPRFPVSSSSRSASMMCPAGAQQEEPQAALRGTAQGQRRVDASEVHLPTVDGVSGDDPEDMHPWKLXIQDAAMQDIRRWGHHQGKFRCYREY

SEQ ID NO: 21079 - DNA, 714 bp, Zea mays
  misc_feature: Ceres CLONE 1390026-F
  misc_feature: Encodes the peptide sequence at SEQ ID NO. 21080
  misc_feature (449)..(449): n is a, c, t, g, unknown, or other
  misc_feature (714)..(714): n is a, c, t, g, unknown, or other
gctctagaactagtggatcccccgggctgcaggaattcgcacgagaccattacctagaacatcctaatcaaaaattttccaaatccgtctacgccctcacgcacgcggcccaactagcctaacaaaccctagctagatttagaaaaaaagtttgtccccaatccgaaccgacgaggagctcgccgccgtgagatgtccgagtacgacgagcgctaccagggcaacgccgacatgcccgcagccgaaggcggctatccgcaggccgagtacgccgccgccgccgcgcctgccgccgggggttcgccgcccgcagacagcaagccctccgggttctccgaccacgccgacggccgctcctcccagcaccagcatgagacacaatcacatggacagtggttcctcgaaatctcgagaaagggaccgagaacgcgataagggcagggataggnagcgtgacagggatcgtggccgagaaaaggggagggacgagacagggataaggatcgggaaaaaagggaaggaaacaaaaatcgcgatcgccaccaaggggaccttcgagaaggcagggaaaaaagggaaccccgggatcgtttctgtgatcgggaccgcccccgggtgggcgcggccgcccccggtttgttcggtttcttagggaaaaaaatccggacaaaaatggcctccaagaccccgcccccccccctccaaaaagggggn

SEQ ID NO: 21080 - protein, 80 aa, Zea mays
  misc_feature: Ceres CLONE 1390026-F
MSEYDERYQGNADMPAAEGGYPQAEYAAAAAPAAGGSPPADSKPSGFSDHADGRSSQHQHETQSHGQWFLEISRKGPRTR

SEQ ID NO: 21081 - DNA, 692 bp, Zea mays
  misc_feature: Ceres CLONE 1390027-F
  misc_feature: Encodes the peptide sequence at SEQ ID NO. 21082
  misc_feature (345)..(345): n is a, c, t, g, unknown, or other
  misc_feature (347)..(347): n is a, c, t, g, unknown, or other
  misc_feature (351)..(351): n is a, c, t, g, unknown, or other
  misc_feature (352)..(352): n is a, c, t, g, unknown, or other
  misc_feature (355)..(355): n is a, c, t, g, unknown, or other
  misc_feature (356)..(356): n is a, c, t, g, unknown, or other
aagctggagctccccgcggtggcggccgctctataactagtggatcccccgggctgcaggaattcgcacgagaccattacctagaacatcctaatcgaaaacctcctccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtccgcgctaccggccgggggcgncncaannacnnaccctctcgctgggtcgtccgccccaaggccgtcaagtacaacttccggaccagtaccgcggtccccaagctcggggtcatgcttgtggggtgtcgaggcaacaacggatccacgctgacggctggcgtcattgccaacagggaggggatctcatgggcgaccaaggactaggtgtagcaagccaactactacggctccctcagccaggcttccaccatcagagtaggcagctacaacggggaggagatatatgcgccggttcaagagcctcctacccatgggggaacccagacgaaccttgtggtttggaggctgggtacatccagcagcatgag

SEQ ID NO: 21082 - protein, 101 aa, Zea mays
  misc_feature: Ceres CLONE 1390027-F
  misc_feature: SWISSPROT Homolog: EC 5.5.1.4 Inositol-3-phosphate synthase
  misc_feature (42)..(42): Xaa is any aa, unknown, or other
  misc_feature (43)..(43): Xaa is any aa, unknown, or other
  misc_feature (44)..(44): Xaa is any aa, unknown, or other
  misc_feature (45)..(45): Xaa is any aa, unknown, or other
MSPSEPTREESVYMAKLAEQAERYEEMVEFMERVRATGRGRXXXXPSRWVVRPKAVKYNFRTSTAVPKLGVMLVGCRGNNGSTLTAGVIANREGISWATKD

SEQ ID NO: 21083 - DNA, 711 bp, Zea mays
  misc_feature: Ceres CLONE 1390028-F
  misc_feature: Encodes the peptide sequence at SEQ ID NO. 21084
  misc_feature (416)..(416): n is a, c, t, g, unknown, or other
  misc_feature (448)..(448): n is a, c, t, g, unknown, or other
gcggtggcggccgctctattactagtggatcccccgggctgcaggaattcgcacgagaccattacctagaacatcctaatcgaaaaacacatacacccacaccccgcgcttcacgttctcaataatggcgccgttcccacgtcgtcttccggccgccgtgccacttcttctcctcctcggcgccgcagtggcccacgccggcgcggaggacaccgatggcggcaactcccgccggcggcactcccgcttgctgttcgcgttcggcaactcgctcaccgacacgggaaacggggccatcttcccggtgactgcaggcgggccattcacccagccgccgtacggggagaccttcttcggtcgtcccagcggccgggcttgcaacggcaggctcgtcctcgacttcctcgtggagtagntgaaggtgccagagccgacgccgtaccttggncggcaggacggccgccgactttgcgaaagaacggagccaactttgcggctgggtggtgcaacggcgctcgaaccaggtgttcttagcaaccaagggggaaaaagcccgctcccgcccatctctctcatcaacgaagacaagctggattccataaccgcccccagccccctgcgaccccgcctcctaacgcaccatcccaaacccccccgcccgacgcctaccctccaccgctggagaccccccgacccccccccccacccccg

SEQ ID NO: 21084 - protein, 96 aa, Zea mays
  misc_feature: Ceres CLONE 1390028-F
  misc_feature: SWISSPROT Homolog: EC 3.2.1.51 Alpha-L-fucosidase
MAPFPRRLPAAVPLLLLLGAAVAHAGAEDTDGGNSRRRHSRLLFAFGNSLTDTGNGAIFPVTAGGPFTQPPYGETFFGRPSGRACNGRLVLDFLVE

SEQ ID NO: 21085 - DNA, 663 bp, Zea mays
  misc_feature: Ceres CLONE 1390029-F
  misc_feature: Translation starting site: 194
  misc_feature (517)..(517): n is a, c, t, g, unknown, or other
  misc_feature (520)..(520): n is a, c, t, g, unknown, or other
  misc_feature (533)..(533): n is a, c, t, g, unknown, or other
  misc_feature (535)..(535): n is a, c, t, g, unknown, or other
  misc_feature (536)..(536): n is a, c, t, g, unknown, or other
  misc_feature (561)..(561): n is a, c, t, g, unknown, or other
  misc_feature (573)..(573): n is a, c, t, g, unknown, or other
  misc_feature (615)..(615): n is a, c, t, g, unknown, or other
  misc_feature (616)..(616): n is a, c, t, g, unknown, or other
ccccgcggtggcggccgctcttcaatagtggatcccccgggctgcaggaattcgcacgagaccattacctagaacatcctaatcgaaaataactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtgggtggggctggccgtggccacgccggtgttcctgatcttcagccccgtgctcgtccccgccgcgctgctcatcgggacggccgtcatggggttcctcacgtcggncgngctggggctcggngnnctgtccctcgctccgtgcctcgccncccggggggggnggggtcccccgccccccgggctcctggggggggcgccccccnngttgggggggccccggcccccccgttccctttttcgccccgcgcgtg

SEQ ID NO: 21086 - DNA, 744 bp, Zea mays
  misc_feature: Ceres CLONE 1390031-F
  misc_feature: Encodes the peptide sequence at SEQ ID NO. 21087
  misc_feature (744)..(744): n is a, c, t, g, unknown, or other
aagctggagctccccgcggtggcggccgctctagaactagtggatcccccgggctgcaggaattcgcacgagaccattacctagaacatcctaatcaaaaaacggtttgcgtataaataagtagtcagtcgctcatcttgttccttgtgaacatcgcagtgctgtagcctccttcgtcttgagcgagcatggagatgtcagccatggaggaagccctccccaaggcgatggagaggaggaaggtaggcctcagaaccattccgttcatcatcttaaacgagatattcgagaaggtggccacgttcgggctgtcggccaacatgatcctgtacctcaccgagcggtatctcatgaccaacgcctttgccaccgtcgtcctctacttctgggatgccttctccaacttcctgcccatcttaggcgccgtgctcgacgacgcccgcctcgaccggttccgtgtcaacaccctcgtctcctgcgttagcctcttcgcgatgtgcctgctgaagatgacagccatcattacgttgaaaaacgaccccccctttagtcccgccctttcccctcgccaccccacaacccacctttcctattcttcatcacccattcctctccacctccactatctcgctacctaactccgtacacctaccccttcatagccactcttccatccccccaccccctcattatataatccatgtaccaacccatttcctctacttttcctatagcaccattccn

SEQ ID NO: 21087 - protein, 149 aa, Zea mays
  misc_feature: Ceres CLONE 1390031-F
MEMSAMEEALPKAMERRKVGLRTIPFIILNEIFEKVATFGLSANMILYLTERYLMTNAFATVVLYFWDAFSNFLPILGAVLDDARLDRFRVNTLVSCVSLFAMCLLKMTAIITLKNDPPFSPALSPRHPTTHLSYSSSPIPLHLHYLAT

SEQ ID NO: 21088 - DNA, 689 bp, Zea mays
  misc_feature: Ceres CLONE 1390034-F
  misc_feature (574)..(574): n is a, c, t, g, unknown, or other
  misc_feature (598)..(598): n is a, c, t, g, unknown, or other
  misc_feature (689)..(689): n is a, c, t, g, unknown, or other
aagctggagctccccgcggtggcggccgctctataactagtggatcccccgggctgcaggaattcgcacgagaccattacctagaacatcctaatcgaaaaatacttttcctccttcagtttttatcacacgtcaatggagtggggctagcaatggcatggtaacttttccaatctttttgcattaaaaaagaaatcctaaagaaaaaggattactaaacgagcacgctcgccggcgctgggaccaggctctgggtctcgcatcacgatcagatccaatccaaggccgcgccccagcccggcggatggattccgccgccgtggccatcgtgacggtgccgttcccggcgcagggccacctgaaccagctgctgcacctgtccctgctcctggcatcgcgggggcttcctgtccacttcgccgcgccggagccgcacctccgggaggcccgcgcgcgccctgcacggctgggggcccgaccccccgcgtcgtgtgcttccgcgcgctggacgtgcccgcgcacgactccccctccccggacccatcctccccgttcccggcgcacatgcagcctnctgttcgaggccttctgcaccggncgcgcgggcctcgctagccgcgcttctgggcggaagctggacgggtcgcaccgaccgcgtcgtcctcctctacgaacgcatgggggccttn

SEQ ID NO: 21089 - DNA, 769 bp, Zea mays
  misc_feature: Ceres CLONE 1390037-F
  misc_feature (320)..(320): n is a, c, t, g, unknown, or other
  misc_feature (378)..(378): n is a, c, t, g, unknown, or other
tccccgcggtggcggccgctctataactagtggatcccccgggctgcaggaattcgcacgagaccattacctagaacatcctaatcgaaaaagttcttctccacctcgtcctcctcctgctcctgcattctcgcccgtcccccaaattcaccttggccaccctccaccacctcgtcgacgcgggcagcagttcgcctcatcgtcctcccacctgacgacgtcgcggttcgcgctctcgcggagtgccgcgcacccacgtctcccgcgagttccacgccttctgtgccacgcgcggacgcgccacctggagccactgttcngcgcgccctccgcatctcccgactctacatctccatccgcggaaagcagacacctccnatccttctttttcacgcagtcattgcttggcctccttagcccaactgttgggaacagaggttctgggttcctcataaggaaagggaacggggccgcaaaggggaccccaccaactaaaaccggggttttcctaacaaaatccccggagggtttttggggtttctttggggggcccacatttgggccagggggggtttgtccacagggggggtttttgggggagggggaacccccatgggggaaagggggggaacacaccccccaaaaaaaggggacccccggcggcgggaaaaataaaaggggtgccgggggggtaagagaaaaaagaagattaggggaggacgggcggggggcggggaaaaataggtaaacacacccccggttgatatgg

SEQ ID NO: 21090 - DNA, 721 bp, Zea mays
  misc_feature: Ceres CLONE 1390041-F
  misc_feature: Encodes the peptide sequence at SEQ ID NO. 21091
  misc_feature (676)..(676): n is a, c, t, g, unknown, or other
  misc_feature (677)..(677): n is a, c, t, g, unknown, or other
  misc_feature (683)..(683): n is a, c, t, g, unknown, or other
  misc_feature (684)..(684): n is a, c, t, g, unknown, or other
tcaccgcggtggcggccgctctagaactagtggatcccccgggctgcaggaattcgcacgagaccattacctagaacatcctaatcgaaaaaattccggccacaccccccgctacgcctgtgctgccgcctccccttcctcttcgcttcccgtgcaagcttcaccgccgccatctcgtcctctcgacgcgatgcttccccttccgcgccgcggatcctctatccccgccttccctgcccgctccggctcttgcacctgacccagtccgccaatctgttccccttttccgtacgagggtactatcgccggccatttcgattcgaagttgatcggatcagcgtatgctgatgggtcgcgatgctgagaagacctctccgccggtgccatcgtcggaattggaacaggaagaagacgacgactgctacctaagcgatcaggaggacgatgccctaaaagaagtccgtctccatgtcctcgaagacgagcacctcgaggactgccattggtcccgctcatgcgtgatcaccaaggaatccctcttggaagcgcaaaaaaaggacctttccaagttgctggggactgcaccgacccagaaggaacctggcccggacgattcctccccagttacgctggaaaggaaaacccaaattccgcttaaagaggggaggaaggacgnnccgccnnggcggagagagaaatattcttggacgacattcaacac

SEQ ID NO: 21091 - protein, 124 aa, Zea mays
  misc_feature: Ceres CLONE 1390041-F
  misc_feature (110)..(110): Xaa is any aa, unknown, or other
  misc_feature (113)..(113): Xaa is any aa, unknown, or other
MGRDAEKTSPPVPSSELEQEEDDDCYLSDQEDDALKEVRLHVLEDEHLEDCHWSRSCVITKESLLEAQKKDLSKLLGTAPTQKEPGPDDSSPVTLERKTQIPLKEGRKDXPPXRREKYSWTTFN

SEQ ID NO: 21092 - DNA, 694 bp, Zea mays
  misc_feature: Ceres CLONE 1390044-F
  misc_feature: Encodes the peptide sequence at SEQ ID NO. 21093
gctctttcctagtggatcccccgggctgcaggatttcgcacgagaccattacctagaacatcctaatcgaaaactctctcccacggttgcttccaggtcccaccacgtagggaggggattggagacgccgagctccaccggaggcgaaggcggaggcgcgtggcgcgccctcggactcctcgctgtcttgtttttcaggacaaaatggaccttgcacctcagggtttgataacacagcaacaaaaggcaaatgagcgaaggccagttggtagctcacaaatttggacacggtatggtgttctgcttccaagccagcagactcgaaagctaaaagaatggattctgactgatgagcagcaacagcttgttaatgctagtggtcttggacatctggcacttaccactgggtttaccattgaccgttctttgctgacatctttttgtgaaagatggaataatgaaacaaatactgcacattttcatgggaatttgagattgcgccttcactttcgtgatgtttcatatattcttggcattccagggactggctcatgtggtcgaccgcacaaccaaattgaggatgaagctgcgcaagcgaacgagcctgcgattacttaaagacagagtccccgcccaacgaaaacccctcggcacgacccaaatcaccattgactacgcacaacaaacacacttc

SEQ ID NO: 21093 - protein, 137 aa, Zea mays
  misc_feature: Ceres CLONE 1390044-F
  misc_feature (70)..(120): Pfam Name: DUF1723 Pfam Description: Protein of unknown function (DUF1723)
MDLAPQGLITQQQKANERRPVGSSQIWTRYGVLLPSQQTRKLKEWILTDEQQQLVNASGLGHLALTTGFTIDRSLLTSFCERWNNETNTAHFHGNLRLRLHFRDVSYILGIPGTGSCGRPHNQIEDEAAQANEPAIT

SEQ ID NO: 21094 - DNA, 698 bp, Zea mays
  misc_feature: Ceres CLONE 1390047-F
  misc_feature: Encodes the peptide sequence at SEQ ID NO. 21095
  misc_feature (511)..(511): n is a, c, t, g, unknown, or other
  misc_feature (541)..(541): n is a, c, t, g, unknown, or other
gctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggaccaaggagttcatggaagcccttgctgccggcgctgatgtgtccatgattggccagttcggncgtcggtttctactctggctacctcgtcgnccgatagagttgtcgtgaccaccaagcacaacgatgactagcagaacggggtgggaggcccaaggggggcggggtcgttcactgttaaccgggaaacggccagggaagaagtttggaaggggcaccaaaaatccactggttcccccaggacgaacta

SEQ ID NO: 21095 - protein, 138 aa, Zea mays
  misc_feature: Ceres CLONE 1390047-F
  misc_feature (28)..(133): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGRRFLLWLPRRPIELS

SEQ ID NO: 21096 - DNA, 728 bp, Zea mays
  misc_feature: Ceres CLONE 1390050-F
  misc_feature: Translation starting site: 228
aaagctggagctccccgcggtggcggccgctctatcactagtggatcccccgggctgcaggaattcgcacgagaccattacctagaacatcctaatcgaaaactcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggtgtcgacggcctcccgccggggcctccgggttggccggtggtggggaacctgttccaggtgatcctgcagcgactgcccttcatgtacgtggtgcgcgacctccggtgagaagtacgggcccatcttcatcatgcggatggagcagcgcaccctcttcgcggtcacctcgccgcagctcatccacgaggtcgtgatgaaaccatgaccccatgcaccccatacccccctgaggatagtctcatccgctctcctctttccgagccccaaactcaaccgacaacgttgtattactatctccccctgcaaccaagcttctcacccaccaacctcaccgaacacgcattacgtctcaacccccccacacacacctcctccccctccaatatcgtaccccccccatccaattacacttcctcctcg

SEQ ID NO: 21097 - DNA, 679 bp, Zea mays
  misc_feature: Ceres CLONE 1390053-F
  misc_feature: Encodes the peptide sequence at SEQ ID NO. 21098
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (533)..(533): n is a, c, t, g, unknown, or other
  misc_feature (614)..(614): n is a, c, t, g, unknown, or other
  misc_feature (615)..(615): n is a, c, t, g, unknown, or other
  misc_feature (639)..(639): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
aaagctggagctccccgcggtggcggccgctcttcaactagtggatcccccgggctgcaggaattcgcacgagaccattacctagaacatcctaatcgaaaaacatcgacccagccatctcctcaccctcgttcaccacacaggccgccactcctttagtagcttgtgatttgtacgtcgacgagatcactggtcgggtggcggacgaccacacatggggaagggtagtgtgggtgcatcatggtgggggttcctcctgctcgccggggtgctgctggtcgtaacagccacggccggggcggaagacggagtggtccgacgggaccccaaggaggacctgcggtggtgcaagcaaggcgtgtgagatgcagtaccgaaaaggaaccccgccggaacaaggaatgcctagagcgagtgccgccagcgcgaacctccaagttgtaccgggccgagacagccgacaagcggggtgggacggctacctctccgcttcggnnnaaaagagacgagtggccgtgccagtggctgtgccnccccacagagggccagcgtggggaaacccgaattgatttgagagggggggccgcgccgcggactgtgcgtcaattggtggnnaaaaagtacacgccgggacgaaanaccgggcagttacgaccgnnncagagagaggccaaccggg

SEQ ID NO: 21098 - protein, 49 aa, Zea mays
  misc_feature: Ceres CLONE 1390053-F
MGKGSVGASWWGFLLLAGVLLVVTATAGAEDGVVRRDPKEDLRWCKQGV

SEQ ID NO: 21099 - DNA, 743 bp, Zea mays
  misc_feature: Ceres CLONE 1390056-F
  misc_feature: Encodes the peptide sequence at SEQ ID NO. 21100
  misc_feature (287)..(287): n is a, c, t, g, unknown, or other
  misc_feature (309)..(309): n is a, c, t, g, unknown, or other
  misc_feature (313)..(313): n is a, c, t, g, unknown, or other
  misc_feature (465)..(465): n is a, c, t, g, unknown, or other
  misc_feature (466)..(466): n is a, c, t, g, unknown, or other
aaagctggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttggcctttttcccgcgagcccngcgtcgtacggggtcgagaagncggnggccgcttcggcccctgccacacccgaacctccgggcccggtcaattcaaggcgccgcctccgggcccgggcaaaaccaaagccgcgcccccggggccccgaaaaacccaaagccgcgccaagggggggaaggaaaaagggctcaaaccttnnttaaactacacaaaagcccaaggggcgtaaactcgggggcggtgcgttttgcattaaacgacaaccaccgactaggttcgagcaccttgccgccttcggtactgaacctcagagccgggtgcaaagatcattcctctcttccctcgtgggaagtaagaccaacgggggcctcttgccccccatatttgtccgccccccccccagggagagaggtggtggggggtgtgtttggcgcgccgggcttcttggtcgtccatcgttgattcccccaccctcg

SEQ ID NO: 21100 - protein, 78 aa, Zea mays
  misc_feature: Ceres CLONE 1390056-F
  misc_feature (27)..(27): Xaa is any aa, unknown, or other
  misc_feature (28)..(28): Xaa is any aa, unknown, or other
MGAVTSTVAARFGLFPASPASYGVEKXXAASAPATPEPPGPVNSRRRLRARAKPKPRPRGPEKPKAAPRGGRKKGSNL

SEQ ID NO: 21101 - DNA, 721 bp, Zea mays
  misc_feature: Ceres CLONE 1390064-F
  misc_feature: Encodes the peptide sequence at SEQ ID NO. 21102
cgctctgtactagtggatcccccgggctgcaggaattcgcacgagaccattacctagaacatcctaatcgaaaagctgaactgctgacgcttcgcgcgggtccgaggtcaggcggcagcagcacggagtagcaccagggcgaccgcccaggttatcgtcggccgccggcgacctgtaccccggcgagaagatgcatctgagcgcgaacgaggggatcgagggtctgcgattcgcggtgacgggcgggcagggcttcgtcggagctgccctcagcctcgagctgctccgccgctgtgcccgcgaggtccggtccctcgatctccgcgcctcctcctcctggtcccagcagctcctcgacgccggcgtccgaatcatccaaggggacataacaaagaaggatgacgtgccgcacggctttcatgcacatggcatgcgctcttcccccttggctgcatattgcgggtacccgtcatgcacgcgcgccccacggcagctcccgtccctcgttacatcgcccgtcccctttcatcgcctcgccacctcgtctttattttcccgccggtgagcctgcccgctcccgtctcctcccccccccccctccgagcgcttccagcattttcttatattgtctacaaccctcctcatctccctccctccaaacccaccccctcgcgcgcttactttgtctattttcccttctctcttccccccctctgccctg

SEQ ID NO: 21102 - protein, 124 aa, Zea mays
  misc_feature: Ceres CLONE 1390064-F
MHLSANEGIEGLRFAVTGGQGFVGAALSLELLRRCAREVRSLDLRASSSWSQQLLDAGVRIIQGDITKKDDVPHGFHAHGMRSSPLAAYCGYPSCTRAPRQLPSLVTSPVPFHRLATSSLFSRR

SEQ ID NO: 21103 - DNA, 724 bp, Zea mays
  misc_feature: Ceres CLONE 1390068-F
  misc_feature (267)..(267): n is a, c, t, g, unknown, or other
  misc_feature (363)..(363): n is a, c, t, g, unknown, or other
  misc_feature (387)..(387): n is a, c, t, g, unknown, or other
  misc_feature (408)..(408): n is a, c, t, g, unknown, or other
  misc_feature (487)..(487): n is a, c, t, g, unknown, or other
  misc_feature (489)..(489): n is a, c, t, g, unknown, or other
  misc_feature (490)..(490): n is a, c, t, g, unknown, or other
gctctagaactagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcggtatcccggccgctggcgctggcgcgagagttggtnggtggtggtgttcagcccccctccctcttcaggtttagggtggagcgatccgtgcaggccaacgcggggtgcgtgacccagaaagggaaccgccgncttttttctcttctggcgccccgnctttccaatcccctcctcaanctcatccgccccgcccgaaccattaacaaaaaagggccccgcccttcttcttcctcttctcctctggcccctggttggncnntttggtccgggtccccccaccccctttttggatccagccggggttccttccgcgggggcggggcgggccccatggggaaattggtggaaagcccaaaaaaaattccaaaagccccccccgggggggctcctcccccgaagggaagcggtccaaattgggaaaaaaaaaagggagcgggaaacccctaaggggggggaaaaacaacgccgccccggggtccttggttcaaacacc

SEQ ID NO: 21104 - DNA, 715 bp, Zea mays
  misc_feature: Ceres CLONE 1390071-F
  misc_feature: Encodes the peptide sequence at SEQ ID NO. 21105
  misc_feature (567)..(567): n is a, c, t, g, unknown, or other
ggcggccgctctatcatagtggatcccccgggctgcaggaattcgcacgagaccattacctagaacatcctaatcgaaaaatttcacgctgacctcgatgctgcacctggacagggaacgtacgtcgccgctgccgacgtcggcgccggtgttcgcaggcgcaatggagaaggcgctctcctatgcgacccgcttattcccgtataaggtcctcgaacgaagacgctcacagacagatccttcgtaccgaactttcggctgacaaggggcaagcagtcggatgagcccgaaccggagacgagcacgactacttccggggggggtaggtaggtgagctagaggtcctggacgcgctcctcgacgtcgacccctctctcgtccgccgcggaacgctctacgaccgactctccgcgctccacatcgccgccgcgaatggccgcctcgaggtgctgtcaatggtcttggatcacggggtgccgccggacgtggtgaatcggcacaagcagacgccgctgatgctcgcggcgatgcacggaaagactgactgcgtgctgaagctcctgaagnccggcgccaatatcctcatgttcgaatcccagcacggttggacctgcctggacaacgcgtactaattcgaacactttggattgtttgcaggccattttaaaggagccgaaaagaacgaacggcaaccctatccttcatctcaagaccc

SEQ ID NO: 21105 - protein, 58 aa, Zea mays
  misc_feature: Ceres CLONE 1390071-F
  misc_feature (15)..(47): Pfam Name: Ank Pfam Description: Ankyrin repeat
  misc_feature (38)..(38): Xaa is any aa, unknown, or other
MVLDHGVPPDVVNRHKQTPLMLAAMHGKTDCVLKLLKXGANILMFESQHGWTCLDNAY

SEQ ID NO: 21106 - DNA, 669 bp, Zea mays
  misc_feature: Ceres CLONE 1390072-F
  misc_feature: Translation starting site: 333
tccccgcggtggcggccgctttccaactagtggatcccccgggctgcatgaattcgcacgagaccattacctagaacatcctaatcaaaacgaaggaacctgctcggcctcgccgtccccggcgcgtggagcgcgtcgcgtccgccacacgcaccgaccatcccctgccctcatcagcaatccccggcccgcagcgtacaaatacacgctccccgccgctccgacctcactttccccgcctccatcaccaattcacgatctcctttcccgcaccgcgccccggatcgccggctcgcaattccggagttaaattcccctccaccgcaaccgtcatgggcggctcccacagccgcgaggacgtcgatctcacctcctccgacgaagaggaggaattcgaggacgactatgacgcccgatcacccatcgcggaggccgcagcgagcgcggggcagcgcgacgacgacctcctccgcaccgccacaccttcctcgcttgaggccatcgacgccaagctcaggtcgctggatctcaagtaccagagacctaccgccgccaggtctacctccacgtcggaggggcctcgccttcggggcgttggtggcccgcaaccccccccgaccaacgcatcctgcaacattcaaaggactacgccccccccaccacggtggt

SEQ ID NO: 21107 - DNA, 689 bp, Zea mays
  misc_feature: Ceres CLONE 1390073-F
  misc_feature: Encodes the peptide sequence at SEQ ID NO. 21108
  misc_feature (460)..(460): n is a, c, t, g, unknown, or other
  misc_feature (479)..(479): n is a, c, t, g, unknown, or other
  misc_feature (689)..(689): n is a, c, t, g, unknown, or other
aagctggagctccccgcggtggcggccgctctagaactagtggatcccccgggctgcaggaattcgcacgagaccattacctagaacatcctaatcgaaaaacaaacttcccctgtcacgagagtacgagaccacgccttctgtgggatcaatcggctagggtttcggagatgttcggccgcgcgccgaagaagagcgacaacacccggtactacgagatcctgggggtttccaaggacgcgtcacaggatgacctcaagaaggcctaccgcaaggccgccatcaagaaccaccccgacaagggcggcgaccccgagaagttcaaggagctagctcaggcttatgaggtcctcagcgaccctgaaaagagagagatctatgaccagtatggcgaggatgccctcaaggagggaatgggaggcggtggtgggatgcatgatccctttgacatattccagtncattctttggtggtggaangcccttttggaggtggcagcagtaggggcagaaggcaacgacggggaggatgatgtggttcatcctctgaaggtttctctggaggatttgtacaatggcacatcaaagaagctctctctgtcccgcaatgtcctctgctccaagtgcaatggtaagggttccaagtttggagctttcgtcgaggttgtgtggggttggtcaaggttcttn

SEQ ID NO: 21108 - protein, 172 aa, Zea mays
  misc_feature: Ceres CLONE 1390073-F
  misc_feature (13)..(71): Pfam Name: DnaJ Pfam Description: DnaJ domain
  misc_feature (97)..(97): Xaa is any aa, unknown, or other
  misc_feature (103)..(103): Xaa is any aa, unknown, or other
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQXILWWWXALLEVAAVGAEGNDGEDDVVHPLKVSLEDLYNGTSKKLSLSRNVLCSKCNGKGSKFGAFVEVVWGWSRF

SEQ ID NO: 21109 - DNA, 656 bp, Zea mays
  misc_feature: Ceres CLONE 1390074-F
  misc_feature: Encodes the peptide sequence at SEQ ID NO. 21110
gctctagaactagtggatcccccgggctgcaggaattcgcacgagaccattacctagaacatcctaatcgaaaagggaaaaaggctcccaacctgttccgagccagccggccatggcgattagggctggccgctcgccccttctccacctcctcgccctcgccttcctcatcctcgccttcctcatcctcgccgcctctccctgcctccaagctcgagtggaccatcacaaacagatatctcactggactgggcaacccaactttgacctgcagaatgtctcatcgggtcgaaaggatggccctcatctcctgggtagatcaaaggaaataacacacatgaaattaaggagagttgctgtaaggaagaaaatggaagtagtgcagcaggatgatgaagcgttagttaaacttgagaatgcaggtatcgaacgttcaaaagctggtgactctgctgtgctgggaaatacagcatctggagacgtgaaatgaaaatgaaaggcagatccaaggtcccgttgatgcgagatcaaatgtcatggccagatatattctgttcttgccaatcgagggacaagctgatcccaacaggagctggtgcaaggtaaggaaaagcaggatccttggggaagtaaggtgaggtgaattccaagggggt

SEQ ID NO: 21110 - protein, 125 aa, Zea mays
  misc_feature: Ceres CLONE 1390074-F
MAIRAGRSPLLHLLALAFLILAFLILAASPCLQARVDHHKQISHWTGQPNFDLQNVSSGRKDGPHLLGRSKEITHMKLRRVAVRKKMEVVQQDDEALVKLENAGIERSKAGDSAVLGNTASGDVK

SEQ ID NO: 21111 - DNA, 825 bp, Zea mays
  misc_feature: Ceres CLONE 1390075-F
  misc_feature: Encodes the peptide sequence at SEQ ID NO. 21112
tctagtttctccgtctctccccccgccacccccaccccccccccaaacctcccctccccgcggtggcggcccgctctataactagtggatcccccgggctgcaggaattcgcacgagaccattacctagaacatcctaatccaaaaaatctctctcttctcctcgcctcgccttggtgttcacgccgtcgctagcgcctgccgcggcgaagcttctgccctccccggcgccaggctcgggtcgtcgtcgtccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacccagcggcgccagcctgcaagaaaccagcccctattcgagacaaggccgatctttgttgccttgccgagcttccaccgaatcaaggtcgaaccatggccgccggcccctccaactcagacccacccaaacccctctccatttaatggaagcacccctgcaccaaacccccgatccgggccgccaaacccagaagctccacttccccaacttgccatccccccccaccccgttctactgaactatgccaacaactccccaccaacaccccccacacctctaacacctacataccacttccctccacctcctcccctatcaatattcaatccactacaccctaccccactctcttatcccttcccaatttaccacccaccataaccccaaccacgataaaaccttccacgacatcttca

SEQ ID NO: 21112 - protein, 31 aa, Zea mays
  misc_feature: Ceres CLONE 1390075-F
MEAPLHQTPDPGRQTQKLHFPNLPSPPTPFY

SEQ ID NO: 21113 - DNA, 700 bp, Zea mays
  misc_feature: Ceres CLONE 1390076-F
  misc_feature: Encodes the peptide sequence at SEQ ID NO. 21114
  misc_feature (509)..(509): n is a, c, t, g, unknown, or other
  misc_feature (629)..(629): n is a, c, t, g, unknown, or other
  misc_feature (641)..(641): n is a, c, t, g, unknown, or other
  misc_feature (655)..(655): n is a, c, t, g, unknown, or other
tccccgcggtggcggccgctctagaactagtggatcccccgggctgcaggaattcgcacgagaccattacctagaacatcctaatcgaaaaagtaatacggcacgccgttcaatctaccgggacggcgagacggagaatagaagacgtcagcactcagcagttcagcactgacccgtcggccgtcgccctcccggctcgcaaccgcatctctctcggcttctggcctcttcctagttcctaactaccaccgccacctctaccactggcctcaatctgcaaaccctagccctcgtcgccggcggccatggccgagaccgtcgacgacaaggtcagctactttcaggccgtcaccggcatctccaacacggacctctgcacggagatcctcgccgcgcacaactgggacctggcagctcgcggtgtccaccatcaccgccaaccccttctcgccctccgcttcggcctccacctcctcgcgtgacccggccccttccgctccgttggcggnagatggcggagtacgtcgcgcccccgcccccgctgccgctgccgctgccgcccagcagcagccggggatcgcgtggaagctggtgacgctccccttcacgtggtctcgggtggggtcggnctcgtcgcggcncgttccgccttggngcctgggtggccggggggcgggtgcccggtccctctccttctcgc

SEQ ID NO: 21114 - protein, 58 aa, Zea mays
  misc_feature: Ceres CLONE 1390076-F
MAETVDDKVSYFQAVTGISNTDLCTEILAAHNWDLAARGVHHHRQPLLALRFGLHLLA

SEQ ID NO: 21115 - DNA, 635 bp, Zea mays
  misc_feature: Ceres CLONE 1390077-R
cagattgggtaccgggccccccctcgaggtcgacggtatcgatattttttttttttttttttgacattttttttttttaacgtggaaaacccctccaaagtgaaggggaaaaaaccacgggcgccggcaggcaacttctcactattttcgggtggttacagatcgcaggagatttacaattgagatagatatctcctgcggcttacaaagatatttatagaggtgaaaccctaaaacgatccgtaccgcgggtctgctccgtctgcctcctcgtgcggagtgccctgacctacattaccaccactcgcctcgtgaccgatgagaaaaagatcatcctcctccaccacttcagtttcacaacgggagttatgccacggtctccctcagacgcggactctactactcctaccaggatcacacctcgcgccagagactcctggcgtatctgtatcctgctcatacgcccgtgccctgtaccaaggatatgatactggacatagtactacccatcagagccagcaaacggcccacgccctctggggagaccaggagcgagcacaactgccctatgccccatgtcaaggaaggtcgccgtgtactcgtgtacaccatgatgacggtcctctaggctgaca

SEQ ID NO: 21116 - DNA, 694 bp, Zea mays
  misc_feature: Ceres CLONE 1390077-F
  misc_feature: Encodes the peptide sequence at SEQ ID NO. 21117
gctctataactagtggatcccccgggctgcaggaattcgcacgagaccattacctagaacatcctaatcgaaaaacaattaaggttcctgttctcgaacgatcagtctgagatgcatgcacgacgatcgatctacagctagcgttgcattgcatgacgatatggacctacactcgcgggcaaagcccatggacaccgccgtcgccgtcgcggtggatgacgtcaacgacgtcctcctcgtgcgaagtcgcaaccccaatcccaccgccgcgcagatagggagagaggaccccgcgacatgtcagtcacgtcgtcgttcacagcgggggagtcgtctcgagctggcgagcaaccggagcgcgacgaggtggtcgagttcctggactgcccttgggtagcactctcctccgccatcgtcgtcatcggcgccaacgacgagcggacacggatgctcgcgcccggtgcctccgacatctttctcgacctccagcccccgctggtcggcgcctcctatctggtcctgcccgagggcatctcctccgactaccggtattccggataccaaacctgcgtcctggccgccttggtccagttgcctcctccttcagaataaacaagcccgaggcagcacttaacctcgcatgtctccccttatcgtgtcagcactctttatgctgtacttctcaacgcacccc

SEQ ID NO: 21117 - protein, 104 aa, Zea mays
  misc_feature: Ceres CLONE 1390077-F
MSVTSSFTAGESSRAGEQPERDEVVEFLDCPWVALSSAIVVIGANDERTRMLAPGASDIFLDLQPPLVGASYLVLPEGISSDYRYSGYQTCVLAALVQLPPPSE

SEQ ID NO: 21118 - DNA, 731 bp, Zea mays
  misc_feature: Ceres CLONE 1390079-F
  misc_feature: Encodes the peptide sequence at SEQ ID NO. 21119
gctctattactagtggatcccccgggctgcaggaattcgcacgagaccattacctagaacatcctaatcaaaaaataccccgtctcggttctcaaacaccgccgccgccgttctcccgacatctccccgtccaggtcgttgggtcagcccctatccttcaccttcacgacttcacctgcttctccactgcgcgccccgcccccggccccgtcgtgcgccctgctcagatccatcgcacggggcttgccgcaccactgcgccaagcaaaaggtgggcggccagcggcgcgtgcgcagatcatgcactgttgtcttatgaagattggtaaggggagaaagaagatgaggaataaacagcgaaaatcatctgccctcggttctgatgcaggatgtggatcttctttatcttgtattgtatggagccttgcaggcattcgaaattagcatgcttccatttccttacacaccacccacaccgtgatcaacacccatgtatacttgcaatccctcttcctcaccatcataaaaccatagagacacccttagacatacaacccccgcatgcacaaacaatcacccgccgaatgcttcaggcatacgacgaaagcagtaaaccaccactataccacagccagttaacacatatactaatatgcaaccctcccctcccaaattctaaacgccactttctcccacctttattaaaacacaatagtcggcaaatgatagtca

SEQ ID NO: 21119 - protein, 47 aa, Zea mays
  misc_feature: Ceres CLONE 1390079-F
MHCCLMKIGKGRKKMRNKQRKSSALGSDAGCGSSLSCIVWSLAGIRN

SEQ ID NO: 21120 - DNA, 732 bp, Zea mays
  misc_feature: Ceres CLONE 1390082-F
  misc_feature: Encodes the peptide sequence at SEQ ID NO. 21121
acccgcggtggcggccgctctagaactagtggatcccccgggctgcaggaattcgcacgagaccattacctagaacatcctaatcgaaaacccaggtccgcgagatcgccgacggcctcgagcgcagcgggcaccgcttcctgtgggtgctccgtggcccgccaccgccggacggttccaagtacccgacggacgccaacgtccacgagctgctcccggaagggttcctggagaggacgaagggccgaggcctcgtgtggcccacgtgggcgccgcagaaggacatcctcgccaaccccgccgtcggcggcttcgtcacccactgcggctggaactccatcctcgagagcctgtggcacggcgtgccgatggtgccctggccgcagttcgcggagcagcacctgaacgcgttcgagctcgtgtccgtcatgggcgtcgccgttgccatgcaggagaacaggactcgcggcaacttcatcgaggtgaaggacctgtagcgctgcattactattttttatgagctacccccacaaccccccatacaatgtaggtatcctaaacccaccagaatatctccaacattacccaccaatatgcgacgatgtaaactgcttccttctcacatcccccgaccaccaccccgccacccaatccgatatagctacctcctggctccccaaaataaccaccacttcgagtcttgcccctcacccacctttcctcacccttctt

SEQ ID NO: 21121 - protein, 42 aa, Zea mays
  misc_feature: Ceres CLONE 1390082-F
MVPWPQFAEQHLNAFELVSVMGVAVAMQENRTRGNFIEVKDL

SEQ ID NO: 21122 - DNA, 747 bp, Zea mays
  misc_feature: Ceres CLONE 1390084-R
  misc_feature (747)..(747): n is a, c, t, g, unknown, or other
cgattgggtaccgggccccccctcgaggtcgacggtatcgataagcttttttttttttttttttaaattgattttgcaggattttagtcatcgcaaaattcaagtaaaatatatgggtccgtaaaagtagatccttgtgtaacagactgatctaaacttcgaatcattttaacaaagcatgacagtttttttcacaactgccttgcttttctatctatgacagctgaaatcaggacagaacatgacagcatccgatcgacccttgctgcctacatgggtcacgacatatcatcatgggcgctaacattgcaaacataatccaggcctaacggaaccataacgctatggagaggaactgtgaatattgaccacaatcacaagttcattcctcgatgcccatcgtgctatgcatacaacacaaaatccagcctttatccctcaataaaccagtttgaccatgtactcttgtcacactgtctgcacaaacactccaccgttagagctcttcgccgaaagtgaggtttctacacagaaacatgtgagctcaatccgaaatctcatcatttgcttgcgacctccacgatgctggataagagggtccttagctccaccatcacaacatcctgatagcctatcacctcgatgggaatgacgctctcaccgcatccgtagaacgttatcttattcaggctggtgacctacacgttgtagctgagaatgcttcatcccccttgcgaacagaccgcn

SEQ ID NO: 21123 - DNA, 690 bp, Zea mays
  misc_feature: Ceres CLONE 1390084-F
  misc_feature: Translation starting site: 236
ggagctccccgcggtggcggccgctctagaactagtggatcccccgggctgcaggaattcgcacgagaccattacctagaacatcctaatcgaaaaaaccgcagcagggcgtgtgggcgagtgagtgagtcagtgaggctgggatagcaacagcagcatcagtgcgccgaactcaacttctcttcttgccgggcggtgcggcgcgccgcggagaggcaccgcacggccgcaagcaatgacgcgccggcagaggacgcgcagcaacgaggagctcaaggcggaggacttcgtcgactcggtgctcaacttcggtgagaagaaggaggatgttcaacaggaaaaataggagggcgtcggacaccgccagtgcggcgtcggagtgtcaagtccaagaacctggaggccgagcgtaagacgagctgttagctcaaccgtaacatcctcgcgctcaggtacgtggtgccgaacatcataaagatgaacagggagtccacgctctcgaaggatgtcgacctcatcaagaagctccagaaccatgctatgtgagatagcaggccagatcgacgactcctcggcaaagggcaggggagaagcaaaccactgacgacgtgatcatgaatccttctctggccaggtagaagatgtcagcatcagggatcagaatcagaggtgactccctcagctctgatg

SEQ ID NO: 21124 - DNA, 701 bp, Zea mays
  misc_feature: Ceres CLONE 1390085-F
  misc_feature: Encodes the peptide sequence at SEQ ID NO. 21125
gctctataactagtggatcccccgggctgcaggaattcgcacgagaccattacctagaacatcctaatcaaaaaaaaagacagtaccgccgataaggacagagagtcagagactgacagactggaaacgcccgcgcgtgccggagatggagagggacgtcgtgctctccgcacccgaggccgctgagtcctcgtcctcccccgtctcctcgtcgtactcctccttcgccgagatcagcgtcatctgccgcgtgtgtcagaagcagttcgcgcagtacacttgcccccgctgtaacgcccgctactgctcgctctcgtgctacaagggtgatagtgttcaatgcactgaatccttcatgcgtgagaatgttatggacgagcttacccagatgcaacctgaggatgaatcaaagaaaaagatgctaagatatcctcaagcggctccacttggaagaagagatggcatcagatggtgaagatgagtccatgctatcagaggagcttattcaaaaagttatgcttgcgccaaaaatacagctgcaagacctctcttgattgtgaaactaaacgattccggctaagctttggcctcaggtggcgctcacgcaccaccgctcgaacggcggatcatctcgccggacaccgcctcttatgtctacttattttcccctgctaccccaaggtcacacgcacttcgtaggc

SEQ ID NO: 21125 - protein, 109 aa, Zea mays
  misc_feature: Ceres CLONE 1390085-F
  misc_feature (30)..(60): Pfam Name: zf-HIT Pfam Description: HIT zinc finger
MERDVVLSAPEAAESSSSPVSSSYSSFAEISVICRVCQKQFAQYTCPRCNARYCSLSCYKGDSVQCTESFMRENVMDELTQMQPEDESKKKMLRYPQAAPLGRRDGIRW

SEQ ID NO: 21126 - DNA, 685 bp, Zea mays
  misc_feature: Ceres CLONE 1390087-F
  misc_feature: Encodes the peptide sequence at SEQ ID NO. 21127
  misc_feature (271)..(271): n is a, c, t, g, unknown, or other
  misc_feature (282)..(282): n is a, c, t, g, unknown, or other
  misc_feature (306)..(306): n is a, c, t, g, unknown, or other
  misc_feature (312)..(312): n is a, c, t, g, unknown, or other
  misc_feature (335)..(335): n is a, c, t, g, unknown, or other
  misc_feature (407)..(407): n is a, c, t, g, unknown, or other
tccccgcggtggcggccgctctataactagtggatcccccgggctgcaggaattcgcacgagaccattacctagaacatcctaatcgaaaaacagcgctcaagttctcgcgcccacagccaaatttttctccactcaatcgcggcataagctgcactgcagccatggacgccagcggagccggtagcaaggcgaagaagggggcggctgggcgcaaggctggcggccccaggagaaagtcgtgtcgcggtccgtcaagcccgggctgcagntcccccgtcgncggatcgggcgctacctcaggaangggcgntacgcgcagcgcgtggcaccggncgccccggtctattctcgccgcgtggttgagtacctcccccgcgagtggctggaacttgcccgaaacccgcnaaagaaaaaaagaaaaggggatcggcccgggaacttgggccggggattccaaaaagagttgacccccaaaaagtgggtgtgggggccccctcggcccgggggggggcccccccaaataaacccggtttccccgcgaaaaaaaaggggggcaaaaccccccacccggcccttaagaagaaagaaaaccccccaaaaagggccccacatccccccacggggggcccctgcccccccgaaagagataaaaaaaaatatcccctcctcccgcgctgtttagg

SEQ ID NO: 21127 - protein, 101 aa, Zea mays
  misc_feature: Ceres CLONE 1390087-F
  misc_feature (36)..(36): Xaa is any aa, unknown, or other
  misc_feature (40)..(40): Xaa is any aa, unknown, or other
  misc_feature (48)..(48): Xaa is any aa, unknown, or other
  misc_feature (50)..(50): Xaa is any aa, unknown, or other
  misc_feature (58)..(58): Xaa is any aa, unknown, or other
  misc_feature (82)..(82): Xaa is any aa, unknown, or other
MDASGAGSKAKKGAAGRKAGGPRRKSCRGPSSPGCXSPVXGSGATSGXGXTRSAWHRXPRSILAAWLSTSPASGWNLPETRXRKKEKGIGPGTWAGDSKKS

SEQ ID NO: 21128 - DNA, 668 bp, Zea mays
  misc_feature: Ceres CLONE 1390091-R
  misc_feature: Pfam Name: HMG-CoA_red Pfam Description: Hydroxymethylglutaryl-coenzyme A reductase
  misc_feature: SWISSPROT Homolog: EC 1.1.1.34 Hydroxymethylglutaryl-CoA reductase (NADPH)
cagattgggtaccgggccccccctcgaggtcgacggtatcgatacagagatgagggacagctccgcggctaggaccgcaccggcaaccaccgtggccaagagccgcgcgttggaccctggggattccctgttagcacctttgacgccaagcaggtccaagcaggcagattgtgaggccagctgcgtgcctccaccaactgtgccaacctcaatagatggcatagtaacggagacgtgcagatctttgccatcatttatagcttccaacatggtgatacactgggaactctccacgttctgtgcagggtcctgaccagtggcaatgaagatggccgccacaatgttacttgcatgggcattgaaacccccaagagcgccagcaacagctgaaccagcgaggttcttgatcacgttcaattctaaagagcctgaacatttgttttgagaaactttttcacaacttcttccttgattactgcctcacaaaccaccgacttcccacggccatcaatccagttcacagcagctgacttcttgtcagaacagaagatacctgatatgctgatgacatccatgtcagggaagtcggcctggaggtagtccagcacgttctgcacacccttggagaccatgttcatccccatggcatcccctgtgctgcagctgaa

SEQ ID NO: 21129 - DNA, 729 bp, Zea mays
  misc_feature: Ceres CLONE 1390092-F
  misc_feature: Encodes the peptide sequence at SEQ ID NO. 21130
  misc_feature (316)..(316): n is a, c, t, g, unknown, or other
  misc_feature (357)..(357): n is a, c, t, g, unknown, or other
  misc_feature (390)..(390): n is a, c, t, g, unknown, or other
  misc_feature (408)..(408): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
aagctggagctccccgcggtggcggccgctctagaactagtggatcccccgggctgcaggaattcgcacgagaccattacctagaacatcctaatcgaaaagcactcgcagttggcgcgcgctcccgtcctaaccaagcaaaacccacaaccctagcctccgccggcgccgccatctgccgggcctccctccggtcccggccgaccgtagcctcgcagcaccctaaccctatccctcccccgctgccgcgggagcagggtaaaaaaatgccgcgtgagatcatcacgatccaggtggggcaatgtggaaaccaatncgggatggagttctggaagcagctctgtctcgagcacggtnatcggcaaggacggcctggctcgaggacttcgnccactcaggggggcaacnaaggaaaggaccgtcttcctttttaaccaaggctggaaggaaaaggaaatttcataaccccggttttctttgttttttttaccccgggggcccccccaaaagggggtctccctggggggggcccccccccccaaaaaaggggtggggggggacccctcctcccacacaaaaaaaaaaaatatttttcccccagaaggggggggggggnnnccaaaaaaaaaataaaggggggggggtttttttctttttttggggaaaaaaaaaatttttttgtttttataaataacagggcgcggggggggaaaaaaaaaaaaaaaaaaa

SEQ ID NO: 21130 - protein, 55 aa, Zea mays
  misc_feature: Ceres CLONE 1390092-F
  misc_feature (17)..(17): Xaa is any aa, unknown, or other
  misc_feature (31)..(31): Xaa is any aa, unknown, or other
  misc_feature (42)..(42): Xaa is any aa, unknown, or other
  misc_feature (48)..(48): Xaa is any aa, unknown, or other
MPREIITIQVGQCGNQXGMEFWKQLCLEHGXRQGRPGSRTSXTQGGNXGKDRLPF

SEQ ID NO: 21131 - DNA, 712 bp, Zea mays
  misc_feature: Ceres CLONE 1390094-F
  misc_feature (456)..(456): n is a, c, t, g, unknown, or other
cgcggtggcggccgctctataactagtggatcccccgggctgcaggaattcgcacgagaccattacctagaacatcctaatcgaaaagattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatcgggtggcgcggtcggcggagccgtcggtaaccttcgtccctaaacccctaaacactaggcttgcagcatcaatccgtccgtgcgagccgcttcacccgtcggtgtttttttttttggttggaagtagattagtgtgcgatttcaggaatcttctcgagctagctagtagctacatcccntggtttgtgtggttagctagcggcagatgtaataactaggtggcttttgttaagagttactagggcttaggtagcatccatctggaggtggaagatatcgatgctcgaagttggagtttgtttggccccaattgcttgtgctctaagggctgttgctgatccgcccgcccgggttaggataaattccggttggtgcttaaaactcggcatggaaaaacgcaaattcggatttgccccctcccttccgtaaagtatg

SEQ ID NO: 21132 - DNA, 731 bp, Zea mays
  misc_feature: Ceres CLONE 1390096-F
ccccgcggtggcggccgctctatatctagtggatcccccgggctgcaggaattcgcacgagaccattacctagaacatcctaatcgaaaaactcccaccgcatcctcccctgcgtagggtttaaccactcgcagcagtcgccgcgcactcgcagaatcatgatcacgccctcgcccgtgcgctcaagaccccggcgaccggccgtagcggtctctccggcgctcgcgtcgccaccccgagagctaccgcctttcgcgccgcctgagctcccccgactcgtagcctccggtgctcagcctccaccgccgtggccggggcttccaccgagatggctgatgctccgctggactgagcagagaggacgctggaggagttacgcagcttgccgcaccacgacacgtactgcttgatagcactctcgccgttggacgggcgtaacgatcgcattcgtcaaggagctgatgccctttttcagcgagctcgtctaagcccatgccaagaccatcatcaataccccgcgaacaccgtaacattcctcaaatccctgcaaaaattagcgcgtcctccgctcattccgggcaacccacacctcccttccgccccccccactgttcactccttagcgccactactcgccataattgctttcacaaactctgttacgcctactcaattcccccaccccatcccgaaagtgcgctactacacagcaagcttcagatacccaaccg

SEQ ID NO: 21133 - DNA, 699 bp, Zea mays
  misc_feature: Ceres CLONE 1390097-F
  misc_feature: Encodes the peptide sequence at SEQ ID NO. 21134
gctctagaactagtggatcccccgggctgcaggaattcgcacgagaccattacctagaacatcctaatcgaaaaagctccaggagcagcaccaatcccccaagccgccatggccgccgaccccacgctgctgcttctcgtacctttcctcgccatccccctctacttcttcttggccaccagacgtaggacgccacgcgggggcgcgcggctcccgccggggccgtgggcgctgcccgtggtcgggcacctgcatcacctagcccggggcctcccgcaccgcgtcatgcgcgacctggcgaggcgccacggcccgctcatgatgctccggttcggcgaggtccccgtggtggtggcctcctcgccggccgcggcgcgcgaggtgatgcggacccacgacgcggcgttcgcgtcgcggcccatcgaccccgcgccccgcctctggtccagggcgccgaggtctcactcttcgttgcctttgcgatctggaggccccccgccccactctgtcctgcacacagtaatcccgtacgcgcccgcacgcctacgggcattcacaccagagtacgcgccgccactaccagcgaatacacccgcacacacctctcactcacgctcacccctacagtgacgcacttccgaacacgctagacgcttatccatcccacggtcctaccaaccgtctaaccacattaccctc

SEQ ID NO: 21134 - protein, 173 aa, Zea mays
  misc_feature: Ceres CLONE 1390097-F
  misc_feature: SWISSPROT Homolog: EC 1.14.13.68 4-hydroxyphenylacetaldehyde oxime monooxygenase
MAADPTLLLLVPFLAIPLYFFLATRRRTPRGGARLPPGPWALPVVGHLHHLARGLPHRVMRDLARRHGPLMMLRFGEVPVVVASSPAAAREVMRTHDAAFASRPIDPAPRLWSRAPRSHSSLPLRSGGPPPHSVLHTVIPYAPARLRAFTPEYAPPLPANTPAHTSHSRSPLQ

SEQ ID NO: 21135 - DNA, 795 bp, Zea mays
  misc_feature: Ceres CLONE 1390098-F
  misc_feature: Encodes the peptide sequence at SEQ ID NO. 21136
  misc_feature (254)..(254): n is a, c, t, g, unknown, or other
  misc_feature (255)..(255): n is a, c, t, g, unknown, or other
cgctctagaactagtggatcccccgggctgcaggaattcgcacgagaccattacctagaacatcttaatcgaaaaaaaaacctcctcctcagtcctctctcctgctgccacgaggtacggcccagctcttcctcaaagcgggcgaaatccacgccgcgcggcggcggcggcagaggaggaggggggatgatggggtgcctcttcgcctgcttccgcgcgtccggcggcgatggcgaggtgaagggcaccggcgnncagctcgcgcatccgtcccagccccccgcgacgacgacgacgaccagccaccaggtccaaggatgggcgggggcaatagggtccaggcccgcgtcgaggaaagggctcctcggcggggttccagggagaaaatgggggaccaaggacggcgcaaggggcgaaccctgggggagaaaaaaggggccaaaaaggaaagaatcgcctcccggggctgtgggtacaggccctttttcccaaagaaatgggggggggttgtttgaaaaaaacaaaaaaatattcgaggggggccccacaaaaacgggggtcttctctcccgaaaaaaaaaaaaataatagggggggtctccgcgggggggacggcgaaacaaattccttcggcgacaccaccccccgagaataagttgggcattcccttcctgtgagaacaagagctatttctccgctgcgagtggccagccattcccccctcacaaaacttgtagaggacctggcaaaccgggccctttcctccagaagcatagacggggagtatgtatatcgg

SEQ ID NO: 21136 - protein, 155 aa, Zea mays
  misc_feature: Ceres CLONE 1390098-F
  misc_feature (23)..(23): Xaa is any aa, unknown, or other
MMGCLFACFRASGGDGEVKGTGXQLAHPSQPPATTTTTSHQVQGWAGAIGSRPASRKGLLGGVPGRKWGTKDGARGEPWGRKKGPKRKESPPGAVGTGPFSQRNGGGLFEKNKKIFEGGPTKTGVFSPEKKKNNRGGLRGGDGETNSFGDTTPRE

SEQ ID NO: 21137 - DNA, 704 bp, Zea mays
  misc_feature: Ceres CLONE 1390100-F
  misc_feature: Translation starting site: 189
  misc_feature: SWISSPROT Homolog: EC 1.3.5.1 Succinate dehydrogenase (ubiquinone)
ccccgcggtggcggccgctctagtctagtggatcccccgggctgcaggaattcgcacgagaccattacctagaacatcctaatcgaaaagttgtttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacacctacgacgcagtggtggtggtggtcgagagtttgcttgatccgggaggagataggactatcatagcatggcttcaacaccgtgtgcatcaccatgctcttccccacgcgctcgtacaccgtcggggatcatggaggcataaatgttgattgtgtgatcatgagtgtacatgactggaactgcaatacgtttgaccctgacaaaaccatcacgagccttgtcgcacggcctgctagttggtatatgcgcagagaggcaccgaggctgtcatagagctggaaaaatatgccccacccttttcgagaactgaagaggtgaagagataccagcgttcctttggagggcaccgccttataatttggcgaaggtgcgcaactctaccggtgaagcttctcttttgaacggacagctattgt

SEQ ID NO: 21138 - DNA, 683 bp, Zea mays
  misc_feature: Ceres CLONE 1390103-F
  misc_feature: Encodes the peptide sequence at SEQ ID NO. 21139
  misc_feature (560)..(560): n is a, c, t, g, unknown, or other
  misc_feature (575)..(575): n is a, c, t, g, unknown, or other
  misc_feature (635)..(635): n is a, c, t, g, unknown, or other
gcggtggcggccgctctatactagtggatcccccgggctgcaggaattcgcacgagaccattacctagaactcctaatcgaaaaaaatccaagtaaggaaatccccgatgatctcctgcgcgtcgcagcgccagccactcgattagtggagtccaccaaccaagcacgcgtccctccccgtcccagatcccatcccgcggcagccggtcagtccgatccatctccagtacccagcccgtcacccgccttccccgttcgctctcgtcggcgcgcgatggagggtctcatcaaggggttggtccacgtggccatcgacgccgtggaggacgccgtgagggagagggaccacggccgcgccgacgacgacgaggtgccgaggaggagggcggcccaaagctccgatcccagatgacgacggggaggaggaacgcgacgaacgatcgcggtcgacgtgggccgaggtcgtctccgagcagaagggcagcgatccggacgagcgccgggaccatcgaagctcggggcgggacaatcgccatgagaggagggatgacgagggttgnaaaagggccgatggncggaaccagcagcagcaccacgcaggccggcagaaccagtgctagggggaggaaagtggnatgggagcggcagcccggggcgttagaataggagcagggacaaggatt

SEQ ID NO: 21139 - protein, 45 aa, Zea mays
  misc_feature: Ceres CLONE 1390103-F
MEGLIKGLVHVAIDAVEDAVRERDHGRADDDEVPRRRAAQSSDPR

SEQ ID NO: 21140 - DNA, 711 bp, Zea mays
  misc_feature: Ceres CLONE 1390104-F
  misc_feature (367)..(367): n is a, c, t, g, unknown, or other
  misc_feature (372)..(372): n is a, c, t, g, unknown, or other
  misc_feature (509)..(509): n is a, c, t, g, unknown, or other
cgcggtggcggccgctctataactagtggatcccccgggctgcaggaattcgcacgagaccattacctagaacatcctaatcgaaaaactacccactcgacatttttgaacccaaacccctcacttccccttccctcgacctccccgaacccgaactcctctcaggtcgagcctagggttagggtttcgtccctccggccccgattcgaaccaatccgcctcggcctccgccgcgccatggccgccggctccatcgtggtggacttcccttccatgggcgccgccctctgcttcccagcctcgattcactcctccgcgactccgcctcgggcttcctcgctgccgtctcaacgccccagcccccggngcagncgacctcaccaacttttcacgcgtcttctcgcgcgtcctcagcacctacccggaaccaccggtcgaggctgtctgggtctttctccgggtttctcttccaggaccggtcccgaggaccttcggttccttggttcagntccctttccggctttaccggctccttggccgggaaccggcaagccggttgggctttcccggccccggggggttccgggtttttccccggccgaaaaagccggggggggaaaacccgaaccccccctgggggggggcgcccccagaataatatcaaagtttgggggggaaaagcggttggcgcccctttctgtggaggggggg

SEQ ID NO: 21141 - DNA, 676 bp, Zea mays
  misc_feature: Ceres CLONE 1390106-R
  misc_feature (135)..(135): n is a, c, t, g, unknown, or other
  misc_feature (225)..(225): n is a, c, t, g, unknown, or other
  misc_feature (226)..(226): n is a, c, t, g, unknown, or other
  misc_feature (233)..(233): n is a, c, t, g, unknown, or other
  misc_feature (234)..(234): n is a, c, t, g, unknown, or other
  misc_feature (302)..(302): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (593)..(593): n is a, c, t, g, unknown, or other
  misc_feature (594)..(594): n is a, c, t, g, unknown, or other
cagattgggtaccgggccccccctcgaggtcgacggtatcgataagcttttttttttttttttttggctggaaacagtaccttacataaggtttatagtactacagatgctccccagatggaacaacagaaacangcactaccaacatattgttgagaacttgagaacctaaacctaattagccacttagtgaataagataacaaaagaattaacggctattcannttatganngagaaactacaaaaacactggttcagtaagactacacctttacggctcacccatgtccttcgtagacnaatagtacagctcaaaagcaaaaattatccgaagctagtttctgggataacccctgtcaaaccggaaccaaccggaacccaatatggcctcttcccccaacaaaagggggcggcccttttttttttcccccctggccaaaaaaaacgcccccagaaaaaaatttttttttttttttttgggaaaatctttttttgggggaaaaaaagtttctctccccaaaacaatttgtgttttttttnnngttttaaaaaaagagaggggggccaccccccataagggggggggggaannaataaaatatgggggggggaggggggggttctcctcttttttttttcccccccgcccggaaaagaaaaataaacaaaagaaa

SEQ ID NO: 21142 - DNA, 687 bp, Zea mays
  misc_feature: Ceres CLONE 1390108-F
  misc_feature: Encodes the peptide sequence at SEQ ID NO. 21143
aaagctggagctccccgcggtggcggccgctctagaactagtggatcccccgggctgcaggaattcgcacgagaccattacctagaacatcctaatcaaaaaactgattgtccacccaccactctacgcaagcaatccttcggacttcggtgggggaaatggaggccgccgccgccgccgagacggggctcgcccagaaaccggttgtgctgtacccttcgccggggatgggccacctggtctccatgatcgagcttggcaagatcctcggcgcgcggggactgtccgtaataattgtcgtcgtcgagcctcccttcaacacgggcgctacgtcgcctttcctcgccggcgtctccgcgggcaacccgtccatctccttccaccgcctgcccaaagtcgagcgcctcccgcccccgtcagacaagcaccaggaggcgctcacccttcgaggtcacccgcgtctccaacccgcacctccgcgagttcctgtccgccgcgtccccagccgtgctcgtcgtcgactttctctgcagcatcgccctggacgtggcggaaggagttccgggtggccgcctacttcttcttcactcggggggcggaggcctgggctttcttcctggacctcccgggatccacgaggggaccgccgggagcttcccgggaattgggaaaagaactccgggacgg

SEQ ID NO: 21143 - protein, 176 aa, Zea mays
  misc_feature: Ceres CLONE 1390108-F
  misc_feature: SWISSPROT Homolog: EC 2.4.1.115 Anthocyanidin 3-O-glucosyltransferase
MEAAAAAETGLAQKPVVLYPSPGMGHLVSMIELGKILGARGLSVIIVVVEPPFNTGATSPFLAGVSAGNPSISFHRLPKVERLPPPSDKHQEALTLRGHPRLQPAPPRVPVRRVPSRARRRLSLQHRPGRGGRSSGWPPTSSSLGGRRPGLSSWTSRDPRGDRRELPGNWEKNSGT

SEQ ID NO: 21144 - DNA, 685 bp, Zea mays
  misc_feature: Ceres CLONE 1390109-F
  misc_feature: Encodes the peptide sequence at SEQ ID NO. 21145
gctcttacctagtggatcccccgggctgcagtttttcgcacgagaccattacctagaacatcctaatcgaaaaatccgctccccgcctttcgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcgggtcaggtcccaccgtcacctccacgagcccgaccaacaatcaggtcatcgcagaggtcgtggaggcgtccgtgcacgactacgaggagggcatgcgcgcctgcttcgatgtcgacaagacctggatggcgattcctgctccaaagcgaggagagatcgttaggcaaatcggtgatgcactgagagcaaagctccatcaccttggcaggcttgtgtcacttgagatgggtaaaattcctcctgaagggatcggtgaggttccgggaatcatcgacatgcgtgattatgctgtggctctaaggcgcccactaaacggcttcactataccccccgaacgaccaaaccatatgatgatggaggtgtgaaatccccttgagacgtagccctctctaacggctatccaacttcccccccccataactcagctacggttgctgtcctctcttcactcctgccaccca

SEQ ID NO: 21145 - protein, 152 aa, Zea mays
  misc_feature: Ceres CLONE 1390109-F
  misc_feature: SWISSPROT Homolog: EC 1.2.1.3 Aldehyde dehydrogenase (NAD(+))
MGAFAKEEHQFLAELGLAQRNPGAFACGAWGGSGPTVTSTSPTNNQVIAEVVEASVHDYEEGMRACFDVDKTWMAIPAPKRGEIVRQIGDALRAKLHHLGRLVSLEMGKIPPEGIGEVPGIIDMRDYAVALRRPLNGFTIPPERPNHMMMEV

SEQ ID NO: 21146 - DNA, 680 bp, Zea mays
  misc_feature: Ceres CLONE 1390110-F
  misc_feature: Translation starting site: 162
  misc_feature: SWISSPROT Homolog: EC 1.2.1.3 Aldehyde dehydrogenase (NAD(+))
  misc_feature (372)..(372): n is a, c, t, g, unknown, or other
  misc_feature (444)..(444): n is a, c, t, g, unknown, or other
  misc_feature (445)..(445): n is a, c, t, g, unknown, or other
aaagctggagctccccgcggtggcggccgctctagaactagtggatcccccgggctgcaggaattcgcacgagaccattacctagaacatcctaatcgaaaaacatccgctccccgccttccgcttccctaccccccgcatcacctaccaacgccgacaccatgggggccttcgcgaaggaggagcaccagttcctcgccgagctcggcctcgcgcagcgcaacccgggcgcgttcgcatgcggtgcgtggggcggctcaggtcccaccgtcacctccacgagcccgaccaacaatcaggtcatctcagaggtcgtggaggcgtccgtgcacgactacgaggagggcatgcgcgcctgcttcgacgccgctnagacatggatggcgattcctgctccaaagcgaggagagatcgttaggcaaatcggtgatgcactgagagcannagctcatcaccttggcaggcttgtgtcacttgagatggggaaaattctccctgaaggatcggttgagttcaggaaatcattgacatgtgtgattatgctgtgggactaaagtcgcaactaaatggatccattataccatctgaacgaccaaccatatggtgatggagggtgtgaaatcccgtggaggtggtggtgttataacgcatttaattcccctgggctgggctggttggaa

SEQ ID NO: 21147 - DNA, 682 bp, Zea mays
  misc_feature: Ceres CLONE 1390112-F
  misc_feature (561)..(561): n is a, c, t, g, unknown, or other
  misc_feature (575)..(575): n is a, c, t, g, unknown, or other
  misc_feature (576)..(576): n is a, c, t, g, unknown, or other
  misc_feature (581)..(581): n is a, c, t, g, unknown, or other
aaagctggagctccccgcggtggcggccgctctataactagtggatcccccgggctgcaggaattcgcacgagaccattacctagaacatcctaatcgaaaagagcagcagaccacgaccagcacgcccacttgcctgcgattactttgcgccagagggcagaggccttggccctgccatcgttgttcttatccccccttcctctttctttctcctccctcttgcggcttctctctggactcgcccctccctccgtctcgtctcccaggtcatggcaaagctggaacacccgtgaatatagcaagtgggagataaacaggaagagctagggtgaatactaaatacaagtagcagtagaaggaaaagagtcagtccgcccgtgactacgagtgaatttgttgggtgtggtgtttgttgaggtcacgatgatgggaggcgggctgttggtggatcagagcgtggtgttccctggcgtcacaacttcgtggatctcctgcagcagaacggcgacaagaacctgggcttcgggtctctgatggcgcagacgtcctctgcgacaantgggtggatggggnnaaggncatatcttcggggacccgccctccggataagctccccgaaccccgggggaaggacgaacagcaaccattaacgtcaaggaacatcgaaggagctggaagcg

SEQ ID NO: 21148 - DNA, 670 bp, Zea mays
  misc_feature: Ceres CLONE 1390113-F
  misc_feature: Encodes the peptide sequence at SEQ ID NO. 21149
  misc_feature (431)..(431): n is a, c, t, g, unknown, or other
  misc_feature (505)..(505): n is a, c, t, g, unknown, or other
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaaccctcagtacgtgcgcctcgggtaccactacctcatcagccacggcgtgtacctggcccacatccccgtcatcgtgctggtgtgcgncgccgagctgggcagcctcagccgcgacgagctgtgcccgcaggtggtgggggggaggccacttacgacctcgncaacgtgctcgccttcctcgcccgtctcggcttcaccatctccgtctacatcatgtccaggcccagggccggggacctcatcgacttcgcatggtacaagcccggcgacgagttcaaggggccaaaggggagttcctcaaccgggggcgcaagtcccgcaaagtn

SEQ ID NO: 21149 - protein, 154 aa, Zea mays
  misc_feature: Ceres CLONE 1390113-F
  misc_feature: SWISSPROT Homolog: EC 2.3.1.119 Icosanoyl-CoA synthase
  misc_feature (75)..(75): Xaa is any aa, unknown, or other
  misc_feature (100)..(100): Xaa is any aa, unknown, or other
MAREEQALLSTEIVNRGVEPSGPDAGSPAFSVRVRRRLPDFLQSVNPQYVRLGYHYLISHGVYLAHIPVIVLVCXAELGSLSRDELCPQVVGGRPLTTSXTCSPSSPVSASPSPSTSCPGPGPGTSSTSHGTSPATSSRGQRGVPQPGAQVPQS

SEQ ID NO: 21150 - DNA, 672 bp, Zea mays
  misc_feature: Ceres CLONE 1390116-F
  misc_feature (287)..(287): n is a, c, t, g, unknown, or other
  misc_feature (353)..(353): n is a, c, t, g, unknown, or other
  misc_feature (433)..(433): n is a, c, t, g, unknown, or other
aaagctggagctccccgcggtggcggccgctctataactagtggatcccccgggctgcaggaattcgcacgagaccattacctagaacatcctaatcgaaaaaattttctcagtctcgagcgcccgcgtccctcgccccgtcgcgactcgcgacttcgcgagtcgccccgtcccagcctcccagccgtcccggctccccgcgaccccgccctccggcagtccggcgcgggggctcctctccgatccggtgagccgaacgaggatcccaactccccgaagaaagcggncacagccagagccagggtggctcggctctcctctcacagactgcgccgcagcggctagcgctcggntggcagccgctccgggcggtcgggccccgcgccccccgccctggtggctacatccgcctgcaggcagaagatctggcttnagggaccggcctgcctgccccttgggggttctgggggttcgggacaccagcaaaggattttgtccccaaccaacgggggcgggggatgaaaaatttccaaaaaagcttcccggggaaagtacttggggggggggggagggggtcttttcttcacgggggaggggatttctcccccggaaaacccctccgggaaaaaaaaaattcccccaaccgggaaaaaaaaaaaaaacacaacctct

SEQ ID NO: 21151 - DNA, 661 bp, Zea mays
  misc_feature: Ceres CLONE 1390122-F
  misc_feature: Encodes the peptide sequence at SEQ ID NO. 21152
ggagctccccgcggtggcggccgctctagaactagtggatcccccgggctgcaggaattcgcacgagaccattacctagaacatcctaatcgaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaagacgcggcgctggcgcccagcgtggcgtactacgactacatcatcgtgggcgggggcacggccgggtggccgctggccggccccctggccgacgcctccccgtgctgcttgttggaaagcggggccctccccctaaaaaaacaacccattgggggaaagggcccctttcccgaaaccgtgttggagaacccccccggttcccccccgaaaggtttttgggggagggaaagggtcctcaacaccccccccccggggggtgggggggggggaaattgtattaaacccccggtttttaaacacgggccaaccaacaaaaaaaggggggggggcccggtggggaacccgggggccccccccagggggaaaaacggggggggaaaaaaaagcttttccccccccccccccg

SEQ ID NO: 21152 - protein, 173 aa, Zea mays
  misc_feature: Ceres CLONE 1390122-F
  misc_feature: SWISSPROT Homolog: EC 4.1.2.10 Mandelonitrile lyase
MSGRSRHFTMSTLLATSFFFVLLCSSLQVRGVNYTFVKDAALAPSVAYYDYIIVGGGTAGWPLAGPLADASPCCLLESGALPLKKQPIGGKGPFPETVLENPPGSPPKGFWGRERVLNTPPPGGGGGGNCIKPPVFKHGPTNKKRGGGPVGNPGAPPRGKNGGGKKSFSPPPP

SEQ ID NO: 21153 - DNA, 680 bp, Zea mays
  misc_feature: Ceres CLONE 1390125-F
  misc_feature: Encodes the peptide sequence at SEQ ID NO. 21154
  misc_feature (544)..(544): n is a, c, t, g, unknown, or other
  misc_feature (567)..(567): n is a, c, t, g, unknown, or other
  misc_feature (591)..(591): n is a, c, t, g, unknown, or other
aagctggagctccccgcggtggcggccgctctagaactagtggatcccccgggctgcaggaattcgcacgagaccattacctagaacatcctaatcgaaaaaaaaaggcactgctcatcgatccgccactacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatctcccgcgccttccgcctcaccgtcgcgctccgtcgccgcctcgccgcgcgggacgtctccgccttcctcgccttcgcgctacccgcgtcctccgaagcctacggacgcctcactgccctggtgcccaaggaagatgatactgagatggatggtgatgctgcagctccagcaactcagatttcaaatcaacatggtcttccctgagatngaaatatattgctacttgctcgnactgattttcccttatgatcatangaaatatgatgaggctaaggcatgcgcaagtgtgagcattggctcgctgaagatctaaccgagaaaatgggtggatgtttgccatcacg

SEQ ID NO: 21154 - protein, 118 aa, Zea mays
  misc_feature: Ceres CLONE 1390125-F
MTEDVQMNDSEPQPAASAPAVGAPALSTLHHLKEIASVIEAGSLSKEVRRISRAFRLTVALRRRLAARDVSAFLAFALPASSEAYGRLTALVPKEDDTEMDGDAAAPATQISNQHGLP

SEQ ID NO: 21155 - DNA, 763 bp, Zea mays
  misc_feature: Ceres CLONE 1390128-F
  misc_feature: Encodes the peptide sequence at SEQ ID NO. 21156
  misc_feature (1)..(1): n is a, c, t, g, unknown, or other
  misc_feature (12)..(12): n is a, c, t, g, unknown, or other
  misc_feature (14)..(14): n is a, c, t, g, unknown, or other
  misc_feature (18)..(18): n is a, c, t, g, unknown, or other
nttttttttctntntccntcacccatccaccccccccgccctccaagaccactcccaaacttgcaatccccgcgggggcggccgctctagactagtggatcccccggggtgcaggaattcgcacgagaccattacctacaacatcctaatcgaaaaacccacccacccccgcgtcccccacctcatggcgccggcgatggggctgaagcggcctgcggcgcgagcgggggcggcagcagcgcataccgtcacactgttcgcgccggccgtgcgagacgcggtgcgcaccgccgcaagggaggccgaggctacggcgaaggttaccgccccggacgccatgggtccgtcgaccggagccagtgccgggcgaagatcgatagggatgaggggctgtgccttggaggaggccgacgggaaggcgatgggagctatgtgtttccaccgccctgttccccgctggaaagggtcaagggaaaggggcggtctgtcggcgggccgccttacaaggcccgtccccggcttccaagttccccgtatggccgctccgggcgagggaaaaccatggccccttttacaaaaatccatatgggcggcgccccgaaaggcttctcccagaaaaggggtccacaccttccaaaatggttcacaaaacatgcaccctggaaaaaaacattacaaaccacttttcctttgggcgaaaacccacagagcctgaggatcaaaaaaacaaagggaaccctaggatcaaacaccttggaaaggc

SEQ ID NO: 21156 - protein, 176 aa, Zea mays
  misc_feature: Ceres CLONE 1390128-F
MAPAMGLKRPAARAGAAAAHTVTLFAPAVRDAVRTAAREAEATAKVTAPDAMGPSTGASAGRRSIGMRGCALEEADGKAMGAMCFHRPVPRWKGSRERGGLSAGRLTRPVPGFQVPRMAAPGEGKPWPLLQKSIWAAPRKASPRKGVHTFQNGSQNMHPGKKHYKPLFLWAKTHRA

SEQ ID NO: 21157 - DNA, 679 bp, Zea mays
  misc_feature: Ceres CLONE 1390129-F
  misc_feature: Pfam Name: PA Pfam Description: PA domain
  misc_feature (324)..(324): n is a, c, t, g, unknown, or other
  misc_feature (336)..(336): n is a, c, t, g, unknown, or other
  misc_feature (353)..(353): n is a, c, t, g, unknown, or other
  misc_feature (354)..(354): n is a, c, t, g, unknown, or other
  misc_feature (426)..(426): n is a, c, t, g, unknown, or other
aaagtggagctccccgcggtggcggccgctctataactagtggatcccccgggctgcaggaattcgcacgagaccattacctagaacatcctaatcaaaaaccccgggccttgcgtggcgatcgagttgccaccagacaactcggctcggctcgtcgtccaccgaccctcctcctcgctccaagcttccctctcccctcctcctccgtcagctggggagctagctagggagcggcgccggcggctgatcgagcggacagacagctgaacgagccggaaatggcggcggggcgcgcgccgtggctcgccgccggcctcgtggcgntgctgatggtgntggccgcgcgcgcgcgnntcgtggtggagagagcagcgtgcgggtgctggcgcccgagcacatccggggccacacgacgccgccatcggnaacttcggcgtgcccgactacggcggcacgctcaccggcgtcgtcatctaaccggaaaccaagcccacggggtgccgaggatttccaggcaagttcaaggccaagtcccggcggcccggcatcctcctgctcgaccgggggaaaatggtatttcccgcctcagggagggaaaccgcgcagggggcggggggagaaggtgccgctaaaacaccaccagggtggcccccccccccctccggcgcaatggcacacc

SEQ ID NO: 21158 - DNA, 685 bp, Zea mays
  misc_feature: Ceres CLONE 1390130-F
  misc_feature: Encodes the peptide sequence at SEQ ID NO. 21159
  misc_feature (518)..(518): n is a, c, t, g, unknown, or other
  misc_feature (578)..(578): n is a, c, t, g, unknown, or other
  misc_feature (579)..(579): n is a, c, t, g, unknown, or other
  misc_feature (622)..(622): n is a, c, t, g, unknown, or other
tccccgcggtggcggccgctctagaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatgttccgcgggccgtggctcgcccgcgcggacttcctgctgacgtgcgacccggcggccgtccagcactgcctggcgtccaaccacgggggctacgacaggggccgagacttttgcggagatgttcgacctcctgggcgacgggctgctggnttgcgacgcccccgcccccggggccgcgcccagcggaacgtcgccgccaccgtcttgggnnacccccgggggttcccggtccctttgtcctggtgcaccatggncgcgcaagaacggggggggctggctccgggccgttccctggactgcgcccgccccggaattag

SEQ ID NO: 21159 - protein, 179 aa, Zea mays
  misc_feature: Ceres CLONE 1390130-F
  misc_feature (145)..(145): Xaa is any aa, unknown, or other
  misc_feature (159)..(159): Xaa is any aa, unknown, or other
MGALRSLAISYPEFLVAGLCFVSLSALRHAMRERRQRAPLSWPVVGMLPFVLANLGRLYDAITDALHGSGCTLMFRGPWLARADFLLTCDPAAVQHCLASNHGGYDRGRDFCGDVRPPGRRAAGLRRPRPRGRAQRNVAATVLGXPRGFPVPLSWCTMXAQERGGLAPGRSLDCARPGI

SEQ ID NO: 21160 - DNA, 767 bp, Zea mays
  misc_feature: Ceres CLONE 1390132-F
  misc_feature (14)..(14): n is a, c, t, g, unknown, or other
  misc_feature (767)..(767): n is a, c, t, g, unknown, or other
tttttcctcccctnttttttccccccccccccccccccccccaggagggaaaaagctggggctccccgcggtggcggccgctctagaatagtggatcccccgggctgcaggaattcgcacgagaccattacctagaacatcctaatcgaaaaactactagtgatcagaccagtgagctagcgactgtaccatgcagcagctgtaggagagcctggtggtaggtaggataggagtagcgccagccgccaagtgcgcgtccgggctggctgcttcgacgagcaggagggagccgcaccgccgggctcccgcaatgtcgcctcctccgcccccgccgctgctgcgcaacgagctgtcgcgcaggacggcggtgctgggcctgcgcctgtgggtgctggtgggcatcgcccgtcggggccgccttcgtgctgctcctcggagttcatctccctccacctcgccgcgggggggagggaggcggcccaagaaagggcgacgaggaagcgtaagccgccgcgcccggtgggtgtcacttcaccactgttctctatcatcttctcctggtccagttacactagaccccagaccatggccccccacacgctgcctcccctccccccctcccctcccacccccgcacgcgcgcttaccgcagcgcaacgaccacgaaccaaccccttcctatctacgttctgcctgatttccccatccctgctctccaccaaaccccctatacccccccccccggtaccacccccccgtcccccccn

SEQ ID NO: 21161 - DNA, 745 bp, Zea mays
  misc_feature: Ceres CLONE 1390136-F
  misc_feature: Encodes the peptide sequence at SEQ ID NO. 21162
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
tgtttnnnnnaccaccnnnaacccaccccccaattacccgaacatcccgccctcgaacaatgggactccccgcgggggcggacgctctccaatagtggatcccccgggctgcaggaattcgcacgagaccattacctagaacatcctaatcgaaaaaaatcgggtttgccgtgcggcacttgcgtttcgggtcgggtacggacccgcaaaaagagctccgtcagttcctctacctcctctgtaggagcacacttgtttcggaaaggaacgcagattcacgccacgccgccgcctcaattatatggcgccggcgttctcggcacaggtccccgcgctccgacgggcagcactgcgcgtgcggtgggtcacgggctgcgctgttctcatcggggattctcgccggcaacaagccgattctggtgcgtgacttcgtgagggtcagcgttgtacgaccccaaccatggctacttctccaagcgggcggggcccggtgggcggttcttgacgccagcatccgcttcaaccagttcggagggggaggagtgcatatattacagcaccttgaataaagtgtaaaaaaaagcaggataatccgcttgggttaactccgcgggggagcctctttaaaacccaatgggtattgccctaccccaccaagcgcacgcattcaaattcctggggtaatagggataatctttttcaggcgctccttgggaaaaataataggggagatattggggggggg

SEQ ID NO: 21162 - protein, 41 aa, Zea mays
  misc_feature: Ceres CLONE 1390136-F
MAPAFSAQVPALRRAALRVRWVTGCAVLIGDSRRQQADSGA

SEQ ID NO: 21163 - DNA, 671 bp, Zea mays
  misc_feature: Ceres CLONE 1390141-F
  misc_feature: Encodes the peptide sequence at SEQ ID NO. 21164
  misc_feature (449)..(449): n is a, c, t, g, unknown, or other
  misc_feature (485)..(485): n is a, c, t, g, unknown, or other
  misc_feature (532)..(532): n is a, c, t, g, unknown, or other
  misc_feature (533)..(533): n is a, c, t, g, unknown, or other
acccgcggtggcggccgctctatcaatagtggatcccccgggctgcaggaattcgcacgagaccattacctagaacatcctaatcgaaaaaagaagctttacagtgaacgagtgagtatgtgcggcatacttgctgtgctcgggtgcgccgacgaggccaagggcagcagcaagaggtcccgggtgctggagctgtcgcggcggctgaagcaccggggccccgactggagcggcctccggcaggtgggcgactgctacctctctcaccagcgcctcgccatcatcgacccggcctctggcgaccagcccctctacaacgaggaccagtcggtggtcgtcgccgtcaacggcgagatctacaaccacctggacctcaggagccgcctcgccggcgcaggccacagcttcaggaccggcagcgactgcgaggtcatcgcgcacctgtacgnagagcatggagaaagagtcgtggacatgctggacgncgtcttctccttcgtgctgctggacactcgccatggcgaccgcgcgnncagcagcttcttcatggctgctcgcgacgccatcggtgtgacgcccctctacatcggatggggagtccatgggtccggtgtggatttcgtcggagatgaaggccctgacgacgaatgtgaacacttcgagatcttccc

SEQ ID NO: 21164 - protein, 184 aa, Zea mays
  misc_feature: Ceres CLONE 1390141-F
  misc_feature (2)..(173): Pfam Name: GATase_2 Pfam Description: Glutamine amidotransferases class-II
  misc_feature: SWISSPROT Homolog: EC 6.3.5.4 Asparagine synthase (glutamine-hydrolyzing)
  misc_feature (111)..(111): Xaa is any aa, unknown, or other
  misc_feature (123)..(123): Xaa is any aa, unknown, or other
  misc_feature (139)..(139): Xaa is any aa, unknown, or other
MCGILAVLGCADEAKGSSKRSRVLELSRRLKHRGPDWSGLRQVGDCYLSHQRLAIIDPASGDQPLYNEDQSVVVAVNGEIYNHLDLRSRLAGAGHSFRTGSDCEVIAHLYXEHGERVVDMLDXVFSFVLLDTRHGDRAXSSFFMAARDAIGVTPLYIGWGVHGSGVDFVGDEGPDDECEHFEIF

SEQ ID NO: 21165 - DNA, 636 bp, Zea mays
  misc_feature: Ceres CLONE 1390149-F
  misc_feature: Encodes the peptide sequence at SEQ ID NO. 21166
  misc_feature (404)..(404): n is a, c, t, g, unknown, or other
cgctcttgaactagtggatcccccgggctgcaggaattcgcacgagaccattacctagacatcctaatcgaaaaattccactattgtctctctcgaaatcggccgtctctctcccgtccggcacttcctccgatcgactagcctgcggcggcgccggcgccggcgaccagcggccatgcgggtggcacccagggtgctcttcctcgtccgcgacgccgcgggctacggcgctgccctcgccgacgcgctccgcccgccgcccgggctaacgagggagtcctcgcccttcgagctcccccttggaaagtacggcctcgacggagagaaggcgtgcgccgagctcctgagcttttccgattccagtggctctccacaggtgaccatttttgttctgccagactatnagccacctcttgcagcgtgtggtgaaaatgaggtcttggaactgattttctctggagctacctccactgaagcgactctaattgtcccatacatcacaggatcgtccagctatcttcatgggacggaacatggcacaagggctcgactggactttcgtggggctgaaaaagggggcaaaattgacatatcccccctggggggtggggggggcccctaaacctcccaaatctt

SEQ ID NO: 21166 - protein, 148 aa, Zea mays
  misc_feature: Ceres CLONE 1390149-F
  misc_feature (77)..(77): Xaa is any aa, unknown, or other
MRVAPRVLFLVRDAAGYGAALADALRPPPGLTRESSPFELPLGKYGLDGEKACAELLSFSDSSGSPQVTIFVLPDYXPPLAACGENEVLELIFSGATSTEATLIVPYITGSSSYLHGTEHGTRARLDFRGAEKGGKIDISPLGGGGGP

SEQ ID NO: 21167 - DNA, 675 bp, Zea mays
  misc_feature: Ceres CLONE 1390151-F
gctcaagaactagtggatcccccgggctgcaggaattcgcacgagaccattacctagaacatcctaatcgaaaataataaaggaggcacatcgataggttctttatctggaagtagcagcataagtaattcttccggtcctggtggggatgattcacatctttggcctcagttgccagcttgggagatactggaggctgttccatttgtggttgatgctgctcttactgcttgttcccatggaagactatttccacgtgaactggccacaggcctgaaggatctggctgatttcctccctgcatctcttgctacaatagtaagctacttttccgctgaggtgacgcggggtgtctggaagcctgcatccatgaatgaatcagattggcctagcccctctgggaaacctatccatgggtgatgagcacatcaagaaaatcgtacctgctaccggtggtgattgttccaagttagttacgggagggaagttctttcggaaaccctcccgtaaccatgggttggtttcgggagccccaaaacccataacaaagttggaaagggttcaaaggggttccccaaccttggggggccccacttaaaaaaacctgggtgaaaattcccctgggccaaaaatgggaaattttgtgaaactggtggcccccaaaggggggagggg

SEQ ID NO: 21168 - DNA, 668 bp, Zea mays
  misc_feature: Ceres CLONE 1390156-F
  misc_feature: Encodes the peptide sequence at SEQ ID NO. 21169
  misc_feature (499)..(499): n is a, c, t, g, unknown, or other
  misc_feature (608)..(608): n is a, c, t, g, unknown, or other
ggagctccccgcggtggcggccgctctagaactagtggatcccccgggctgcaggaattcgcacgagaccattacctagaacatcctaatcgaaaaatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaagtccgtcggcacgggcagccggttcagtttcacagcaactgacgggaaggataagatcaaggcgatgcttcccaccaacttcgggtcggaggtccgctctggcaacctgaaagaacctcggctcatccgcatcatcgactacacttggcacgtcgtcaaagggcaaagatgacaagtcttggntgtcatcaaatgcgagcttgtgtgccaagcgcttgacgccgagatcaacggcgaggccaaaaaagaggagccctccattggtgctgaagcctaaggacgaatggatggncgtgacatccccactcgctatgaagccccagcaggaggtgaagtctgcgtcccaaatcgg

SEQ ID NO: 21169 - protein, 94 aa, Zea mays
  misc_feature: Ceres CLONE 1390156-F
  misc_feature (6)..(93): Pfam Name: Rep-A_N Pfam Description: Replication factor-A protein 1, N-terminal domain
MDAAKLVTPVAVSHILAHPSAGSDGAVTDLVVQVLDLKSVGTGSRFSFTATDGKDKIKAMLPTNFGSEVRSGNLKEPRLIRIIDYTWHVVKGQR

SEQ ID NO: 21170 - DNA, 677 bp, Zea mays
  misc_feature: Ceres CLONE 1390159-F
  misc_feature (334)..(334): n is a, c, t, g, unknown, or other
  misc_feature (348)..(348): n is a, c, t, g, unknown, or other
  misc_feature (677)..(677): n is a, c, t, g, unknown, or other
acccgcggtggcggccgctctatgaactagtggatcccccgggctgcaggaattcgcacgagaccattacctagaacatcctaatcgaaaaacctcatgggtcacgcgaagaccacacccacaccacaccacacctcacggcgtccattcattcccgactcgtcttccgctgcttggctccaactccccccgcgtcgtctcgtgcttcacaatcaccataaagccggttgatccccaaaggaccatgatattctccgacgccgcgtcgcctctcagtagccaccgacgctgactctggttcctcctgcgtctgcacctcccctgctgctgtcgncgtagatgtcgcgntagtcgtgaatacgcggaggtcgacgttcctggacttctcgccgacggcctcggaactgctagctatgaatctctccggcgcgaattgccaacctatggtcgtgatgactgcttgccccccccaccatggagggatggtgaagccccccccttgctctgttcaagaaccaaagctggaatcccttctgaccggaaagcccaggggaaaaaggacccccggggacgggggggcacaaaaattttcccccccagggaccccccccttgggttaaaaacccccaaaaccccccccaaaggggggggggcccctttgaaaaaaaaaaaacccn

SEQ ID NO: 21171 - DNA, 673 bp, Zea mays
  misc_feature: Ceres CLONE 1390160-F
  misc_feature: Translation starting site: 162
  misc_feature: Pfam Name: DHquinase_I Pfam Description: Type I 3-dehydroquinase
  misc_feature (292)..(292): n is a, c, t, g, unknown, or other
  misc_feature (302)..(302): n is a, c, t, g, unknown, or other
  misc_feature (369)..(369): n is a, c, t, g, unknown, or other
  misc_feature (398)..(398): n is a, c, t, g, unknown, or other
  misc_feature (403)..(403): n is a, c, t, g, unknown, or other
  misc_feature (409)..(409): n is a, c, t, g, unknown, or other
  misc_feature (415)..(415): n is a, c, t, g, unknown, or other
  misc_feature (472)..(472): n is a, c, t, g, unknown, or other
  misc_feature (473)..(473): n is a, c, t, g, unknown, or other
  misc_feature (485)..(485): n is a, c, t, g, unknown, or other
  misc_feature (579)..(579): n is a, c, t, g, unknown, or other
tggagctccccgcggtggcggccgctctagaactagtggatcccccgggctgcaggaattcgcacgagaccattacctagaacatcctaaaaaaaaaccaaaacctccactcttcctcccaccaaggcaccaacccgacgcaaagccgccggctttccccgatggcgacgacgatgtcagtttcggcggtgtccccgcccgccgcggctgtcacgcggccccggacgatggtctgcgtgccggcgacggcgcgggcgccgcgggagatggcggctgagctggccgccgccgncgcgctcggngccgacgtggcggagcttcgcctcgactgccctcgcggttcacgccgcgcagggacctgcccgtcantctcgcaaggcccccgtcgctccccgccntcgtnacttcnaggccnagtgggaaggagcgaatacgaagcgatgacgaatcccggtttgagctctgctatggnncatggagctggnagctgaatatgtggatgtccagcctaagggggcctgacaaattaatggaaacttatttctgggaggaaaacctgaaaactgggaacttataagnttcattcccacaattatgagaacccctcccatcctcgagaggactttggaaatttggggggttcaaaatccaggaacgggggggtggaatacgg

SEQ ID NO: 21172 - DNA, 666 bp, Zea mays
  misc_feature: Ceres CLONE 1390161-F
  misc_feature: Encodes the peptide sequence at SEQ ID NO. 21173
tcataactagtggatcccccgggctgcaggaattcgcacgagaccattacctagaacatcctaatcgaaaagttgtttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacacctacgacgcagtggtggtgggggccggcggcgcggggctccgggcggcgatcggcctctccgagcacggcttcgacaccgcgtgcatcaccaaggtcttccccacgcgctcgcacaccgtcggggttcagggaggaataaatgctggacttggaaacatgagtgaagatgactggaggggccatatgtatgaaactgttagggaaagcgattggctggttgaccagaatcttattcaggatatgtggaagagaggccccaaaagttgttttaaaagtttgaaaacttatggactaccattttttcagaactggaagagggaaaagaattacccaccgggccctttgggggggcaaaaatttaaaatttttgggaaagggggggcaaagccctccc

SEQ ID NO: 21173 - protein, 165 aa, Zea mays
  misc_feature: Ceres CLONE 1390161-F
  misc_feature: SWISSPROT Homolog: EC 1.3.5.1 Succinate dehydrogenase (ubiquinone)
MWRSCVSRGLSRAKASASRLLSTASSSYTVVDHTYDAVVVGAGGAGLRAAIGLSEHGFDTACITKVFPTRSHTVGVQGGINAGLGNMSEDDWRGHMYETVRESDWLVDQNLIQDMWKRGPKSCFKSLKTYGLPFFQNWKREKNYPPGPLGGQKFKIFGKGGAKPS

SEQ ID NO: 21174 - DNA, 626 bp, Zea mays
  misc_feature: Ceres CLONE 1390162-F
  misc_feature (486)..(486): n is a, c, t, g, unknown, or other
  misc_feature (626)..(626): n is a, c, t, g, unknown, or other
gctctataactagtggatcccccgggctgcaggaattcgcacgagaccattacctagaacatcctaatcgaaaacgttccaggtcgtggtctttgccaaattcccacgcccctgcccaccctgcccgaatcctctcgccctttacccccgcccgcgaccccattcacactctcgctgctccactccgctccgctcagctcgtcgggacgcgcccccgcctcccatcccatgcccgcccccgcgctcgtcggaggccgctcgcggcggcctcccatcccgccgcgctgacgagagggcctctcggtgggggcgctttcggtgttcattttgtccgttcgggaaggggagtggcgcgatggggaacaccagaagggaagcgccggcgcgggagaagaacggcagcggaaggggaggggagacagtgcagcggcgtgccggagacccgcgcaaggggccggtgctggatccgcttccgcgcctcgcggntgatggcggtccgcgccaagtccactcctccacaggggggggggggggggccggaaaccaaaacatctactgatgatgttgccaggaccatcaaaaccaccagctctgggtccggaaaaacagaaaacatggaagatccn

SEQ ID NO: 21175 - DNA, 672 bp, Zea mays
  misc_feature: Ceres CLONE 1390163-F
ccccgcggtggcggccgctctattaatagtggatcccccgggctgcaggaattcgcacgagaccattacctagaacatcctaatcgaaaactctctctctctcgctcgaactgtagccgcgtagcgtccttctctgtggactacacaagtccgagttatgatgatcgtatgactcccgcccaattgccaccaatgtatagagccaggttgctaaacatgccgcacaatgtcgcgttgttgcgcctagtagcctgcagcggaagctgtccgagcggcagatagggaggctctgagcagagggagagtgcctattctgcatgcgaaacaggtctcctcagaataatcgccacgtgacgatcggcagagacatcgaggatcacctgtgtcagacctgctgagattatggtatccggcgaggacgcctgccagctcgacttatgtagtcgagcgaggctatgactccagggtcgactcaagcgtgcagacagaaggttgctgctgggaatcgaagtcgctaccccgaatatatttcccctggggaggggaacccggagcagctgcaaaatgcctcagagtcaagtgattcttatcgaccctgtcataagtccgccgagaggacgacgtaaaatttattggcctagatggtgtcccaggcgctaaccataatatcgc

SEQ ID NO: 21176 - DNA, 675 bp, Zea mays
  misc_feature: Ceres CLONE 1390165-F
  misc_feature: Translation starting site: 217
  misc_feature (257)..(257): n is a, c, t, g, unknown, or other
  misc_feature (258)..(258): n is a, c, t, g, unknown, or other
  misc_feature (265)..(265): n is a, c, t, g, unknown, or other
  misc_feature (266)..(266): n is a, c, t, g, unknown, or other
  misc_feature (278)..(278): n is a, c, t, g, unknown, or other
  misc_feature (279)..(279): n is a, c, t, g, unknown, or other
  misc_feature (315)..(315): n is a, c, t, g, unknown, or other
  misc_feature (357)..(357): n is a, c, t, g, unknown, or other
  misc_feature (466)..(466): n is a, c, t, g, unknown, or other
aagctggagctccccgcggtggcggccgctctagaatagtggatcccccgggctgcaggaattcgcacgagaccattacctagaacatcctaatcgaaaaacggcccacaacgcccagaaataaaaaggaaaaatccgggagaggataacaaaaaagaaaaaaaccacaaagagattcctctcaccaccaccaaccctagacgatcctcctccgccatgatgcgggacggcgtgcctccgtcggtggccggctccgnncgcgcgnncggcggcgacgnnccccagcgatgctcgcagtgcgggcaccacgggcancacgcgcgaacctgcacggcgcggcccgtcaagctcttcggngtgcgcatcggggacaagcccatcgggagagcggcagcatggggaaatcgcgcacctcgcgcggaggcagcggcggcagggaggaaaggtacgctccgacggggagcgncgcacaagaacgaggtggaggcatggactgaagaggaccacaagaagttcctgcttgggttgaataacctaggggaaagccgattgcggtgggatatccccgtaaatatgttgtttcaaggacacctactcaggtggctagccttgcgcaaaagaatttcaatccccaaacaaatgggcatagaaaaaagaaaaagatccagcctattc

SEQ ID NO: 21177 - DNA, 697 bp, Zea mays
  misc_feature: Ceres CLONE 1390166-F
  misc_feature (345)..(345): n is a, c, t, g, unknown, or other
tcttaacaggtggatcccccgggctgcaggaattcgcacgagaccattacctagaacatcctaatcgaaaagtccgccaccggagctcacttcgtcggccttccctcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagctttcttccgccataagctcagctccctcctcttgcttcctctgaggacgccccacccgcctcgatcgcttncggcgggggccgctgctgctgcgctgtcctagcatccgttcaaagggggggtttggcgttcttagggttccaagaatggctttttggttgcgtctttggggagacgaaaggactagggcggcggaaaaagaatcagcatgcttccgagcggttgtcagtttccacttcccgcgaacggctgggccgcgcccggtgacaaaacaaaatcttgttcttctcggggggggagggggggccccaaaagcaagggttttttttcccgagggggttcccagattggcggttcccctggccattggggacttagagcctacgcccaggagggtcataaaagagcgccccctcttctcac

SEQ ID NO: 21178 - DNA, 659 bp, Zea mays
  misc_feature: Ceres CLONE 1390171-F
  misc_feature: Encodes the peptide sequence at SEQ ID NO. 21179
  misc_feature (257)..(257): n is a, c, t, g, unknown, or other
  misc_feature (329)..(329): n is a, c, t, g, unknown, or other
  misc_feature (430)..(430): n is a, c, t, g, unknown, or other
ggagctccccgcggtggcggccgctctataactagtggatcccccgggctgcaggaattcgcacgagaccattacctagaacatcctaatcgaaaaatctcctcgcgagcaccgctggcctcgcttaacggcctgatctcccagccgccgcttccgcctcgcgtcccaccggtctccatctacatgcagccgcgctcgccaccgccgtcggaggcgcctgcgccctccgacgccatcatgatgcccggcgtgggcgncgtggagccggccgtcacgttgggccaggtgccgcgctggagcgaccccgaccagcgcatcttcctcgcctnacgtccgaagaggcgtccgcggaggacgacggatccgcacgacctctgcgtctggcttcatctctttctccgacccgctcacggtcgacgacggcgcccgncgggggtgcccacgccggggggtggctcgcgcttcccccgcgaccaggagatcaactctaggatctatctctggcgtggcccagcctggaaactcgaggtccgaggggtcgtcaattctaacaacgaaagcttggacgaggggcacagaaaccccgggtgtgctgctgctgccgatccaagctccccaaggaaggcgcaccttcgggggctcccccaacgcacgccaac

SEQ ID NO: 21179 - protein, 158 aa, Zea mays
  misc_feature: Ceres CLONE 1390171-F
  misc_feature (25)..(25): Xaa is any aa, unknown, or other
  misc_feature (49)..(49): Xaa is any aa, unknown, or other
  misc_feature (83)..(83): Xaa is any aa, unknown, or other
MQPRSPPPSEAPAPSDAIMMPGVGXVEPAVTLGQVPRWSDPDQRIFLAXRPKRRPRRTTDPHDLCVWLHLFLRPAHGRRRRPXGVPTPGGGSRFPRDQEINSRIYLWRGPAWKLEVRGVVNSNNESLDEGHRNPGCAAAADPSSPRKAHLRGLPQRTP

SEQ ID NO: 21180 - DNA, 754 bp, Zea mays
  misc_feature: Ceres CLONE 1390173-F
  misc_feature: Encodes the peptide sequence at SEQ ID NO. 21181
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (23)..(23): n is a, c, t, g, unknown, or other
  misc_feature (24)..(24): n is a, c, t, g, unknown, or other
  misc_feature (49)..(49): n is a, c, t, g, unknown, or other
gttgccccccccccnnncccccnnccgccctccccgccgacaacaccanccaacactggagctccccgcggtggcggccgctctataatagtggatcccccgggctgcaggaattcgcacgagaccattacctagaacatcctaatccaaaagaaataaaggactatctcagcgatttccgaaccctccccacccccacacccacccgatccaaccgagtcccggcggcgatggcggcggcggcgacgaacgccgatgtggaggtggtcgacttcgacctcgatgacgacgacctcatggacgaggacgccgggccggatccaggaccgccccccggctcccgcctcggctccaccatcgcgggcgacgacgcgccgcgtaggaccaagggccgcggcttccgcgaggaccctaactcctcggcgacccgcgactccggcttttggcgcggggggacgcgccgacctcgactcgcttggggggcctggacccatccagtggacggctacccttctctttcaatttttttcccaaagattggcttgaaccgattaatatttttctttttggaaacggaaaaactgggggttgagggaaaggaaaaactttcctttttgggggggatggaatggcctaatggaaataaagaatttgggggctggccaaaaaaaataattgcgcccttctcggggggggggaatttggggggaaaaaaggggccatcatccccaacaaaattgggagaacaacccct

SEQ ID NO: 21181 - protein, 174 aa, Zea mays
  misc_feature: Ceres CLONE 1390173-F
MAAAATNADVEVVDFDLDDDDLMDEDAGPDPGPPPGSRLGSTIAGDDAPRRTKGRGFREDPNSSATRDSGFWRGGTRRPRLAWGAWTHPVDGYPSLSIFFPKIGLNRLIFFFLETEKLGVEGKEKLSFLGGMEWPNGNKEFGGWPKKIIAPFSGGGNLGGKKGPSSPTKLGEQP

SEQ ID NO: 21182 - DNA, 678 bp, Zea mays
  misc_feature: Ceres CLONE 1390175-F
  misc_feature: Translation starting site: 194
  misc_feature: SWISSPROT Homolog: EC 2.3.3.1 Citrate (Si)-synthase
  misc_feature (491)..(491): n is a, c, t, g, unknown, or other
  misc_feature (505)..(505): n is a, c, t, g, unknown, or other
  misc_feature (528)..(528): n is a, c, t, g, unknown, or other
  misc_feature (573)..(573): n is a, c, t, g, unknown, or other
  misc_feature (574)..(574): n is a, c, t, g, unknown, or other
  misc_feature (586)..(586): n is a, c, t, g, unknown, or other
aaaagtggagctccccgcggtggcggccgctctatcaatagtggatcccccgggctgcaggaattcgcacgagaccattacctagaacatccctaatcaaaaaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattaccactggaaaggacgacaagggtcttaagatttatgatcctggttaccttaacactgcccctgttcgctcgntcatctgctacatncgatggagatgagggaatcctcngctataggggttatccaatcgaagaattggctggaagcagctcgnnttgttgaggtgncctaccttttaatgtatgggaacttgcctactcagagtcaattggcagggctgggaatttgctatttctcagaattctgctggtccccaagg

SEQ ID NO: 21183 - DNA, 703 bp, Zea mays
  misc_feature: Ceres CLONE 1390176-F
  misc_feature: Encodes the peptide sequence at SEQ ID NO. 21184
  misc_feature (517)..(517): n is a, c, t, g, unknown, or other
  misc_feature (518)..(518): n is a, c, t, g, unknown, or other
  misc_feature (543)..(543): n is a, c, t, g, unknown, or other
aagctggagctccccgcggtggcggccgctctagaactagtggatcccccgggctgcaggaattcgcacgagaccattacctagaacatcctaatcgaaaaacggatttgttaacgtcctctatgattgaaggagaattccaaaacctgtaaagaatgagtctcgcagtctttgagctcacaaggttctaacagtggggagcgtgtttggagcaagcgatcgattaaaggatgtatagtcccatgcacaggagttctttagatagggagatccctggcagcacaaaattctccttgccacagatccagaaagcaacaaagaacttctcgccaaacttcaagattgggcagggtggttctgggactgtatacaagggtcagcttgctgatggtactcttgtcgctgtcaaacgtgccaagaagaatgtgtatgacaagcatatggggtcgtgagttctggaacgagattgagacatttgcacgcattgagcacctgaattttggtagggtccatgggnnacttgggaagtttggtggcgagcantttgattatttgggggagtattgtccccaatgggaatcttcgagagcaactcgacttgtataaatggaaaaaaaaattggaactcctcactgaagatttgaaatttgccaattggagggggctcatgcttattaacatatcttcataaccaattcggaaa

SEQ ID NO: 21184 - protein, 73 aa, Zea mays
  misc_feature: Ceres CLONE 1390176-F
  misc_feature: SWISSPROT Homolog: EC 2.7.11.1 Non-specific serine/threonine protein kinase
MYSPMHRSSLDREIPGSTKFSLPQIQKATKNFSPNFKIGQGGSGTVYKGQLADGTLVAVKRAKKNVYDKHMGS

SEQ ID NO: 21185 - DNA, 653 bp, Zea mays
  misc_feature: Ceres CLONE 1390178-F
  misc_feature: Translation starting site: 219
  misc_feature: Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature (433)..(433): n is a, c, t, g, unknown, or other
  misc_feature (434)..(434): n is a, c, t, g, unknown, or other
  misc_feature (475)..(475): n is a, c, t, g, unknown, or other
  misc_feature (486)..(486): n is a, c, t, g, unknown, or other
  misc_feature (556)..(556): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
ggagctcaccgcggtggcggccgctctataactagtggatcccccgggctgcaggaattcgcacgagaccattacctagaaatcctaatcgaaaaacaaatgaaacccctgagacagtcagacgtcccgtgctcgtcatcaccacccacatctcagttcaccccggcgtcgtcctcttcccccggcgctactctcccgctccacgttccaaaggaaagatggcgtcccatattgttggataccctcgcatgggccccaagagagagctcaagtttgccttggagtctttctgggatgggaagagcagcgccgatgatttagagaaagtgcctctgacctcaggtctagcatctggaagcaatgtcagaagctgggatcaagtacatttccagcaacaccttctcgtactatgaccaggtccttgataccacgnncatggcttggtgctgtcccagagcgctactcttggactggnagcgagatggncttgagcacctatttcctcatggccagggaaaatgccactggtcctgctatggagatgaacaagtggttngataccaactaccactttattggtcctggacttggcccaagcacaaagtcacatacgtcccccagctgttcgatacagaagggcnnnnnnnnnnnnn

SEQ ID NO: 21186 - DNA, 658 bp, Zea mays
  misc_feature: Ceres CLONE 1390179-F
  misc_feature: Translation starting site: 356
cgctctcaactagtggatcccccgggctgcaggttttcgcacgagaccattacctagaacatcctaatcaaaaaaaactttagtctactcggcctcggtcctcctcttctcgcagcagccagcagaccaatcgggacaagcaaactcccccgattagtttaagcagcccggttccggcgacgaccagctccgttccgcgcggtgatttaaacgcgcgaagcgagaaggcacgcagcaggcggcagcggcaagcaacgaacgcgatcgcgcgccgacgacgacgcgcggtgccggcgcctggtggtgccgtgttgcggactccgctgcatcgtctcggtcggtcgtcgtcgttatcatgggtgtccggctgccggtggcgtgccccgccgtcctcgtcctcctcgtgcgggcggccgtgccgcggaagtacgcgaccatcttcaacttcggggactccctgttggacgccgccaacctgggtggtggacggcatcccggactacctggccacggcgcgcctgccctacgggatgacccacttcggctaccccaccgggccgctggctccaacggccggcctcgtcggttgattccctcgcgcaggaagctgggccggggccccttggttgccgcccgtcccaagcgctaaggaacgctc

SEQ ID NO: 21187 - DNA, 716 bp, Zea mays
  misc_feature: Ceres CLONE 1390180-F
  misc_feature (216)..(216): n is a, c, t, g, unknown, or other
  misc_feature (218)..(218): n is a, c, t, g, unknown, or other
  misc_feature (219)..(219): n is a, c, t, g, unknown, or other
  misc_feature (255)..(255): n is a, c, t, g, unknown, or other
  misc_feature (256)..(256): n is a, c, t, g, unknown, or other
  misc_feature (260)..(260): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (271)..(271): n is a, c, t, g, unknown, or other
  misc_feature (272)..(272): n is a, c, t, g, unknown, or other
  misc_feature (276)..(276): n is a, c, t, g, unknown, or other
  misc_feature (281)..(281): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (289)..(289): n is a, c, t, g, unknown, or other
  misc_feature (323)..(323): n is a, c, t, g, unknown, or other
  misc_feature (327)..(327): n is a, c, t, g, unknown, or other
  misc_feature (330)..(330): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (385)..(385): n is a, c, t, g, unknown, or other
  misc_feature (386)..(386): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (396)..(396): n is a, c, t, g, unknown, or other
  misc_feature (398)..(398): n is a, c, t, g, unknown, or other
  misc_feature (400)..(400): n is a, c, t, g, unknown, or other
  misc_feature (421)..(421): n is a, c, t, g, unknown, or other
  misc_feature (425)..(425): n is a, c, t, g, unknown, or other
  misc_feature (426)..(426): n is a, c, t, g, unknown, or other
  misc_feature (633)..(633): n is a, c, t, g, unknown, or other
  misc_feature (661)..(661): n is a, c, t, g, unknown, or other
  misc_feature (667)..(667): n is a, c, t, g, unknown, or other
aaagctggagctccccgcggtggcggccgctctatcactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgncnnatgcgggctcgcccgctccgacactcgcccccggcnngcgngnnncgcgcgnngcgnttttngnnnncgntaccccggcgggggcggggggccccggggcgggnggcnccncggggggccggcccgggggggnnnggcccccccccccccccccgcgggggggggnncnnnnccgcncngnccccccccccccggggcggcncccnngggggggcgcggccccgggggcgcccggccggcccccgccccccccccccgccccccggggccccccggcggcccccgcgccggcgcgcccccccccgcgcccgcgccgccccccccgcgccgccccgccccccccgcgcgccgcgcgccgccccgcgccgcgcgccgccgcgggcgggcgcgggcccggggcccgcccgccgcccncccggcccggccccggcggcgcggcgcncggccncggcccgggcggggggcgggcggccgccgcccgcgcgcccgcccccccc

SEQ ID NO: 21188 - DNA, 650 bp, Zea mays
  misc_feature: Ceres CLONE 1390183-F
  misc_feature: Encodes the peptide sequence at SEQ ID NO. 21189
  misc_feature (650)..(650): n is a, c, t, g, unknown, or other
cgctcttcactagtggatcccccgggctgcaggaattcgcacgagaccattacctagaacatcctaatcgaaaaatccctcctcctaactccaaactacccactggttcgactcgcgttcgcatcgcaagcagcagcgttccatcgaggcaatggcggtgatggccgaagtagtgtcgaccaccggcgcggcgctccggagcccggcctcgcagcagccggcggcggcgggcgcggcgaagggcaccgacgctgagaagctccagttcatcgaggacatgacctccaacgtggacgccgtgcaggagcgcgtgctgggggagatcctcgcccgcaacgcggacaccgagtacctcgccggcaggtgcggcctcgccggcgctacggaccgcgccaccttccgcgcaagggtgccgatgccgacgtacgaggacctgcagccgtacatccggcgcatcgccgacgccgaccgctcgcccatcctgtcggggcacccggtctccgagttcctcaccagctccggcacgtccgggggcgagcggaagctcatgcccacatcgaggacgagctcaaccgccgccagctgctgtacagcctccagatgcccgtcatgaacctggacgtgcctgggatggaaaaggggaaagctcn

SEQ ID NO: 21189 - protein, 153 aa, Zea mays
  misc_feature: Ceres CLONE 1390183-F
MAVMAEVVSTTGAALRSPASQQPAAAGAAKGTDAEKLQFIEDMTSNVDAVQERVLGEILARNADTEYLAGRCGLAGATDRATFRARVPMPTYEDLQPYIRRIADADRSPILSGHPVSEFLTSSGTSGGERKLMPTSRTSSTAASCCTASRCPS

SEQ ID NO: 21190 - DNA, 674 bp, Zea mays
  misc_feature: Ceres CLONE 1390184-F
  misc_feature: Encodes the peptide sequence at SEQ ID NO. 21191
  misc_feature (351)..(351): n is a, c, t, g, unknown, or other
  misc_feature (355)..(355): n is a, c, t, g, unknown, or other
  misc_feature (412)..(412): n is a, c, t, g, unknown, or other
  misc_feature (636)..(636): n is a, c, t, g, unknown, or other
tccccgcggtggcggccgctctagaactagtggatcccccgggctgcaggaattcgcacgagaccattacctagaacatcctaatcgaaaagtccgccccccgccaccaccgcactcccatccagatgggagtgcgcaagaggagctttcggcattccggtctcgctcgaccaaccggatccccgtgagagtccccacccacaccccgagggcggcgtcgggtcgtcggggacagctgatttcacaagacgagccggcgagccggccggcatttcgtcgtcggatggcgccggcctcctcctcgtccgccggcgtcgcgtggctcgtcctgctcctggctctgctcctcgncggngcctccgcggggcacggctcgttcaagggtaggcgtgctctgtcagatgaccatggnagcggtatagtggcgcgatgggcggaggttgctcgccgacgctgcgactccagcgaacaactctcttgtgctggctggcgccgaggactcaccggagcgaccccctcgccaacctttacgcgtacgagggggggttggaaactttagggacgagcactacggggttttcgggacgaaaacccgggggggcccccttcttagggccggggtggggggtttttttnttttccgggccccaaaggcaaaatactcctggggtggg

SEQ ID NO: 21191 - protein, 91 aa, Zea mays
  misc_feature: Ceres CLONE 1390184-F
  misc_feature (23)..(23): Xaa is any aa, unknown, or other
MAPASSSSAGVAWLVLLLALLLXGASAGHGSFKGRRALSDDHGSGIVARWAEVARRRCDSSEQLSCAGWRRGLTGATPSPTFTRTRGGWKL

SEQ ID NO: 21192 - DNA, 671 bp, Zea mays
  misc_feature: Ceres CLONE 1390185-F
  misc_feature: Encodes the peptide sequence at SEQ ID NO. 21193
  misc_feature (353)..(353): n is a, c, t, g, unknown, or other
  misc_feature (573)..(573): n is a, c, t, g, unknown, or other
  misc_feature (604)..(604): n is a, c, t, g, unknown, or other
  misc_feature (615)..(615): n is a, c, t, g, unknown, or other
  misc_feature (642)..(642): n is a, c, t, g, unknown, or other
tccccgcggtggcggccgctctataactagtggatcccccgggctgcaggaattcgcacgagaccattacctagaacatcctaatcgaaaaattcaatcaagttgagtaaagcccccccaccccaaaccaaatctcggaaggcgatcgacgactcgacgtgtgttctacgagtaggagctgttaatcaacagctagtgaatcggagggcgacggtaccaaccttgatgcggcgatagagtcgctcctgaatgtcgagaagcagatgaggctggccggagatgtcgccggcactcggaaggccgtcatcgacatcgtcgagctctgctacaaggccggcgcgtggaagacgctnaacgaccagatcgttctcctatctaagaggagaggccagcttaagcaggctattactgctatggttcagaaagcaatggagtacattaatttgacaccaggcattgacacaagcatcgagctaataaaacactgagcagtgtctctgctggcaaaatctatgttgagatagagagagcaagattgatcaaaaggcttgcaaaaattaaagaggagcaggnacagatttacgaggctgctgatttgatgcangaaagtgctgntgaaacatttggctctatggcaaagancgagaaaattgcttcatttcttgagcagg

SEQ ID NO: 21193 - protein, 74 aa, Zea mays
  misc_feature: Ceres CLONE 1390185-F
MRLAGDVAGTRKAVIDIVELCYKAGAWKTLNDQIVLLSKRRGQLKQAITAMVQKAMEYINLTPGIDTSIELIKH

SEQ ID NO: 21194 - DNA, 750 bp, Zea mays
  misc_feature: Ceres CLONE 1390187-F
  misc_feature: Encodes the peptide sequence at SEQ ID NO. 21195
  misc_feature (22)..(22): n is a, c, t, g, unknown, or other
aaattactacctatctttttantaaaaaaaccaataaaacccaacatccccacaaccgatccccccgtggggaaggacgcttttcaaaatagaatcccccgggatgaatttccccacacaagaccattacctacaacatcctaatcgaaaaaaaataacacactatgttccccgatcaaagcttgcgcgtttacaatgtctgcacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcgtcacggccgggtgcccgctggccgccacgctgtaggagcgcttccgcgtgctgctgctggagcgcggcgcctcgccctacgacgacaaccgcatcggtgacatgtcccgcttcgcggacacgctgacgaacacctccccggtctcgcccgcgagcgcttcctgtcgggagtacggtgtcatcaactcccccccgcagcctgcctgtcccgcccaacaccgcatcaacgcccgcgtacctacacaaaccacacaccacaaccaccctactgtccctacccgcccccccccgcttcgccgcctcgccccgacacaccaccccgaaccgcccccccgctcccacacccccctccctcccccccgcctcaaaccccctcccgcgcccccc

SEQ ID NO: 21195 - protein, 67 aa, Zea mays
  misc_feature: Ceres CLONE 1390187-F
  misc_feature: SWISSPROT Homolog: EC 4.1.2.10 Mandelonitrile lyase
MSARSRHFTMSTLLATSFFFVLLCSSLQVRGVNYTFVKDAALAPSVSYYDYIIVGGVTAGCPLAATL

SEQ ID NO: 21196 - DNA, 710 bp, Zea mays
  misc_feature: Ceres CLONE 1390189-F
  misc_feature: Encodes the peptide sequence at SEQ ID NO. 21197
  misc_feature (17)..(17): n is a, c, t, g, unknown, or other
  misc_feature (18)..(18): n is a, c, t, g, unknown, or other
  misc_feature (40)..(40): n is a, c, t, g, unknown, or other
  misc_feature (48)..(48): n is a, c, t, g, unknown, or other
tggttgacccccccctnntcaaccccacatccaagttttnttaaattnattacaaagtggagctccccgcggtggcggccgctctatcacagtggatcccccgggctgcaggaattcgcacgagaccattacctagaacatcctaatcgaaaaatccgttcaccccgcgaccctgcgtgcccccctccctccctcagcccccccctctctctcgctctcggcgacgactgggcgaccgccgccgccgctgccgctgcgccgcccttgtccaggtgcccaggtcttcgccggcgccttcgccaggtcttcgaaggtaacgagcaccaaccggattcagggaatataagtaaaatgaggccagttttttgtgggaaccttgactatgatgttcgcatctcagaggttgagcgcctttttgggaagtatggaagggtggaacgagtggatctaaagacagggtttgcatttgtctacatggaagatgaacgcgatgctgaagatgctatcagtagacttgatggaattgattttggcagaaaaggaaggagggatcagggtttgagtggacaaaaggaggatctgcaactggtgggccgaaaaaagcaggcttcaagggagggcttcccacccaataactaaaaccggacaaaaaaccctttgggttgtggggaccaacttttggagcccgaatcgaacctcaagaaattcag

SEQ ID NO: 21197 - protein, 95 aa, Zea mays
  misc_feature: Ceres CLONE 1390189-F
  misc_feature (4)..(67): Pfam Name: RRM_1 Pfam Description: RNA recognition motif. (a.k.a. RRM, RBD, or RNP domain)
MRPVFCGNLDYDVRISEVERLFGKYGRVERVDLKTGFAFVYMEDERDAEDAISRLDGIDFGRKGRRDQGLSGQKEDLQLVGRKKQASREGFPPNN

SEQ ID NO: 21198 - DNA, 728 bp, Zea mays
  misc_feature: Ceres CLONE 1390190-F
  misc_feature: Encodes the peptide sequence at SEQ ID NO. 21199
  misc_feature (470)..(470): n is a, c, t, g, unknown, or other
  misc_feature (507)..(507): n is a, c, t, g, unknown, or other
  misc_feature (524)..(524): n is a, c, t, g, unknown, or other
  misc_feature (557)..(557): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
aagctggagctccccgcggtggcggccgctctagtactagtggatcccccgggctgcaggaattcgcacgagaccattacctagaacatcctaatcgaaaaccccggcccggtccggcctaaacacgcattcttccttctcccaacgacggaagaaacttcctgcctggatatccatccatccaaccgctcctccctcgtccggcaggcgacgactcgattccttcctcccttcctcctcctcgtctctttcatcggcgactccgatcttctctgccgtcgccgccgccgccaagagatcgacccgaccccgagcgcccgacccgaccccccaatccaaccaccaaccgccggcgcgcgcggaagattcagatttggcccctcgccggtaagggagaaagcgaggatgggtgcgtggatgtcgcgcgtgtggttcctcatgttcccagcgcgggagtacaagctcgtcgntgtggggctcgacaacgcggggaagacaccacgctcntacagctccacctcggngagggcgtcaccggccgcgcccacatcggaagnaacgttgaagaggtcgtctcagaactgcgctcagtctggatcaggagccaaaaagctgcaccttggggaccatcgacccggtgggaaaaacccccaaataaaattcttacccagggttgtaaaaannnnnnnnnnnnnnnnnnnnnnnnnnnnnnnnnnnnnnnnnnnnnn

SEQ ID NO: 21199 - protein, 92 aa, Zea mays
  misc_feature: Ceres CLONE 1390190-F
  misc_feature (22)..(22): Xaa is any aa, unknown, or other
  misc_feature (40)..(40): Xaa is any aa, unknown, or other
  misc_feature (51)..(51): Xaa is any aa, unknown, or other
MGAWMSRVWFLMFPAREYKLVXVGLDNAGKTPRSYSSTSXRASPAAPTSEXTLKRSSQNCAQSGSGAKKLHLGDHRPGGKNPQIKFLPRVVK

SEQ ID NO: 21200 - DNA, 810 bp, Zea mays
  misc_feature: Ceres CLONE 1390191-F
  misc_feature: Encodes the peptide sequence at SEQ ID NO. 21201
  misc_feature (42)..(42): n is a, c, t, g, unknown, or other
accccactcccccccccaaccccgcctccccggcccccaccnaccaaagtggagctccccgcggtggcggccgctctagtctagtggatcccccgggctgcaggaatttgcacgagaccattacctagaacatcctaatcgaaaactgggaggcagagacgaaagcctactagcttccctttgggtcggtctcgcgctcccgctgcgcgtctgtctgtctgtctgtcttggagcctcatcaatggctaccatcagagaggagtccgactacgacagcagccggtcctcgctgacggcgccgggcggctcccgccggagctggatcagcgacattggcagcgccagctcggtctcggcgcgctccgtgccggggcgaggctgggacgcgccggcgtgccgccaccgccacaagcctcacaaggcgaaaccaggacgagtgggaggccatcgggcgcgcccccgccgccgggggccgcgtcggcctggagcacttccgcctgttgcggcgccctgggcagcgggggacctcgggaacgtctacctctggcagctgcgcgaagccctgggtccaccaggggggtgcctgtaccaccatgaaggtgggtgggaaagggaccggcctggaggttcccccaagaaactgccggccggcggaaagggggaaccgcaaagaatcctccggcgcggtttcgaaccaccccccttccttccccaacattggtaacgcccgaacttcgaaaggcggtcggaacatacggcctgggcctccgtccatgggaagtttccgggcccccgcggggggggaacttg

SEQ ID NO: 21201 - protein, 160 aa, Zea mays
  misc_feature: Ceres CLONE 1390191-F
MATIREESDYDSSRSSLTAPGGSRRSWISDIGSASSVSARSVPGRGWDAPACRHRHKPHKAKPGRVGGHRARPRRRGPRRPGALPPVAAPWAAGDLGNVYLWQLREALGPPGGCLYHHEGGWERDRPGGSPKKLPAGGKGEPQRILRRGFEPPPFLPQHW

SEQ ID NO: 21202 - DNA, 678 bp, Zea mays
  misc_feature: Ceres CLONE 1390192-F
  misc_feature: SWISSPROT Homolog: EC 1.1.1.40 Malate dehydrogenase (oxaloacetate-decarboxylating) (NADP(+))
  misc_feature (402)..(402): n is a, c, t, g, unknown, or other
  misc_feature (404)..(404): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (422)..(422): n is a, c, t, g, unknown, or other
  misc_feature (423)..(423): n is a, c, t, g, unknown, or other
  misc_feature (425)..(425): n is a, c, t, g, unknown, or other
  misc_feature (426)..(426): n is a, c, t, g, unknown, or other
  misc_feature (428)..(428): n is a, c, t, g, unknown, or other
  misc_feature (435)..(435): n is a, c, t, g, unknown, or other
  misc_feature (456)..(456): n is a, c, t, g, unknown, or other
cgcggtggcggccgctctatcaatagtggatcccccgggctgcaggatttcgcacgagaccattacctagaacatcctaatcgaaaaagaccatagtcatctcatccctcccaactccgctgctacgccttcttctacatcgcaatcacgcgcccgtccggctctcccccttctccctcgccctcacgcgctcacgccctcacctcagtcctcatcgctctcggccgcctgcttaaaccctccgctcgaaccggaacccaaccgagaacagatccaaaacgcaagccgcaccatgtctcgtgtcgcgggctcgcgcctcctccctaggatctctgcgctctccttctgcaccgcctccccggcaaccgccgccgcttcctcctcctcatccacagcggcggngntannnnnnnnannnactnnannanaaaaaantcatgcacaacctgcaccganacaagcaagcgctggaccgctacatccgccatgatggacctgcaggaacgcaacgagaggctcttctacaagctcctcatcgataacggtcaaggaactggcccccggccgctaacccgcccaccgccgcagagggacgcccagaagtacggcatctatccacccgccgcccgcaggtggctgaaattcaagcctcaggaaaaagggacaaggacctcccaa

SEQ ID NO: 21203 - DNA, 655 bp, Zea mays
  misc_feature: Ceres CLONE 1390194-F
  misc_feature: Encodes the peptide sequence at SEQ ID NO. 21204
  misc_feature (298)..(298): n is a, c, t, g, unknown, or other
  misc_feature (319)..(319): n is a, c, t, g, unknown, or other
  misc_feature (351)..(351): n is a, c, t, g, unknown, or other
  misc_feature (358)..(358): n is a, c, t, g, unknown, or other
  misc_feature (361)..(361): n is a, c, t, g, unknown, or other
  misc_feature (441)..(441): n is a, c, t, g, unknown, or other
tccccgcggtggcggccgctcttcaactagtggatcccccgggctgcaggaattcgcacgagaccattacctagaacatcctaatcgaaaaacgcacctcccgacttctccggttctcccttcttcatagcagccacccacgcatctcagcgccgaggcgagcgaggacctcgtggttcgtgccctgctcacctcgtgaggatgtggatcgcgagccggctcttcctcgcggcggcggcgctgctgatggctgtgcttctgctcgtcgcggggccggtggcggcgcaggacgcggcgntggagggcgtggccccgcctnggcggagagatcgcgcgaacgcgagggccaanggagcgntgnttctggccgccgagctagtgcagctcagggcgaagatctccgcgttagagtctcgcattgcagagcagaacctggagttnccagacaagaatgatgcaatcgaaacactgaatatgattgtcaaaggaaaagtcacagaagattgctactatgcagaatgaagccaaaaggttctttagctgcagaggagcagggaagcaaggccaatgcactgcttatggagctcaagaagcagaccgagaagttcaagaaggttattacagaaccaaaaattaaaaaagcggctctggaggg

SEQ ID NO: 21204 - protein, 106 aa, Zea mays
  misc_feature: Ceres CLONE 1390194-F
  misc_feature (33)..(33): Xaa is any aa, unknown, or other
  misc_feature (40)..(40): Xaa is any aa, unknown, or other
  misc_feature (50)..(50): Xaa is any aa, unknown, or other
  misc_feature (53)..(53): Xaa is any aa, unknown, or other
  misc_feature (54)..(54): Xaa is any aa, unknown, or other
  misc_feature (80)..(80): Xaa is any aa, unknown, or other
MWIASRLFLAAAALLMAVLLLVAGPVAAQDAAXEGVAPPXRRDRANARAXGAXXLAAELVQLRAKISALESRIAEQNLEXPDKNDAIETLNMIVKGKVTEDCYYAE

SEQ ID NO: 21205 - DNA, 701 bp, Zea mays
  misc_feature: Ceres CLONE 1390196-F
tccccgcggtggcggccgctctatgaactagtggatcccccgggctgcaggaattcgcacgagaccattacctagaacatcctaatcaaaaaggacccttgtttgcctatacgctgccagcctgccttttctaagttcttcttcaatcgctccacccccaccccccttctctctcgtagaatcgtttgggcggccggcgctgccgctctactcgggtgccaagtacttgttcgggcccttcgccgacgagccagggtacatttgctttgggatgagaggaacagtggtgcatttattatgatgatgacgacgacattgcaggagattgaggatgactatgatatggaatgaccctgctgatgaactgataagaggaggattggagttttaagcgattcctgatgccggaggataatggattaaggaacaaccagaatgacaaagatccccagatacgttcaatcacgcagaaggcaggaaatggacaggtaccatccaaggaatacccctggggagcagcctagaacataacccgtaaaaaaatatagacctgtccaagattagaacaggtacaaaaaaattatgagaatgtaccctaactcttgaagaaaatgctatggatggattgcaagccaacagagaaaagtggaatggtactatgagttcagacgaataactcgatcgattaagtcaactattcg

SEQ ID NO: 21206 - DNA, 769 bp, Zea mays
  misc_feature: Ceres CLONE 1390198-F
  misc_feature: Encodes the peptide sequence at SEQ ID NO. 21207
  misc_feature (21)..(21): n is a, c, t, g, unknown, or other
  misc_feature (43)..(43): n is a, c, t, g, unknown, or other
tttttcctttctccccccccnccctcccccccctttgttttgnttttatcaagctggggctccaccgcggtggcggccgctctaccaatagtggatcccccgggctgcaggtaattcgcacgagaccattacctagaacatcctaatcgaaaagtcccaaaaagggcaacgaaatccagacaccgctccccatctccccttccttcctttcctactcccacactcccccaccctccactagtactagtactagtaccacaaccaccccaccgggaaaaaacccaacaaggggtagggccgccgccgccgccagcgccgccgtgcagatcgcggccggatctacggcgctggggcacgggggtccccggatcgacgacgcctccgccgagggttcggatggctatgcgaaaagaaaaccctgtgcttaatgcttgtcaagaatccaatggccggatcacgcgagctcaagctgctgcaaatcgtcgaagctttggagctttcccttctgttccattgcctgcaaaaaccgaacgaaaaacagactgcacaagggaaggcaaaaacgaggttcttcatatgaccacaccaggtgcaagcggttggcacctttcaggccccccagcctaaaaaggggaacagctacttcaggggaaggggacccaattttgaagaaatggctaacttcctaaccacaaggtttttggctgcctggacaccgaaagctttcaaaaacaagaggcccccctccagagagagacctggacaaaaa

SEQ ID NO: 21207 - protein, 76 aa, Zea mays
  misc_feature: Ceres CLONE 1390198-F
MAMRKENPVLNACQESNGRITRAQAAANRRSFGAFPSVPLPAKTERKTDCTREGKNEVLHMTTPGASGWHLSGPPA

SEQ ID NO: 21208 - DNA, 595 bp, Zea mays
  misc_feature: Ceres CLONE 1390205-F
  misc_feature (410)..(410): n is a, c, t, g, unknown, or other
  misc_feature (434)..(434): n is a, c, t, g, unknown, or other
  misc_feature (481)..(481): n is a, c, t, g, unknown, or other
  misc_feature (488)..(488): n is a, c, t, g, unknown, or other
  misc_feature (489)..(489): n is a, c, t, g, unknown, or other
gctctttactagtggatcccccgggctgcaggaattcgcacgagaccattacctagaacatcctaatcgaaaagatctcctcgcaacaaaatttgacccacttgccaaccgatcccgccaacggtttgtttgaactaatagctgatgaaaccaagcgtcttgaaagaaaatgctcctcaaaaagtttggctgacggcacccactcgctcgcatagaagcgcacctctgttctttggtgtgcgaccgtgtgaattcaaaaccgctgaccggccgcttatttaagcccttgccccgccggttttctcttctcccgtcggtgctgatcacgcgtgtccacacctgcctgctgcctgattcttacccaccaacacgcgcgccagccgaattctcttcaccgatcgccccgcccnttcccattgcttacttgctatgcncagcagcagccggtgcggggattctgaagtggcaccgcggggaaggnggacggnnaacccttccccaggggaaggcgcggcccaacctgggccccggggaaaccgggcgcccaccatcacccccccacgcccgagaactccgcggacctccctcgccccgc

SEQ ID NO: 21209 - DNA, 669 bp, Zea mays
  misc_feature: Ceres CLONE 1390210-F
  misc_feature: Translation starting site: 223
  misc_feature: SWISSPROT Homolog: EC 1.8.1.4 Dihydrolipoyl dehydrogenase
  misc_feature (418)..(418): n is a, c, t, g, unknown, or other
  misc_feature (437)..(437): n is a, c, t, g, unknown, or other
  misc_feature (530)..(530): n is a, c, t, g, unknown, or other
  misc_feature (560)..(560): n is a, c, t, g, unknown, or other
tccccgcggtggcggccgctctataactagtggatcccccgggctgcaggaattcgcacgagaccattacctagaacatcctaatcgaaaattcgaaacctccgccccgtcgcataaacccctcctcgcctcctccgcccgagcctgcctcctcatcgacttatacgcctccttctcttaactcgacgcactagcctcagccaattgtcgcatttcgtcgctatggggtccacagcggccgtctccgtctccgcctcggcgatcgcgtcccgcggctgcgccagatccgaggctgcgcggcggccaggtggaatccgggtctgcggactccggagcgaggccctcacgtgtcactcgcttcggatctcgcaggcgcccgcgaggctgacggtggcgaggccgccgccgccggcggcgncgaccaatggcgcggcggncgggacctggcggttcgactacgatctcgtcatcatcggcgggggcgtcgggggtcacggcgccgcgctgcacgccggtgaagagggcttaanaaacagaataattgagggagatgttgttgnctggcacttgtgtaaacagaggctgtgtcccatcgaaagcgcttcctggctgtccagcggtcgaaatgcggaagctccatgatgaacctcatatggaaggccttggggc

SEQ ID NO: 21210 - DNA, 700 bp, Zea mays
  misc_feature: Ceres CLONE 1390211-F
  misc_feature: Encodes the peptide sequence at SEQ ID NO. 21211
  misc_feature (471)..(471): n is a, c, t, g, unknown, or other
ggagctccccgcggtggcggccgctctagaactagtggatcccccgggctgcaggaattcgcacgagaccattacctagaacatcctaatcgaaaaacacgagcatacgcgacgactgacaaggcgaggggagcactcggcggcgatgggcggcggcggcgcacatggcggcaccacctacaagggctacaccatcccgcacaacaagcgctggcacaccgtcgccggcaagggcctctgcgccgtgatgtggttctgggtttctacagggctaagcaggatggtgctacgctcttggggtttgcgtcatcccttgggatggacatgatgaccactctcatggtcatggacaccggcatgaggcatcatcatcgtcatcttcacattaaggtccctactggctggggacgatgcttggcatggtcaacaggctaaaggttgaggtaataaattctatcaccctggatgggnactcatggtgtgttgcaactgggttaacacgaaactgggctctggtactattggggtaaagggattttggggtccgaaagttcccggcaaaaaaaaaaaaaaaaaaggttatacgaaccgccgaaccttcgggggggggggccccgggacccaaatccgcccctaaagggggggccgaattaccgccgcccccctggggccggcggttttaaaaccggccgggggctgg

SEQ ID NO: 21211 - protein, 60 aa, Zea mays
  misc_feature: Ceres CLONE 1390211-F
MGGGGAHGGTTYKGYTIPHNKRWHTVAGKGLCAVMWFWVSTGLSRMVLRSWGLRHPLGWT

SEQ ID NO: 21212 - DNA, 754 bp, Zea mays
  misc_feature: Ceres CLONE 1390217-F
  misc_feature: Encodes the peptide sequence at SEQ ID NO. 21213
  misc_feature (32)..(32): n is a, c, t, g, unknown, or other
  misc_feature (36)..(36): n is a, c, t, g, unknown, or other
  misc_feature (37)..(37): n is a, c, t, g, unknown, or other
tggttcctttcccctctcctttttactattanctcnnttcaccttctcctttcaaaactggagctccccgcggtggcggccgctttccaatagtggatcccccgggctgcaggaattcgcacgagaccattacctagaacatcctaatcgaaaaatatataatggtattacccccgtcgtcaaatgcaccgccacccaaccccatggccgccgccaccggaagaaccatgaagacgatggcgctcgtcgtcgtcctcgccgccctcctctgctccatctcggtcgccgctgcagccagcggcggcctttcttcgtacgtggtgtacctcggccagcacgcgcacggcgcggcgctggtcacgcacggcgccgaggagctgcaggcgctggagcgcgacgccgccgaggcgcactgcgaccctcctcgccggggtctttggccggagacaagcaaaaggggccggaagccgatcttctactcgtacacgaagcacatcaacggctttcgcagccaacctgggacgccgccaccgcccgccggagattgcgggggaaaccccggcgtgaatctcttgtgttccccaaaccaggggccgcaaggctgcacaccaacccgggtcaatgccagttccggcgggcctggccggggccccggtggctgttcccccaagggggggggctgggctgaaaaaggccaaagtccggggggccaaaaacaattaattgggaaatttcaaaacaatggggggggggg

SEQ ID NO: 21213 - protein, 183 aa, Zea mays
  misc_feature: Ceres CLONE 1390217-F
MAAATGRTMKTMALVVVLAALLCSISVAAAASGGLSSYVVYLGQHAHGAALVTHGAEELQALERDAAEAHCDPPRRGLWPETSKRGRKPIFYSYTKHINGFRSQPGTPPPPAGDCGGNPGVNLLCSPNQGPQGCTPTRVNASSGGPGRGPGGCSPKGGGWAEKGQSPGGQKQLIGKFQNNGGG

SEQ ID NO: 21214 - DNA, 730 bp, Zea mays
  misc_feature: Ceres CLONE 1390219-F
  misc_feature: Encodes the peptide sequence at SEQ ID NO. 21215
  misc_feature (657)..(657): n is a, c, t, g, unknown, or other
aaagctggactccccgcggtggcggccgctctatactagtggatcccccgggctgcaggaattcgcacgagaccattacctagaacatcctaatcgaaaatccactcgccctcccacacagaaaaccctagccgccgccaccgaagcggcctcccaggtaagcaggagcgtccaccccgccgccgtcatgaagcgcaatccccgcgtcacgagctcccgccggaagtgccgcaaggcgcactttacggccccgtcctccgtccgccgcgttctcatgtccgccgggctgtcgacggagctccgccacaagtacaacgtgcgctccatcccgatccgcaaggacgacgaggtgcaggtcgtgcgcggcacctacaagggccgcgaggggaaggtggtgcaggtctaccgccgccgctgggtcatccacgtcgagcggatcacccgcgagaaggtgaacggctccaccgtgaacgtgggcatccacccctccaaggtgatcgtcactaagctgaagctcgacaaggaccgcaaggcgctcctggaccgcaaggcccggggccgcgccgccgacaaggctaagggcaagtttactgccgacgacgtcgctgccgccgccgctggtgggcgcgccaccggcgcctctctcccagagatcgnactagctcttcacggtcatctgatggttgtcgtaccgccttttcctcatctcttttagttttgctaccaatga

SEQ ID NO: 21215 - protein, 175 aa, Zea mays
  misc_feature: Ceres CLONE 1390219-F
  misc_feature (51)..(82): Pfam Name: KOW Pfam Description: KOW motif
  misc_feature (157)..(157): Xaa is any aa, unknown, or other
MKRNPRVTSSRRKCRKAHFTAPSSVRRVLMSAGLSTELRHKYNVRSIPIRKDDEVQVVRGTYKGREGKVVQVYRRRWVIHVERITREKVNGSTVNVGIHPSKVIVTKLKLDKDRKALLDRKARGRAADKAKGKFTADDVAAAAAGGRATGASLPEIXLALHGHLMVVVPPFPHLF

SEQ ID NO: 21216 - DNA, 800 bp, Zea mays
  misc_feature: Ceres CLONE 1390221-R
ccaattgggtaccgggccccccctcgaggtcgacggtatcgataagcttttttttttttttttttgcaccaaggcattcattgaaaactctgcatggaaggcatcacattagccttcccaatcacacgacactagcaatgttcaaaaccccaactgatccaagctaaaaataaaataaaaataaaggatagcatcccaccacgcatgccaacattttattgatgccccggggcgaaatctccacgaaagctaacttaattaacccaaacaaaccgtctcagcgtagaggcgcagagacggacgctaagactcgatctacctaatgaaccgaaaccgaggacgtcgacgacgaggggcggggcggcgggggacagtgacgtggtggaacggcgggcgtgcggccatgatctagttggccttgggcgatgaggtcctggggcggggggcggacccgtgggggcaagcgcccgggaagggcgcccccttctttgggggggtgcaaaaatgggcgcccccaaggcggttggaagaaacttgagaagccctcgcggaaaccttcctcctccctttggggaaaagaatagaaatctcttccctttgggccaaccttttgaaccaaggggaggggggagccccaaaacaaaaggggggtttccccccggggggcccccgggggggtggtgtttccaaaaagggggtggtcccaaacaccctgtggagaagggcccggggaaacaacccctcttgcccccccttattgaaaaaaaaccccccctcttgggaggggagaaaagaaaaca

SEQ ID NO: 21217 - DNA, 741 bp, Zea mays
  misc_feature: Ceres CLONE 1390224-F
  misc_feature: Encodes the peptide sequence at SEQ ID NO. 21218
  misc_feature (340)..(340): n is a, c, t, g, unknown, or other
  misc_feature (342)..(342): n is a, c, t, g, unknown, or other
  misc_feature (344)..(344): n is a, c, t, g, unknown, or other
  misc_feature (367)..(367): n is a, c, t, g, unknown, or other
  misc_feature (372)..(372): n is a, c, t, g, unknown, or other
tggagctccccgcggtggcggccgctctagaactagtggatcccccgggctgcaggaattcgcacgagaccattacctagaacatcctaatcgaaaactctcttcttcccgcggtctgctcgttcgatctgtgcagcagatctgaggtcccgggcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagtttcttagatgaacccccttgggaangntnctgtttctgagactcctgatggncctgntttttgagagtaatgctatcgcacgctatgttgctcgccggaaagatgacaaccctcttttttgggccttccccgattgaacaagcccccttggagaatgggtggaattttgcccaacaaaaagtgaccctgggggtgcaggggaacttgatccaaaggtttggggcacctccccttatgtttaccacaatgggggaaaaacttttcttttttttaaaaaaggccctttggtggtttaaaaacaccccttgggttaaaaaaaaaccttgggggggggggggtgttcccccggggagttgggaggggggggccccccccccaggggatgggggggttttggacaaaaactccccgggtttcccccccggg

SEQ ID NO: 21218 - protein, 47 aa, Zea mays
  misc_feature: Ceres CLONE 1390224-F
MALVLHSGAGNKNAFKALIAAEYSGIKVELTKDFEMGVSNKTPEFLR

SEQ ID NO: 21219 - DNA, 682 bp, Zea mays
  misc_feature: Ceres CLONE 1390231-F
  misc_feature: Encodes the peptide sequence at SEQ ID NO. 21220
  misc_feature (564)..(564): n is a, c, t, g, unknown, or other
  misc_feature (595)..(595): n is a, c, t, g, unknown, or other
  misc_feature (596)..(596): n is a, c, t, g, unknown, or other
caaagctggagctccccgcggtggcggccgctctagaactagtggatcccccgggctgcaggaattcgcacgagaccattacctagaacatcctaatcgaaaacttcccctgcacaggctgtcgtccacaatgcccgcgccgctgatactacccacagtcgcgcgcgagctggcagagctcctcgtcgccctctccgccgcccgcgcgctcccaaaaggacagcagctccacggccatctcctcaaggctggacacgtccccgccaccgcctcctcccacgcgctgctcgcgcaccacctccttacgttctacgcgcgctgcgcgctccctgacctctccctccgtgccttccttgacctccccgcgccgccccttcccgctgcatggtcttccctcatctcctccttcgctcagaacggcctcgccgccactgccttcgacactttccgccgcatgctcgccgcgggcgtccctgccaccgaccgctccatccctttggctgcaaaggccgttgccgctgccgagaccttgtcgcgccctccgttctcccctcacgcgctccngggccttgctgccaagacttcgtccgctggnngaacgttgtttgttggcctccggcgattgtcaacatgtatgccaagtgcggccaccttgcagacgcccgccggctattcgatgata

SEQ ID NO: 21220 - protein, 184 aa, Zea mays
  misc_feature: Ceres CLONE 1390231-F
  misc_feature (84)..(118): Pfam Name: PPR Pfam Description: PPR repeat
  misc_feature (145)..(145): Xaa is any aa, unknown, or other
  misc_feature (156)..(156): Xaa is any aa, unknown, or other
MPAPLILPTVARELAELLVALSAARALPKGQQLHGHLLKAGHVPATASSHALLAHHLLTFYARCALPDLSLRAFLDLPAPPLPAAWSSLISSFAQNGLAATAFDTFRRMLAAGVPATDRSIPLAAKAVAAAETLSRPPFSPHALXGLAAKTSSAGXTLFVGLRRLSTCMPSAATLQTPAGYSMI

SEQ ID NO: 21221 - DNA, 736 bp, Zea mays
  misc_feature: Ceres CLONE 1390234-F
  misc_feature (284)..(284): n is a, c, t, g, unknown, or other
  misc_feature (655)..(655): n is a, c, t, g, unknown, or other
  misc_feature (691)..(691): n is a, c, t, g, unknown, or other
  misc_feature (692)..(692): n is a, c, t, g, unknown, or other
  misc_feature (714)..(714): n is a, c, t, g, unknown, or other
  misc_feature (723)..(723): n is a, c, t, g, unknown, or other
  misc_feature (724)..(724): n is a, c, t, g, unknown, or other
tccccgcggtggcggccgctctataactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgacgcgcgcggttgtttgataggagaggaggaagatgagggagtgcatctccgtccacatcggggagggncggcatccaagtcggcaacgcgtggttggaaattttactgcctccagcacgggatccaatctgaatgatgacaagctcggagaaaaaacccggggacatcacgaaggaaaggcttaagcactttcttcttcacaactggtggggggatgaagcggaaccccgtcccgtgcatctcgtgatctaaaaaacaccccctgggtcatgaggggggcccttttggaaaaaaaagggggggtctgccccccgggtcttcactgaaagtataggggaggggtgcgtaaaaattttttcccgggggggcccccaccaatttggaaaaagaaattgtggatttggggctttaccccccacccccaaaattgggattaaanttaaatggccgcccacggtttctgtgtttaaagggnngtggggggggggaggggccccncccgccctnnttggcccccccc

SEQ ID NO: 21222 - DNA, 822 bp, Zea mays
  misc_feature: Ceres CLONE 1390236-F
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (30)..(30): n is a, c, t, g, unknown, or other
  misc_feature (45)..(45): n is a, c, t, g, unknown, or other
nccccccacccnnnncnnnnnnncaccccncgaccacatcaggcnacacaaaagctgcggctccacgcggtggcggccgctctacaatagtggatcccccgggctgcaggaattcgcacgagaccattacctagaacatcctaatcgaaaaataaattttaaaatataaaaaatacagataaaagggatatggttgaagatagtgccctctaaattctccctcgttgtcttaccgtgtcgttgttgccgggttttcttggcgagcgacggagccacagaaatggagtgcaatacgggcgcctaattttagcggcggggaggggagcgaagcctgggcagccactcgccggccttccaagaaaccgtcgccattttttcatccgagtgccgccgattttgatttcattattttctgtcttcgcggggaaccaattcggttttgtttccggaagaaagggaggggaggaatgctcctgccccgggtctcgacatcgccacgccgccggtctcccacgggcgactgtgtaactgtcccctcagccctaacaaccggccagggtggcccgaaagggcaaaaattcccctcaagacacacgcgcgtttaattgtatcgcccttaccacaaaggtccccctggacccctaacatccgaggctcataacacccccccccaggaaccgccacttttacacctccatacactgttcgtggaataaaatcgaacacaaaatccattacaaaacaaattgtcaccacctcacgtcgcatccgcgccatcatcccgtcgagaggtactccttgcgccgtatgcgcgtcaataaa

SEQ ID NO: 21223 - DNA, 643 bp, Zea mays
  misc_feature: Ceres CLONE 1390236-R
  misc_feature: Pfam Name: DUF525 Pfam Description: Protein of unknown function (DUF525)
accgggccccccctcgaggtcgacggtatcgataagcttttttttttttttttttgttttttttttttttttttttttttttttttttttttttttttttttggagcaagctctaagttccatgctgtacatttaaaagtacaattgggaggatgtcctattgggcctcacaattgatattcgcatgggccaaattcaacatcccagaaaactctacctgaccttgcaccaggggacttggctcccgccataagtcaaccatagtagttccacctgaaccttgcgctcaattacatcacttacaaaaaaaatttgggtttggggggctagtttaaatcccagggcttgtttgccaaaagggattgtgagctaaaatcccttactattcaaaattgaatagtaagggattgtagcccccttaattcccttcaatccatttgcttccaagcaagccctcagtgtagttcatagcaaaacatcattatcgtcaccaaaaattgacagaaagaatggcgcaattgcaacattgaatgttgatgatccagccttggcgatgtgcttcatctcaaagtcaccttccattctcccatttggagtgctcaatgggcatgcagaagatactcaaaaccagtcttcgggaata

SEQ ID NO: 21224 - DNA, 768 bp, Zea mays
  misc_feature: Ceres CLONE 1390238-F
  misc_feature: SWISSPROT Homolog: EC 1.1.1.40 Malate dehydrogenase (oxaloacetate-decarboxylating) (NADP(+))
  misc_feature (363)..(363): n is a, c, t, g, unknown, or other
  misc_feature (384)..(384): n is a, c, t, g, unknown, or other
  misc_feature (418)..(418): n is a, c, t, g, unknown, or other
  misc_feature (419)..(419): n is a, c, t, g, unknown, or other
  misc_feature (425)..(425): n is a, c, t, g, unknown, or other
aagctggagctccccgcggtggcggccgctctataactagtggatcccccgggctgcaggaattcgcacgagaccattacctagaacatcctaatcgaaaaagttctgattgggacgtctggagttggaagaacattcacaaaagaagttgttgaggccatggcttccttcaatgagaggcctatcatcttttcactgtcaaatccaacctctcattctgaatgtactgctgaagaagcatataactggactcagggtcgtgtaatatttgccagtggcagtccatttgaccctgtggagtacgatgggaaggtttttgtacctggacagtcgaacaacgcctacattttccctggatttggnctcggtctttgtatctctggnagcatccgtgtccacgaggacatgcttcttgccnngctcgnagcactagctgctcaggccacacagagaacttcgacagggatccatctccccgcccttcaacacattaaaaaaaccccctgcggaattgccgcaacccggggctgcaaaaactttaggaactcggtttggggacccgtttgcctccccccaagggaccggggggaaaattgcccaaagtggggtgggacacccctgtgaaaccgaaaaaacggggagggggggggggaaaaattccggagaaaaaaaaaaatgcccccccaaagaaccccccaaaggggggagattattttttttttttttggggggccgtggtgtgtaaaccctttgtgggggggaaaaaaa

SEQ ID NO: 21225 - DNA, 681 bp, Zea mays
  misc_feature: Ceres CLONE 1390243-F
  misc_feature: Encodes the peptide sequence at SEQ ID NO. 21226
  misc_feature (512)..(512): n is a, c, t, g, unknown, or other
  misc_feature (563)..(563): n is a, c, t, g, unknown, or other
  misc_feature (574)..(574): n is a, c, t, g, unknown, or other
  misc_feature (593)..(593): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
ggagctccccgcggtggcggccgctctagaactagtggatcccccgggctgcaggaattcgcacgagaccattacctagaacatcctaatcgaaaaacggttcttgttcttcttcccacccagcgtgcgctccctcttcctcttccccttctctctcggcgacgactgggtggccgtagctgcctccatacgcctggtgccctggtcttcttcgggccattcgccggccgcgagcaccaccaaaagggagagcttcccaggtagagctgtttctccgtactctagcagatggcaaggataaagcctaagcaattgctaatccaaagcaaaacaaagaaggctccatctcgaatcagctactctactatcatcacatggaacttgattgtcatattggttgtgctatctctctatgctacctacagccattggcatcaaaggtctgcccaagacttcgaaatggagcttcatgaagctgagcttgctgtgagaccggaggatccaaaaatgantagtagaccaagatatggcgtaatgaacaccgcaaaaggccccattactantagaatatacnaagatgctttctgctgacngtgtggatagatttatcaactttgtgcagagtaatcattcacgcnnnnnnnnnnnnnnnnnnnnnnnnnnnnnnnnnnnnnnnnnnnt

SEQ ID NO: 21226 - protein, 100 aa, Zea mays
  misc_feature: Ceres CLONE 1390243-F
  misc_feature: SWISSPROT Homolog: EC 5.2.1.8 Peptidylprolyl isomerase
  misc_feature (75)..(75): Xaa is any aa, unknown, or other
  misc_feature (92)..(92): Xaa is any aa, unknown, or other
  misc_feature (96)..(96): Xaa is any aa, unknown, or other
MARIKPKQLLIQSKTKKAPSRISYSTIITWNLIVILVVLSLYATYSHWHQRSAQDFEMELHEAELAVRPEDPKMXSRPRYGVMNTAKGPITXRIYXDAFC

SEQ ID NO: 21227 - DNA, 709 bp, Zea mays
  misc_feature: Ceres CLONE 1390253-R
  misc_feature: SWISSPROT Homolog: EC 2.7.1.4 Fructokinase
  misc_feature (1)..(1): n is a, c, t, g, unknown, or other
ncgattgggtaccgggccccccctcgaggtcgacggtatcgataagcttttttttttttttttttgccccaaaggattcattgtaaaactctcgctggcaacgctctcattactcttcgcaatcactctacactgacaatgttcaaaaccccaactgatgccaagctaataataaggtaaatgtaacggatagcatgcccatcacgattgccaccttttaactgatgtcccggggcgaagacgccactaatgataattttattcactgaaattaatttttttgacgtaaaggagcgcatatagactgttagactctatctgcttaatcaaccgagatctacaacgtttatcactagtaccggggctgcaggcgacactgacgagccggaactcctgttgcgcatgccatgatctcactgacctcgcgcaagagtctctgggcaggctaccttggctagctcccggatggcgctcttcttgtcggtgcagatggcgccacacgtgttcgacaactcgagagccccgctgagcttctcctcggtgtggaatatggagtcctacttggccatgttgactatgagggagcccactacacgtactccgtcacaggaggtgtcgacagtgttgatcttgacagacggacacgctgccccttcgaagtcctttgatgaagaacctcgcatcccctagtcccccatcggtgcacgag

SEQ ID NO: 21228 - DNA, 679 bp, Zea mays
  misc_feature: Ceres CLONE 1390255-F
  misc_feature: Encodes the peptide sequence at SEQ ID NO. 21229
  misc_feature (339)..(339): n is a, c, t, g, unknown, or other
  misc_feature (386)..(386): n is a, c, t, g, unknown, or other
  misc_feature (387)..(387): n is a, c, t, g, unknown, or other
  misc_feature (464)..(464): n is a, c, t, g, unknown, or other
aaagctggagctccccgcggtggcggccgctctagaactagtggatcccccgggctgcaggaattcgcacgagaccattacctagaacatcctaatcgaaaaactagtcccaactcccaaccaccgccagccgtccgctctccgcaagcgcgaccttccggccagatccgccgcgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtggnacgccatcagtgctctgtcctgggggtcggtctcttcttcggctganngatctgaagggggtttcgtggtatccgtcgctacgatctggtccagtcagagcacctggatcattctcgggtcgggncatggagactctgctcatctcgggagagcgcaaccaccagctccaccacttctcgggtcgccggaaagaggggttagcagcgtcgcctcagtccactcgcagctaccatggcgggcacctgccgggcgttccactccgggaatcaccgtcgggatcctggcggccccgccccgggaggagggttgcactgacccgctcctctcctgaggcccaga

SEQ ID NO: 21229 - protein, 71 aa, Zea mays
  misc_feature: Ceres CLONE 1390255-F
METLLISGERNHQLHHFSGRRKEGLAASPQSTRSYHGGHLPGVPLRESPSGSWRPRPGRRVALTRSSPEAQ

SEQ ID NO: 21230 - DNA, 697 bp, Zea mays
  misc_feature: Ceres CLONE 1390257-F
  misc_feature: Encodes the peptide sequence at SEQ ID NO. 21231
  misc_feature (371)..(371): n is a, c, t, g, unknown, or other
  misc_feature (413)..(413): n is a, c, t, g, unknown, or other
  misc_feature (415)..(415): n is a, c, t, g, unknown, or other
  misc_feature (697)..(697): n is a, c, t, g, unknown, or other
aaagctggagctcaccgcggtggcggccgctctagaactagtggatcccccgggctgcaggaattcgcacgagaccattacctagaacatcctaatcgaaaaagaagccatccccaaatcgccctacgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaaggnctcgatctgccccatgacctttcggctcgcctgctgcgcggngnagatgatgcacgcccgcgcgtcccgctacacttcgacccggttcggcgtcatcttccgtccgtccccgcgcccagtccaattgcatgatccgtcgccggcacgcttcaccaaaaagatggcttccggccctcccgaaaggtttatggaccaatggcctgaccctagggggtgttttttcaatggggacagttgtggccaacgcgggggtgaatacacaccttacctcccaaacttgggtggatggcggatggtaacccggtttcttcctctgttcacacttn

SEQ ID NO: 21231 - protein, 130 aa, Zea mays
  misc_feature: Ceres CLONE 1390257-F
  misc_feature: SWISSPROT Homolog: EC 1.6.5.3 NADH dehydrogenase (ubiquinone)
  misc_feature (22)..(22): Xaa is any aa, unknown, or other
  misc_feature (36)..(36): Xaa is any aa, unknown, or other
  misc_feature (37)..(37): Xaa is any aa, unknown, or other
MSKTAEFVVSKVDDLMNWARKXSICPMTFRLACCAXXMMHARASRYTSTRFGVIFRPSPRPVQLHDPSPARFTKKMASGPPERFMDQWPDPRGCFFNGDSCGQRGGEYTPYLPNLGGWRMVTRFLPLFTL

SEQ ID NO: 21232 - DNA, 578 bp, Zea mays
  misc_feature: Ceres CLONE 1390261-F
  misc_feature (205)..(205): n is a, c, t, g, unknown, or other
  misc_feature (231)..(231): n is a, c, t, g, unknown, or other
  misc_feature (273)..(273): n is a, c, t, g, unknown, or other
  misc_feature (288)..(288): n is a, c, t, g, unknown, or other
  misc_feature (289)..(289): n is a, c, t, g, unknown, or other
  misc_feature (332)..(332): n is a, c, t, g, unknown, or other
  misc_feature (345)..(345): n is a, c, t, g, unknown, or other
  misc_feature (346)..(346): n is a, c, t, g, unknown, or other
  misc_feature (378)..(378): n is a, c, t, g, unknown, or other
  misc_feature (379)..(379): n is a, c, t, g, unknown, or other
aaagctggagctccccgcggtggcggccgctctagaactagtggatcccccgggctgcaggaattcgcacgagaccattacctagaacatcctaatcgaaaatccaacgacccacactgagacgtcccctccccgctccgtcctctctcctctgccgccgagacgacgcgatggggcgggtccgccgcctttgccgcgctcgccngcttcgggtcgctcattacgcgcggngctttcgcgcgccaggtcgcgctccggtcctgtcaggcgcgnctactggcggtgccnntccggacctcgcgcctcgccgcttccggggggggggccgcgcnggccggggtggcnntcccactttcctcccgcccggccgcggacccnncccttttcccccgtgccccccccccccgcccccgggcccgcccgcgtcctccccccccccccctcgggggcgcgggggccgctcgcggggccgggggcctcttgggcgcggtggtcccgtggggggggggcccctcctcgggcggctcttggtttcgcccccgggcctccctctcctttgccgtcgctgcgtccccttg

SEQ ID NO: 21233 - DNA, 669 bp, Zea mays
  misc_feature: Ceres CLONE 1390264-F
  misc_feature: Encodes the peptide sequence at SEQ ID NO. 21234
  misc_feature (355)..(355): n is a, c, t, g, unknown, or other
  misc_feature (372)..(372): n is a, c, t, g, unknown, or other
  misc_feature (406)..(406): n is a, c, t, g, unknown, or other
  misc_feature (407)..(407): n is a, c, t, g, unknown, or other
  misc_feature (564)..(564): n is a, c, t, g, unknown, or other
tggagctccccgcggtggcggccgctctagaactagtggatcccccgggctgcaggaattcgcacgagaccattacctagaacatcctaatcgaaaagacgagaaaaccccacagcctgcacctcggggacgccggcgcggagggatggagtgccacgccctacagtgatttctcccccgctccgatccccggcgcatgaccgggtcggctggcctatgcatcgcagcaggagttgtcgtcgattgcccctgcctgccccagttaatcccgcccggtcgcaatccagtattagaggcgccgatctcctgccccgtcctgccctgtggattatcgacagcggcgccggataccacnggaagagaaggaagacnagggaaggggccgaaactaacttgcttgtgccgnngcaagggacgagatcgagggcagccgagccggtacccgaaactctaggcgagattggcaagtgcaggttcccacaatagaagataccccatggattccggggaggttctcaaaagaaaagacataaatctggtacaaatgttgacatcatcagtaanctacctgatgttattaaagacaaaattctctgctggttgcaaaaaaaagaagctggaagaacatgtcttcttgtaagggaaatgaagggaccatgggctttaatg

SEQ ID NO: 21234 - protein, 47 aa, Zea mays
  misc_feature: Ceres CLONE 1390264-F
  misc_feature (23)..(23): Xaa is any aa, unknown, or other
MDSGEVLKRKDINLVQMLTSSVXYLMLLKTKFSAGCKKKKLEEHVFL

SEQ ID NO: 21235 - DNA, 693 bp, Zea mays
  misc_feature: Ceres CLONE 1390268-F
  misc_feature: SWISSPROT Homolog: EC 2.7.6.1 Ribose-phosphate diphosphokinase
ggcggccgctctagtatagtggatcccccgggctgcaggaattcgcacgagaccattacctagaacatcctaatcgaaaaatgtagagactgcccctccccgcggcgtgatttttgggtaaggactccccagtctcggccgccgttaaagctcgcttgatggtggccgtccttaccgagaagcagaaggcgaagaatttcttacacctctcctattgctcaaaatgagagcagctcgtcctcatgatcgccgccggatcagaggacatcgtgctcctatccataaactgacggagttgcgatgacggaatctccaacctgttgatgaaggaggcgaacgagatccgtgcgcagagcgtgacgttcctggactgattctgctcgccgaccgtgatattctatgagattgctgacatcgtcgcgctgcgcaagtgattctgtgactgaatcactctcgtgctgtgttacttcgccatgagctgatacgagcgcgttgagcagttggacgatgtcagctacgcgatcaccctcgcgcgcatgctctcgatgataaccatggctcgagcagcagctaccggcgtcgtcatcgacgacatccacgcggtccatgagaggttgtacttcgcttacgacgtcatgtcatgatacgagactggaatccctgtcatgatgaagcagctgcgtcagctatagg

SEQ ID NO: 21236 - DNA, 779 bp, Zea mays
  misc_feature: Ceres CLONE 1390269-F
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
ttgttccccactctccctcccccnacnnaagannnaacgtgggccttattaaaaaatgtagctccccgcggtggcggccactctagaatagtggatcccccgggctgcaggaattcgcacgagaccattacctagaacatcctaatcgaaaatacctcctcaaggcacgttcaccacagtcctctctttccccggcaccaccaccaccacccaggctaacaggactggaccgagtgttgaacaacactgcagtgagcgacggcaggcatggtgagccctagaaatttgcacctggtgatggacccggcgtctctgggcgcgccttggcccgaccccgtccgccggagagatcccgccgaagctcctcgccggggtgggagagtacctctcctccgcccgcggggactttcaaaacggagggggacgaccatttcttgatgcacaaattcaagggggcggccggcccccccccctcccaaaacccaaaagtgggacggggtgcccccaaaccccccccgtgtagaaaccctctcgaaccatccaacaccccctccacctccccccccccggagttaaagcgttacccccccttccccggccccaatagaaaaataacgaagagcttaaatataccgcacaacccccccggtaacataaacgcgccggcggccaccgagaatggccagccccccgccccctacacccatgcccacccacccctctccccgcccccctcccatctacacctcaatgatcatcctcctacaataagcccagcg

SEQ ID NO: 21237 - DNA, 582 bp, Zea mays
  misc_feature: Ceres CLONE 1390270-F
  misc_feature (268)..(268): n is a, c, t, g, unknown, or other
  misc_feature (285)..(285): n is a, c, t, g, unknown, or other
  misc_feature (300)..(300): n is a, c, t, g, unknown, or other
  misc_feature (350)..(350): n is a, c, t, g, unknown, or other
tggagctccccgcggtggcggccgctctagaactagtggatcccccgggctgcaggaattcgcacgagaccattacctagaacatcctaatcaaaaaagcaccgtccacctccaccatctttcctcttcctcctcgcctccaccccttcccttccatctcctcccacccggcgactcctcttcctctctgccgcgccgatcgattggcccacccatcgatcgagcacggggaagaagattccagtccggagtggtttcaattcggtcnggttcgttgcccgtgtnggtgggcgctatggncgcgatggatgcctcggaagataagaacgccgtcttccgcaagcttcgcngcaaatcgaacaaacagatggggtttgattggcaccgccagaacccgaggggggggccggcactaggggggtttcctggataaggggtcggggggaaccaaaccccggggcccatttcctttggggggaaaaatttgggttttgggctccaaaaaattgaaaggggggctattgggggaaaaaccgggcggaaattttttttaaaaaagggggggcacaaaggggggaaaaa

SEQ ID NO: 21238 - DNA, 701 bp, Zea mays
  misc_feature: Ceres CLONE 1390271-F
  misc_feature: Encodes the peptide sequence at SEQ ID NO. 21239
  misc_feature (682)..(682): n is a, c, t, g, unknown, or other
ggagctcaccgcggtggcggccgctctataactagtggatcccccgggctgcaggaattcgcacgagaccattacctagaacatcctaatcgaaaacttcctcgtcgcccttttccttccgcaacacacacacaccggcacgatcgagtgcacgaccgcgggcgcagcagccaccgatccggcggcatctccgccctgctcgcgcccgcgcccgccggagaagaagagccttccatgagattgttgatgtcgcgccggcgcggcgccggcggcggtctgtgcatcaggaagaaggcccgcggattcatgtgcgggtgcggcggcaccaaggccatctccatctccgacggctccgacaagtcaccaacggccacgccgcagaccgccgcgtccaccactccccttaccggcatgtcggtcaccaccaccacccaccacacgaccaagccgacgagaggaggaggaggaggagggtacaggccggcggcggcaccgtcaaccacgggagctccctccctgttctcgtcctcgtccttgtacgcggacacaccgacgacggccccagcagcatgtagagcacgcccagcctgtcggcgctcctgccccagctcggcgagctgaagcgcaacgtccgcttcctgcattccgcgggggcccgaaacgaagaagaagcccaacccgnaaagctgcagggaagcggg

SEQ ID NO: 21239 - protein, 128 aa, Zea mays
  misc_feature: Ceres CLONE 1390271-F
MRLLMSRRRGAGGGLCIRKKARGFMCGCGGTKAISISDGSDKSPTATPQTAASTTPLTGMSVTTTTHHTTKPTRGGGGGGYRPAAAPSTTGAPSLFSSSSLYADTPTTAPAACRARPACRRSCPSSAS

SEQ ID NO: 21240 - DNA, 647 bp, Zea mays
  misc_feature: Ceres CLONE 1390276-F
  misc_feature: Encodes the peptide sequence at SEQ ID NO. 21241
  misc_feature (209)..(209): n is a, c, t, g, unknown, or other
  misc_feature (277)..(277): n is a, c, t, g, unknown, or other
  misc_feature (368)..(368): n is a, c, t, g, unknown, or other
  misc_feature (411)..(411): n is a, c, t, g, unknown, or other
  misc_feature (475)..(475): n is a, c, t, g, unknown, or other
ggagctccccgcggtggcggccgctctagaactagtggatcccccgggctgcaggaattcgcacgagaccattacctagaacatcctaatcgaaaagttcctttcttcccactacaacatctgtcaccgtgaaatctcggctacctccttctgacttctggtacctcgccgccggggacccaactccgatccccaccccaccataccanagccaccgcggctgcggctgcggcttccgcatcatcaatggtgctgatcactctcgtccgcgactacntcgaccgcatgctccacgacatccctgacatgaaggtcctcgtcctcgaccccccaaccgttgggatggtgagcgtggtgtacagccagtncgatctggctgcggaagggagtcttcctcgtcgagaccatggnacacgcctccagctccagggagccatggcgaccctcaaggccgtctacttcctcgaccctccgntaaaacgtcagaaagctccgcaggcacctcgccatggcgcgctttcgcgagtaccactattctctcagggaaaattgaagggcccgagatccaatacttgctgactcgaagaaaaaggaggttgtgcaaaaagttcggagttctatggttatttttgggccattgacccata

SEQ ID NO: 21241 - protein, 110 aa, Zea mays
  misc_feature: Ceres CLONE 1390276-F
  misc_feature (11)..(11): Xaa is any aa, unknown, or other
  misc_feature (41)..(41): Xaa is any aa, unknown, or other
  misc_feature (77)..(77): Xaa is any aa, unknown, or other
MVLITLVRDYXDRMLHDIPDMKVLVLDPPTVGMVSVVYSQXDLAAEGSLPRRDHGTRLQLQGAMATLKAVYFLDPPXKRQKAPQAPRHGALSRVPLFSQGKLKGPRSNTC

SEQ ID NO: 21242 - DNA, 676 bp, Zea mays
  misc_feature: Ceres CLONE 1390279-F
  misc_feature: Encodes the peptide sequence at SEQ ID NO. 21243
gctctagaactagtggatcccccgggctgcaggaattcgcacgagaccattacctagaacatcctaatcgaaaaatctagcggcagagaccaaagtgcccatcgcaccatgtcggccgccgaaaccgctgtttctccgacgacgacgccgcagccgcagctgcaatcggatccgaacgccgccgccgacgcggccagttccaattctctctgggtggccgacgagacgcaaaccctaaccgaggtcctgctccaaccccaaccaaaccacctgtcgcctcctccttctggtgaaggggacgacgggatcactgcctccggtgctcctgttgggtggggacgccggggaatctgcttctgctgcggcggcggctaacgcgacgatagaagagcgggggggaggggggccggggtccccaaagggaagacgcggggggttgaaaaccccccggggaaaaagtccgggggagcgggaaggggggcgcggatcgcgcgcgggccatcccggggccgttcgcggcaaagtgctggccccctggcgttgaatgaaacctattacaaccccctaagggaagggaggagggcttgtccaaagaatagcacgaggcgaaataatggggggcggcgccccgcttggtcgcgtggcaaaagggcgagcacttcccctcgcgcggtcg

SEQ ID NO: 21243 - protein, 88 aa, Zea mays
  misc_feature: Ceres CLONE 1390279-F
MSAAETAVSPTTTPQPQLQSDPNAAADAASSNSLWVADETQTLTEVLLQPQPNHLSPPPSGEGDDGITASGAPVGWGRRGICFCCGGG

SEQ ID NO: 21244 - DNA, 721 bp, Zea mays
  misc_feature: Ceres CLONE 1390281-F
  misc_feature (346)..(346): n is a, c, t, g, unknown, or other
  misc_feature (352)..(352): n is a, c, t, g, unknown, or other
  misc_feature (624)..(624): n is a, c, t, g, unknown, or other
  misc_feature (692)..(692): n is a, c, t, g, unknown, or other
tcaccgcggtggcggccgctctataactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacnaatcanaataataaaaaaaataataaaaactagtactacgcaatccagctttctccttataaagaaatcaatggataaatttaaaaaaagcagagcatcaaaccaagaagaaaaactgatgtcacgaacttgacagttgacttttcgcgcaaacaaacaaacaaacactacgtactgtgctctgcttatggatacatacatgcatactagtagctcatatatgcgtacaaatgcgccccgcaggcccaccttcgtgggcatctgggagaagcgtgcgntggagcagtactcgccgatcccgtacgtggcgacgctgctgaactgcatgatgtgggtgctgtacggnctgccgctggtgcaccgcacagcatgctg

SEQ ID NO: 21245 - DNA, 732 bp, Zea mays
  misc_feature: Ceres CLONE 1390283-F
  misc_feature: Encodes the peptide sequence at SEQ ID NO. 21246
  misc_feature (368)..(368): n is a, c, t, g, unknown, or other
  misc_feature (532)..(532): n is a, c, t, g, unknown, or other
  misc_feature (667)..(667): n is a, c, t, g, unknown, or other
  misc_feature (694)..(694): n is a, c, t, g, unknown, or other
ggagctccccgcggtggcggccgctctagaactagtggatcccccgggctgcaggaattcgcacgagaccattacctagaacatcctaatcgaaaaaaccctagcgctcccgacgcgccgcggagcgatggcgatggacgcggagcggcggcaggcggagctgatcgcgcagttctccgctcaggcggcggcgctttcgtccgcgccccagctcgccgcgctggtgcttgaggccacctcccacccggccctcttcgccttctccgagctcctcaccctcccggccctctccaagctcactggcacgcagtacgcgtcgtcactggacttgctccggctcttcgcctacggtaccctgaatgactacnagagtaattctggattccttccagcactgttgcctgaccaggtccgaaagctaaagcagctcagcgtgctaactctggcagagtcaactaagatactaccatatgatcagctcatgcaagaagtagacgtttcaaatgtaagagaactcgaagatttcctaatncatgagtgcatgtattcgggtatcgttagagggcaactggatcagctgagaaggtgctttgaggtactatttgcagctggaagagatcttacacctgatcagctaaagacatgatagagactttgtctggatggntgggacatcagatagactggtgcatcnaattcaggagaaaatcaagtgggctgacacaatgagtg

SEQ ID NO: 21246 - protein, 172 aa, Zea mays
  misc_feature: Ceres CLONE 1390283-F
  misc_feature (63)..(159): Pfam Name: PCI Pfam Description: PCI domain
  misc_feature (81)..(81): Xaa is any aa, unknown, or other
  misc_feature (135)..(135): Xaa is any aa, unknown, or other
MAMDAERRQAELIAQFSAQAAALSSAPQLAALVLEATSHPALFAFSELLTLPALSKLTGTQYASSLDLLRLFAYGTLNDYXSNSGFLPALLPDQVRKLKQLSVLTLAESTKILPYDQLMQEVDVSNVRELEDFLXHECMYSGIVRGQLDQLRRCFEVLFAAGRDLTPDQLKT

SEQ ID NO: 21247 - DNA, 720 bp, Zea mays
  misc_feature: Ceres CLONE 1390284-F
  misc_feature: Encodes the peptide sequence at SEQ ID NO. 21248
  misc_feature (331)..(331): n is a, c, t, g, unknown, or other
cgctctttactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcnggcggacggtgttgtccgttccggcgctctgcccgccaagctgttgctgtgccgccagctgcttgcttccctacgggcggctccagtccgcgaacggagaagtgcaggtgctttgcctgccgccagaatcttccaccgcttgccgaggggtcaggatcttccgtcgccaagggccgcgccctcccccatcctccagctcggtcggcctccaccagaagccggcgaaagggcggcccttgtaaattggccagggccgcgttccccctccggcggccgcgggttcctataacggggccccccttgaaaccgcccgcccgggcccaaacggttgaagttttcccgttgggaagaagttgcaacttcccaaccggggccggggggagaggagg

SEQ ID NO: 21248 - protein, 114 aa, Zea mays
  misc_feature: Ceres CLONE 1390284-F
  misc_feature (19)..(19): Xaa is any aa, unknown, or other
MLLTSCRQGRGMASLSCAXADGVVRSGALPAKLLLCRQLLASLRAAPVRERRSAGALPAARIFHRLPRGQDLPSPRAAPSPILQLGRPPPEAGERAALVNWPGPRSPSGGRGFL

SEQ ID NO: 21249 - DNA, 629 bp, Zea mays
  misc_feature: Ceres CLONE 1390287-F
  misc_feature: Encodes the peptide sequence at SEQ ID NO. 21250
  misc_feature (510)..(510): n is a, c, t, g, unknown, or other
tccccgcggtggcggccgctctagaactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaaccggctcgttcaaggaggaacgcaacctggtggaaaacctgccccaaccggagacaaaggcgctccacacgccccggccggtgatcgctgctgcccccccggccgtgtggttatatttccctccccctccgcccccgccgccgcccaaggcacggaaggagtgacggtncgaggccccgcccggccggccttcgggcccgttcgagcgcgagactgggcgggtccgggcgcccaggggcgatccggtgtcggtgaggtgtccgcgcaactctacctcgcgatagaccg

SEQ ID NO: 21250 - protein, 157 aa, Zea mays
  misc_feature: Ceres CLONE 1390287-F
MAEETQPEAAAAAAPAAAEVVVTEAAPAEAEVPAAAEAEAEAKDEKKGDEAELTADDAGVGNRLVQGGTQPGGKPAPTGDKGAPHAPAGDRCCPPGRVVIFPSPSAPAAAQGTEGVTVRGPARPAFGPVRARDWAGPGAQGRSGVGEVSAQLYLAID

SEQ ID NO: 21251 - DNA, 824 bp, Zea mays
  misc_feature: Ceres CLONE 1390288-F
  misc_feature: Encodes the peptide sequence at SEQ ID NO. 21252
  misc_feature (1)..(1): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (34)..(34): n is a, c, t, g, unknown, or other
  misc_feature (38)..(38): n is a, c, t, g, unknown, or other
  misc_feature (40)..(40): n is a, c, t, g, unknown, or other
ntttttttccccccccnnnnnccnnnnncccccnattntntgtgatcccccacacaaaagtggaactccccgcggtggcggccgctctataatagtggatcccccgggctgcaggaattcgcacgagaccattacctagaacatcctaaaaaaaacataataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcgccgctggcgccccagcgtgtcgtactacgactacctcatcggggggccggcggcacggcccgggtgccccgttgggcccgccaggctggccggagcggttttccgcgtgcctggctgctgggaaccggggcccccccccccctaacaaagaataaccccggcttccgggtaacaatggacccccgtttttcgagggaaaatgtctttgttcgggaacaacccttttccccgggtgaccccccccccgccccgaaagcggccttttcgccgcgcctccaacagtcacactctcctctcctataatattcctcgcaaccccccagaagaccacacacgacaccgccgcggcggatgtgatggaacgcataaccccccgcgtattaccaccacccccccacccctccacgtctatctcaccaaacccgtgcttgctgccattgttttaataacgacgaccatgtcgtggcgccgctcctcaccaccgcccacctcaacatatatatt

SEQ ID NO: 21252 - protein, 140 aa, Zea mays
  misc_feature: Ceres CLONE 1390288-F
MSGRSRHFTMSTLLATSFFFVLLCSSLQVRGVNYTFVKDAPLAPQRVVLRLPHRGAGGTARVPRWARQAGRSGFPRAWLLGTGAPPPLTKNNPGFRVTMDPRFSRENVFVREQPFSPGDPPPAPKAAFSPRLQQSHSPLL

SEQ ID NO: 21253 - DNA, 736 bp, Zea mays
  misc_feature: Ceres CLONE 1390291-R
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (26)..(26): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (48)..(48): n is a, c, t, g, unknown, or other
gtttttttttctttttttnnnaaccnaccttacacnnttngtgttttnttttttacaaatgggtacgggccccccctcgaggtcgacggtatcgataagcttttttttttttttttttgaaaaaaacgagacaataattaacaaaagaggttatgcttgcgcatccccagtcagtttcgcaacagctttgtccatgcaaagacagctctataactacagcaccgggaccagtgcacatgactcgaatgggtttgaatgtccagaggtgagtaggttccatccatacatatgttttaaataaggtaggtttgttcccgtttcagtgggggagcaaatgagcatcccgaacaggcaagaactttttcctgcctgaatgcaatacacgttgaagcaagctccggtatgtaaagctcagaggtggggcaaaagacctgtacagcttcggatcctcgaatgttgttggttgcagatggttactccagtcaagaatggggaacgaagacaccgaggatggcctaggacgcctctctctcagcgctcctttcaccagagggtatttgctgggaatcagagtgggcaatcctcctagaccttccggaagccacctgtttcaaggggggaatggccttcctcggaaatggccaaaccggggtaaatttttgggggccccacaaatatgttggcccccccaaaaaaaaataaggggggggggatccccccacaaatgggggggaga

SEQ ID NO: 21254 - DNA, 665 bp, Zea mays
  misc_feature: Ceres CLONE 1390293-F
  misc_feature: Encodes the peptide sequence at SEQ ID NO. 21255
  misc_feature (454)..(454): n is a, c, t, g, unknown, or other
  misc_feature (480)..(480): n is a, c, t, g, unknown, or other
  misc_feature (660)..(660): n is a, c, t, g, unknown, or other
aaagctggagctccccgcggtggcggccgctctataatagtggatcccccgggctgcaggaattcgcacgagaccattacctagaacatcctaatcgaaaaaggtctaggtggtctccaagctttccgcctttccacgccaccattctccccacccgcgcgcctcagcaatccccatccagcatcgccgtttcgccgcggcaccgacacctcgccggccatgggcgcgtcctcctcgactggcaacccgtccccagaggcgcacgagcagcgggagcaggagactctcgcctccgccgccctctccctcccgctcctccgcgccgccttctcccgctccgccgcccaacgcgctgccggatgccctcgcgccgccgcccgcctcctttcgtctggccggatccccggcgccgccgccgccgcacttcacggcatcctcgggggctcggccccgncctcgccctcccctcttcggcccggngttggcgcggcgccgcgccggcgctccgggtggctcccttttttcttgggggtcttcccccgctcgtcttcctgctctgtcctccccctccgtccgcccgccctgccgggggccccccctgccggtcctcgggcgtccggtctcgggggcgccccgccgcctcctcgccccccccccggnccccc

SEQ ID NO: 21255 - protein, 148 aa, Zea mays
  misc_feature: Ceres CLONE 1390293-F
  misc_feature (79)..(79): Xaa is any aa, unknown, or other
MGASSSTGNPSPEAHEQREQETLASAALSLPLLRAAFSRSAAQRAAGCPRAAARLLSSGRIPGAAAAALHGILGGSAPXSPSPLRPGVGAAPRRRSGWLPFFLGVFPRSSSCSVLPLRPPALPGAPPAGPRASGLGGAPPPPRPPPGP

SEQ ID NO: 21256 - DNA, 680 bp, Zea mays
  misc_feature: Ceres CLONE 1390294-F
  misc_feature: Encodes the peptide sequence at SEQ ID NO. 21257
  misc_feature (401)..(401): n is a, c, t, g, unknown, or other
  misc_feature (416)..(416): n is a, c, t, g, unknown, or other
  misc_feature (461)..(461): n is a, c, t, g, unknown, or other
  misc_feature (516)..(516): n is a, c, t, g, unknown, or other
  misc_feature (531)..(531): n is a, c, t, g, unknown, or other
aagctggagctccccgcggtggcggccgctctagaactagtggatcccccgggctgcaggaattcgcacgagaccattacctagaacatcctaatcgaaaaaaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaaaagcatccgccgcgtcgcttcatcctgaagcacctctcgatgacgaggcttttacccggncggttcctcagcagncccgcagctgtcgctcaaggggctcccgctgctctcttcctgccntccctccgcgccgctctccaccgccgaagggacctggatggacgagtacctctcnaaggccaagcaaggngctcgggtacccgctcgcgccctcggagacgctcgggcgaaggcgatgactggcccgcgcgtcatttcgatgtggtgttctaccctcgcgttcaagatcctggacccctctagggagcgcacgcggaaggggcacggaaggaacggccc

SEQ ID NO: 21257 - protein, 76 aa, Zea mays
  misc_feature: Ceres CLONE 1390294-F
MGPPAMAFQALTLTPLPFSLHSSSRRVRVLAVAADQTPPPAPPSEPANSPSRLLRELAQRKKAVSPKKSIRRVASS

SEQ ID NO: 21258 - DNA, 642 bp, Zea mays
  misc_feature: Ceres CLONE 1390297-F
  misc_feature: Encodes the peptide sequence at SEQ ID NO. 21259
  misc_feature (340)..(340): n is a, c, t, g, unknown, or other
  misc_feature (384)..(384): n is a, c, t, g, unknown, or other
  misc_feature (391)..(391): n is a, c, t, g, unknown, or other
  misc_feature (439)..(439): n is a, c, t, g, unknown, or other
  misc_feature (474)..(474): n is a, c, t, g, unknown, or other
ggagctccccgcggtggcggccgctctagaactagtggatcccccgggctgcaggaattcgcacgagaccattacctagaacatcctaatcgaaaagatccgccactacgccacaaaatcctctcctaactccggagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctggtccaaggaggtgcgccggatctcccgcggcttccgcctcaccgtcgngctccgtcgccgcttcgcggggcgggacgtctccgccttcctcngcttcgngctacccgcgtcctccgaagcctacggacgctcactggcctgtgcccnaggaaatgatactgagatggatggtgatgctgcanctccacaactcagattcaatcaacatggtctccctgaattggaaatattgctacttgctcgactgattttcctattgacataaaaatatgatggggtaggcatgcgcagtgtgacattgtcgctgaaattcaaccgggaattggtgttgtttggcatcagaatgactt

SEQ ID NO: 21259 - protein, 31 aa, Zea mays
  misc_feature: Ceres CLONE 1390297-F
  misc_feature (10)..(10): Xaa is any aa, unknown, or other
MILRWMVMLXLHNSDSINMVSLNWKYCYLLD

SEQ ID NO: 21260 - DNA, 677 bp, Zea mays
  misc_feature: Ceres CLONE 1390298-F
  misc_feature: Encodes the peptide sequence at SEQ ID NO. 21261
  misc_feature (299)..(299): n is a, c, t, g, unknown, or other
  misc_feature (509)..(509): n is a, c, t, g, unknown, or other
  misc_feature (548)..(548): n is a, c, t, g, unknown, or other
tccccgcggtggcggccgctctagaactagtggatcccccgggctgcaggaattcgcacgagaccattacctagaacatcctaatcgaaaaggggcagagctggcaagtggcaaggctgcgcagccgcagagggactttttgtgtaaatgcggtgggaagggcgctgcaccctgcagcagaggtgtgctctactgacagagtttgaaactctcagaggaggcgaggcagaacccgcatcgcgaccgcgacccgcaggtgacatacatacggtgcgagcgccggaagccggaagcaccgntgacgaagccttccgtgtcatcactcatcaggatctcagggtttttgtttcgtttcgcgggcgttgggatccatccatggcgaggagatgctcatcgacggggaggtggcggccgtcgcggatggtgggcactatgactacgatctcttcgtcatcggggcgggcagcggggggggttcggggttctcgcaccgccgcctccttcggagntaaggttgcgatttgggagctcccattcaccccatcagntcagaggggctaggaggacatggtggggacttgccgggaaccgtggttgccaacataaaaaaaacctcggggagggggcatcatccctggggaaaaaatggaggaatccaaaaaattttggggggggaa

SEQ ID NO: 21261 - protein, 64 aa, Zea mays
  misc_feature: Ceres CLONE 1390298-F
PRGGGRSRTSGSPGLQEFARDHYLEHPNRKGAELASGKAAQPQRDFLCKCGGKGAAPCSRGVLY

SEQ ID NO: 21262 - DNA, 643 bp, Zea mays
  misc_feature: Ceres CLONE 1390299-F
  misc_feature: Encodes the peptide sequence at SEQ ID NO. 21263
  misc_feature (339)..(339): n is a, c, t, g, unknown, or other
  misc_feature (456)..(456): n is a, c, t, g, unknown, or other
gctctagaactagtggatcccccgggctgcaggaattcgcacgagaccattacctagaacatcctaatcgaaaaaagatgaatgctacgtaggtagacagtgttcttgtggtgacgtgacctccacagagtgcagagatgggagaagctgaagaagcgccaggagacagcaatggtgaggcactggagctcctcatgtccatggcgtcctcttcgctggcctgctctgtctcgcagttcccagccaagtggcagtccatcaaggacaagctccagctgctctgctgcagcctcaattcactctgcggcggcggcggtgaccacgacgacgacgacgacnaggagcatcctggtgttgctgagcttctggcgctggcctcagcaaccgtgaggagcatcccagtcgttgcttctcagtgcagcgacggtcataaaagggtgaaaggcttcgtctggngaacgacctggaccacctgagctggcagctcgatgcgcacatggaacagttcagggagatggccgtctcgtccggggcgcccgtcccgtccaaggccattggcccccgtccggcccagcgccgaaggcagggtggggtgaaaaggcctccaacttcaaggtttccttttccaagaacaggaacgggg

SEQ ID NO: 21263 - protein, 112 aa, Zea mays
  misc_feature: Ceres CLONE 1390299-F
  misc_feature (68)..(68): Xaa is any aa, unknown, or other
  misc_feature (107)..(107): Xaa is any aa, unknown, or other
MGEAEEAPGDSNGEALELLMSMASSSLACSVSQFPAKWQSIKDKLQLLCCSLNSLCGGGGDHDDDDDXEHPGVAELLALASATVRSIPVVASQCSDGHKRVKGFVWXTTWTT

SEQ ID NO: 21264 - DNA, 689 bp, Zea mays
  misc_feature: Ceres CLONE 1390301-F
  misc_feature: Encodes the peptide sequence at SEQ ID NO. 21265
  misc_feature (689)..(689): n is a, c, t, g, unknown, or other
tggagctccccgcggtggcggccgctctagaactagtggatcccccgggctgcaggaattcgcacgagaccattacctagaacatcctaaaaaaagaacaaccaccgcctctctcccccgtctatctcttcttggagcctggagaagaggaaggatcagggaacgggggaagaggttgctgccacagctcaggtctcaagtttggattcagacaagtagacaaacaccagttggttaagatggcagctggtttccagatcggtgtgatcgggtcacttgcactctctgttgcatcttcagtttccattgtcctctgcaacaaagctctcatcagcacacttggttttccattcgctacaacattaacaagctggcatctgatggtgaccttctgcaccctccatgtggcacagcgcttacgtttcttcgagcccaaggcaattgatggacagaagtcatacctctttgggttgctgaatggcacgtcaattggtcttctcaatcctgagtttaggattccactccattggattctaccagatgacaaaatttggcgatcatacctttcactggggttattgaagaatatctccttgaagaaaagatccagaagaacaatcaagtttcagatatttccaaataaacctcttgcattcaactggttggattaaatccgagaggatcaggcn

SEQ ID NO: 21265 - protein, 143 aa, Zea mays
  misc_feature: Ceres CLONE 1390301-F
MAAGFQIGVIGSLALSVASSVSIVLCNKALISTLGFPFATTLTSWHLMVTFCTLHVAQRLRFFEPKAIDGQKSYLFGLLNGTSIGLLNPEFRIPLHWILPDDKIWRSYLSLGLLKNISLKKRSRRTIKFQIFPNKPLAFNWLD

SEQ ID NO: 21266 - DNA, 631 bp, Zea mays
  misc_feature: Ceres CLONE 1390304-F
  misc_feature: Encodes the peptide sequence at SEQ ID NO. 21267
  misc_feature (273)..(273): n is a, c, t, g, unknown, or other
  misc_feature (296)..(296): n is a, c, t, g, unknown, or other
  misc_feature (335)..(335): n is a, c, t, g, unknown, or other
aaagtggagctccccgcggtggcggccgctctagaactagtggatcccccgggctgcaggaattcgcacgagaccattacctagaacatcctaatcgaaaactctttcccaccgccttcttccactactcttcaccctcccctcctccccatcgcgaactcacaagagaaccaagtagacgagggagaaggagatggcgaagaagaaggagaaggcggtgaacgtgtcgggcaagccgcggcactcgaacgacgtcaaccgccccatgacagnaaaaggcgcggcggcggcgccgntggcgggagcccgtccgcggctacggtgcggcggctcangatggtacagacgcggcccaagagggacgccggcgggaaggtgctcaggaacgattcccaggctaaaggagttccccaaacccgaatcgagcccgaacggcgggggggtccgaaaaaacccggggttggggggccccgcccacgtttggaaaaggtccccggaaggaaaaccccagaggggggttttttccaaacaactttcgggggtgctccctggaaaaaaaaggaaagggtggcactttatcgcccccgggggagaattcttcaaaaggggcggggggaagggccctttctcg

SEQ ID NO: 21267 - protein, 98 aa, Zea mays
  misc_feature: Ceres CLONE 1390304-F
MVQTRPKRDAGGKVLRNDSQAKGVPQTRIEPERRGGPKKPGVGGPRPRLEKVPGRKTPEGGFFQTTFGGAPWKKKERVALYRPRGRILQKGRGEGPFL

SEQ ID NO: 21268 - DNA, 682 bp, Zea mays
  misc_feature: Ceres CLONE 1390305-F
  misc_feature (333)..(333): n is a, c, t, g, unknown, or other
  misc_feature (342)..(342): n is a, c, t, g, unknown, or other
  misc_feature (365)..(365): n is a, c, t, g, unknown, or other
  misc_feature (468)..(468): n is a, c, t, g, unknown, or other
ggagctccccgcggtggcggccgctctagaactagtggatcccccgggctgcaggaattcgcacgagaccattacctagaacatcctaatcgaaaacttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcgaagtagggtgtaaagttttgtatatgatgccaggcatggatgaaccccttcttgggcatggtcttaangacagcggnaaaagagagagcctggtagtggncgaggtcagaaaacagatgtaccttgctgggccactcatcgctgcatgaatcctacagaacattgtccagatgatatctatcatggttggcgggcaccttggnggagtttgccctctccaggggctccatcgccacctcctttggagggggtactggcttcagtttattggcctggcatggcgagcaccttgaacaccctgggggggcaatcgttcggggaaaagaagactattttcttggatccaacaagaaagaggcaacccttgggtcctctaagccagcctgggggttgcaaatatctggtcctaactgggaa

SEQ ID NO: 21269 - DNA, 668 bp, Zea mays
  misc_feature: Ceres CLONE 1390307-F
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (357)..(357): n is a, c, t, g, unknown, or other
ggagctccccgcggtggcggccgctctagaactagtggatcccccgggctgcaggaattcgcacgagaccattacctagaacatcctaatcgaaaagttgtgttcttccacgttctttgccaaattccggcttccttttccatgcccaagcatctcgttatccaagaccgtgacaagcaccacggcaccagtcctcgagaagtcaaccaaacgaaccaaaggcagagctgaacgcgaaagggagggagctcggatcggatgcggcggcgcgcggaggtggccgtggtgggcgcggggcgcgcgnnnctggtggccgcgcgcgagctgctccgcgagggcctcacgtgtccgtctccnaaaagcagggcggggtgggggccaccctggcgaaagcccgcgcgcggacggggaaccggttgtcagcgcaccggcgggcccccgcgactggcaaataacccggaagggccgcttgtcttgcaactggtgggggagggcggtggttcttctgaccgtccccgaagcgcggtgagaatacacctcccacaccaggtccttcctcgcgcgccccgccgcgcacatcccttcccccgggagcctggatgccgtctccccgaccgaatcaatctctccctccgggaagggggacgtcgctccctcctccttgtgcc

SEQ ID NO: 21270 - DNA, 677 bp, Zea mays
  misc_feature: Ceres CLONE 1390308-F
  misc_feature (505)..(505): n is a, c, t, g, unknown, or other
  misc_feature (539)..(539): n is a, c, t, g, unknown, or other
  misc_feature (540)..(540): n is a, c, t, g, unknown, or other
aaagctggagctccccgcggtggcggccgctctataactagtggatcccccgggctgcaggaattcgcacgagaccattacctagaacatcctaatcgaaaaaccacccgcagcgagccttgctcgtcaccaactcaccatcacgcgcgagcgcgacgcttcagctctctctcgttgaagagctgcatctccagccagtgcctagcccgtcgagggaccggtcgccttggcggactcccgctggtgctcctccacgcccatctctctcttttcctcgctgcagccacggatcttggtagcagggacgccaccgcatttccagaatccaaacggaattttacaggaatcgcgctggaatttcacaggaatcagttcaatttcacggaacaaacgcaggagcaaggaaattttgtcacgtccccctcatttgtttccttcggcgacgactaggcgagtgctgcccgctcttcacgaggtttccacctggcgacgaaatccctccagntgatctttctgctggaaaatcacgttgacggtgnnaagtaggggttttatcaatcggaggctcatctcagaaagaaaattctttcatgatccctttgaacccggaggcaaggctggccagggcttgggatggaaaactttgatgcaaggccgaagccctcgaaatggtggaa

SEQ ID NO: 21271 - DNA, 670 bp, Zea mays
  misc_feature: Ceres CLONE 1390310-F
  misc_feature: Encodes the peptide sequence at SEQ ID NO. 21272
  misc_feature (211)..(211): n is a, c, t, g, unknown, or other
  misc_feature (216)..(216): n is a, c, t, g, unknown, or other
  misc_feature (318)..(318): n is a, c, t, g, unknown, or other
  misc_feature (350)..(350): n is a, c, t, g, unknown, or other
tggagctccccgcggtggcggccgctctagaactagtggatcccccgggctgcaggaattcgcacgagaccattacctagaacatcctaatcgaaaaatcaagttttgtagtgttgttagtgtttctaccgtatgtctgatttgtactttattagtacttaagtctgtctttgagaatataagatactagtctggtcactgaagaatgtgnccttnaacactagtttgatttcaggggtgttatgttctttatcgcctcttctggaaaccagagagaaaactgtgcgctccagcccagaaaaatggatagaaagtggnactcgcctactactccccgttcttcacgtgancaccaagaggcgaatgagggagctattaccccatttaaatagaaatctctaggatctgctctgcatggaccgattgagctgccaaattctgctgaaacccctgctgggccaaggaaaatggcccctggcggacagaaatggaaaatttgggtgctacgggcccccggtttgttcccatttccttttccgggaatggggggcgggagaaaataaatttgggccttttagggggtggttacgccccttttgttaaccccccaaaatggaaatggcccccggcccaaattttttttggggggtttccccccccttttcccccg

SEQ ID NO: 21272 - protein, 29 aa, Zea mays
  misc_feature: Ceres CLONE 1390310-F
  misc_feature (6)..(6): Xaa is any aa, unknown, or other
  misc_feature (16)..(16): Xaa is any aa, unknown, or other
MDRKWXSPTTPRSSRXHQEANEGAITPFK

SEQ ID NO: 21273 - DNA, 674 bp, Zea mays
  misc_feature: Ceres CLONE 1390313-F
  misc_feature: Translation starting site: 462
  misc_feature (415)..(415): n is a, c, t, g, unknown, or other
  misc_feature (431)..(431): n is a, c, t, g, unknown, or other
  misc_feature (433)..(433): n is a, c, t, g, unknown, or other
  misc_feature (496)..(496): n is a, c, t, g, unknown, or other
  misc_feature (513)..(513): n is a, c, t, g, unknown, or other
  misc_feature (535)..(535): n is a, c, t, g, unknown, or other
  misc_feature (565)..(565): n is a, c, t, g, unknown, or other
  misc_feature (566)..(566): n is a, c, t, g, unknown, or other
  misc_feature (594)..(594): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (618)..(618): n is a, c, t, g, unknown, or other
  misc_feature (619)..(619): n is a, c, t, g, unknown, or other
  misc_feature (625)..(625): n is a, c, t, g, unknown, or other
aagctggagctccccgcggtggcggccgctctagaactagtggatcccccgggctgcaggaattcgcacgagaccattacctagaacatcctaatcgaaaaaaaaaaaaataaaaatcgcagccaaaacacgcttctcccttcccatcttttcctttcccctcctccctcctcggctcgtctctgttcccctttccctcctgcgcacccgtcttctcctccccgcgtcaaaccccagcacaaaaagctaccgcccgccgcctcctcgttcctctcccgaatcagccgtcgcggtgcctaatccggccgatcccccctccgatccgcgggtgcccgccgcagaggcggcgcctccggccctcccccgatgtatagcaacttcaaggagcaggcgatcgagtacgtcaaagcagcgntccaggaggacatgcngncactaacgtcaaggcgttccctctctacatgaacgcgctcgagtacttcaaaacccacctcangtacgagaagaacccanggatcaggagccatcaccgccnagttcaccgagtactccgccgccgcgagannaatccggcggtcctcgatggggggcggngcagggctggnnnccaacgggggnnaaccanctgcccccacgcgccccaagacaagggcaaggacggggacgaaggaaag

SEQ ID NO: 21274 - DNA, 702 bp, Zea mays
  misc_feature: Ceres CLONE 1390315-F
  misc_feature: Encodes the peptide sequence at SEQ ID NO. 21275
  misc_feature (326)..(326): n is a, c, t, g, unknown, or other
  misc_feature (352)..(352): n is a, c, t, g, unknown, or other
  misc_feature (384)..(384): n is a, c, t, g, unknown, or other
  misc_feature (405)..(405): n is a, c, t, g, unknown, or other
  misc_feature (418)..(418): n is a, c, t, g, unknown, or other
  misc_feature (429)..(429): n is a, c, t, g, unknown, or other
  misc_feature (455)..(455): n is a, c, t, g, unknown, or other
  misc_feature (478)..(478): n is a, c, t, g, unknown, or other
  misc_feature (498)..(498): n is a, c, t, g, unknown, or other
  misc_feature (681)..(681): n is a, c, t, g, unknown, or other
  misc_feature (682)..(682): n is a, c, t, g, unknown, or other
tccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtgggaggagacngggcttcgtggtggctccggcagcgnccgcaaggtggaccactacttcgccaaggccnggccgccacgtgtcctagggncgccgagggtggntcggcggtggnccgaacaagggccgggctcaagaagnatcacggggcgtcaagggccaanggagatggctggctgtgggntcacccctccacgagatcctgcggtcgacggacccgccccactgggaaagcctccactgcaagggccatcgggcggcctggtcccgcagcttcccccgtcgagggccttcgagggccgaggagccggcgccccccggaagccgggcggtgtccttccccagggacgcgaagggaggaagaagnntttttgctgcctctctttcg

SEQ ID NO: 21275 - protein, 179 aa, Zea mays
  misc_feature: Ceres CLONE 1390315-F
  misc_feature (55)..(55): Xaa is any aa, unknown, or other
  misc_feature (74)..(74): Xaa is any aa, unknown, or other
  misc_feature (81)..(81): Xaa is any aa, unknown, or other
  misc_feature (89)..(89): Xaa is any aa, unknown, or other
  misc_feature (98)..(98): Xaa is any aa, unknown, or other
  misc_feature (105)..(105): Xaa is any aa, unknown, or other
  misc_feature (112)..(112): Xaa is any aa, unknown, or other
  misc_feature (173)..(173): Xaa is any aa, unknown, or other
MTLTIPDEVRAKAEVYVGDAAGQEKTRLLLQETGLPSGLLPLRDIIECGYVGGDXASWWLRQRPQGGPLLRQGXAATCPRXAEGGSAVXRTRAGLKKXHGASRAXGDGWLWXHPSTRSCGRRTRPTGKASTARAIGRPGPAASPVEGLRGPRSRRPPEAGRCPSPGTRREEEXFLLPLF

SEQ ID NO: 21276 - DNA, 660 bp, Zea mays
  misc_feature: Ceres CLONE 1390316-F
  misc_feature: Encodes the peptide sequence at SEQ ID NO. 21277
  misc_feature (440)..(440): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (485)..(485): n is a, c, t, g, unknown, or other
  misc_feature (486)..(486): n is a, c, t, g, unknown, or other
  misc_feature (504)..(504): n is a, c, t, g, unknown, or other
  misc_feature (505)..(505): n is a, c, t, g, unknown, or other
  misc_feature (512)..(512): n is a, c, t, g, unknown, or other
tccccgcggtggcggccgctctagaactagtggatcccccgggctgcaggaattcgcacgagaccattacctagaacatcctaatcgaaaacggtttcattttgtagctcaaagctcaaaggtgaggctagggtttctttgcgccaaaccagcgaggcagcgactgttttgtcgccacaacactcccgccgaccccctcgccgccgccgggaatggagaccagcactaagaagcttagcagccttcgtatcacctccctggatgacgatgacgaagagaccgagatcccgcaccagccccctcaagcaggcctctcccccgctggagcggattatgaggacgacgacgatgaggaggaagaagccgaagtgactcttggtgtccttagcaaaccgaagcacccaggcttcctcctccgccacttgttccccagcaagggncgcgnnnatcccggcgtgggctagaccggtgaacttgcccgtcgnnaagtccagctactggtgnnttctgtnggcgagcttctgcagttcgccctccagatttatgcaccaattgaagattaatgtaccagccttcaaccgaacgctgttcatggtcatgtgcccatccatggcatgcttggcttcgagatcaacatggacaatggaagcacaagtacgg

SEQ ID NO: 21277 - protein, 83 aa, Zea mays
  misc_feature: Ceres CLONE 1390316-F
  misc_feature (78)..(78): Xaa is any aa, unknown, or other
  misc_feature (79)..(79): Xaa is any aa, unknown, or other
METSTKKLSSLRITSLDDDDEETEIPHQPPQAGLSPAGADYEDDDDEEEEAEVTLGVLSKPKHPGFLLRHLFPSKGRXXPGVG

SEQ ID NO: 21278 - DNA, 681 bp, Zea mays
  misc_feature: Ceres CLONE 1390319-F
  misc_feature: Encodes the peptide sequence at SEQ ID NO. 21279
tccccgcggtggcggccgctctagaactagtggatcccccgggctgcaggaattcgcacgagaccattacctagaacatcctaatcgaaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggcgctccgctctacctctccctctccgcccggtggccgcgcactctgctcgaattgctggtgagatgcccaaagcctttgtgatcctagatgatgttgtgcaacacaccctgactaatttgcacagtattcacaaaagcttactatttttggcaggccaaggctgagggaacaaattctcagaaagtgtactttatgatatttggagaagaggccaaggggccttttgttgatgcaaaattattaaaccctccttagactcggggaggaggtggacgcccgtgccaaaaaaattttggatttctgcatttcggaattgggggggcaaacaaaaccccgccggcccctgac

SEQ ID NO: 21279 - protein, 123 aa, Zea mays
  misc_feature: Ceres CLONE 1390319-F
MATSPPQNPSSGEPSDASSLAAAALEAPVRVWRSLVARFPPLPDSSSFLAGVSDLQLRYFGNSRPRRRRRSALPLPLRPVAAHSARIAGEMPKAFVILDDVVQHTLTNLHSIHKSLLFLAGQG

SEQ ID NO: 21280 - DNA, 696 bp, Zea mays
  misc_feature: Ceres CLONE 1390326-F
  misc_feature: Encodes the peptide sequence at SEQ ID NO. 21281
  misc_feature (307)..(307): n is a, c, t, g, unknown, or other
  misc_feature (453)..(453): n is a, c, t, g, unknown, or other
  misc_feature (516)..(516): n is a, c, t, g, unknown, or other
aagctggagctccccgcggtggcggccgctctagaactagtggatcccccgggctgcaggaattcgcacgagaccattacctagaacatcctaatcgaaaaattttggctcctcactgccgcgccgccaccccctacaggtaaggaagaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacnaggctggcatgactcacattgtccgtgaggttgagaagccaggatccaaactccataagaaggaaacttgtgaggctgttaccatcattgaaacccctcctcttgtcattggtgggctcgtggcatatgtgaagactcctcgtggnctccgcacactcaactctgttgggggccaacatcttagtgaagaagtgaggagaagttctacnagaactggtgcaagagcaagagaaggttttcacaagtatggttctcaatatgaaaatgatgctggcaagaagaaattcagctgcagtttgaaaaaagaaaaaaatgcttctggtatccggggccttgctcatacccaaataggaagatgaaggttttgaaaaaaaaaaaggtcccctggg

SEQ ID NO: 21281 - protein, 168 aa, Zea mays
  misc_feature: Ceres CLONE 1390326-F
  misc_feature (51)..(168): Pfam Name: Ribosomal_L3 Pfam Description: Ribosomal protein L3
  misc_feature (50)..(50): Xaa is any aa, unknown, or other
MSHRKFEHPRHGSLGFLPRKRSSRHRGKVKSFPRDDPKKPCHLTAFLGYXAGMTHIVREVEKPGSKLHKKETCEAVTIIETPPLVIGGLVAYVKTPRGLRTLNSVGGQHLSEEVRRSSTRTGARAREGFHKYGSQYENDAGKKKFSCSLKKEKNASGIRGLAHTQIGR

SEQ ID NO: 21282 - DNA, 873 bp, Zea mays
  misc_feature: Ceres CLONE 1390327-F
  misc_feature (732)..(732): n is a, c, t, g, unknown, or other
tcattttccttttttccctcccctccccccaccccgcgaccccccacaaaagttgagctccccgcggtggcggccgctctataatagtggatcccccgggctgcaggaattcgcacgagaccattacctagaacatcctaatcgaaaaactttcctagggtttcgtcgcttccagccgccgccgcgtccgcctcgccaagcgcagcagccgcccgcagcacatcgctctcttgatctcagccatggcggaggtggagcagcaacaggacacgccgaagctcttcaaccgctggacctttcgatgatgcccaggtgaacgacattcttcgctgaaggactaccctcgcttgggaccgcaccaaacaccgcggatggacctggcggcacaccgggggggggctcctcccagaaaggggttcccgaaggggcaaatgccccgaaatggttaagggccttaaaaaactccccctcctggggggccggggggccaaaaaaccggtaaaaaaaaggggcttgggggtttggcccccaatatcttaaaagaaaaaccccgggggggaaaaaatttttcccccgggggcacccccggggggggtccaccccccccattctggggggggttgggtgtccagcgccgctttacactctcaaagggggggccccccccccggggagagggggcccccccccccgtaaatgggcgcccccgcgccggggggtgtgagaaaaaanaaccagcccgccgggaataaaatcttccccccccggggggggggggggggggaaaacagcgttcatcctacccccccctctcccacacggcgggcccagaagaataagtttttttcctgaaaaaaaacaaaatatcggggg

SEQ ID NO: 21283 - DNA, 735 bp, Zea mays
  misc_feature: Ceres CLONE 1390330-F
  misc_feature: Translation starting site: 421
  misc_feature: SWISSPROT Homolog: EC 2.7.11.24 Mitogen-activated protein kinase
  misc_feature (289)..(289): n is a, c, t, g, unknown, or other
  misc_feature (290)..(290): n is a, c, t, g, unknown, or other
  misc_feature (328)..(328): n is a, c, t, g, unknown, or other
  misc_feature (357)..(357): n is a, c, t, g, unknown, or other
  misc_feature (402)..(402): n is a, c, t, g, unknown, or other
  misc_feature (425)..(425): n is a, c, t, g, unknown, or other
  misc_feature (477)..(477): n is a, c, t, g, unknown, or other
  misc_feature (601)..(601): n is a, c, t, g, unknown, or other
  misc_feature (648)..(648): n is a, c, t, g, unknown, or other
ggagctcaccgcggtggcggccgctctagaactagtggatcccccgggctgcaggaattcgcacgagaccattacctagatcatcctaatcgaaaacccggcccgcgcctcgctctctcttgtctcgcccgctagctcccatcccagcctcccaccgcgcccgcctgccccaacatcccccctccccgctccgctccacgcacggctccagatctgctacggcggcggccggtggacgccgcgccgcgcgtgccggaggcggtgacgtgagcggcggatcctgcccggnncgtgcatcctggcgacgatgacagcgtaagcgggcggnggacgaccgcgcccccccggcccctactnccgaggtcattggcgtgtgctccttggcagaaatggcgatgatgntggatcccccccaatggcatggncagtcaaggaaagcattactatactatgtggcagacactggttgagatcgancacaagtacgtgccgatcaagcccatcggaaagagagcttacggaaatcgttgctcatctgttaaccgcgagaccaatgaaaaagtcgcgataaaaaagataaacacgtctttgacaacgtgtngatgcgctaaggacgctgagagagctgaaactcctttcgcacctgangcacgagaatggtatggctctcaagaactaatgatgcctgcgcaataaaagagcttcaggacgtttacttgggttatgagctcatgg

SEQ ID NO: 21284 - DNA, 712 bp, Zea mays
  misc_feature: Ceres CLONE 1390331-F
  misc_feature: Encodes the peptide sequence at SEQ ID NO. 21285
  misc_feature (433)..(433): n is a, c, t, g, unknown, or other
  misc_feature (447)..(447): n is a, c, t, g, unknown, or other
  misc_feature (605)..(605): n is a, c, t, g, unknown, or other
  misc_feature (712)..(712): n is a, c, t, g, unknown, or other
aagctggagctccccgcggtggcggccgctctagaactagtggatcccccgggctgcaggaattcgcacgagaccattacctagaacatcctaatcgaaaactattcctcggagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctcgctcgncagtacaaccaggnacagatgatctgccgcaaatgctatgcacggctgcaccctagggctgtcaactgccgcaagaagaagtgtggtcacagcaaccagctgagggccaagaagagatcaagaactgagggtgtgctgctagtcagtttcatgggacatggtgtttggttgntgaacccgtgtttgtttaccaactgtatttttgtttgggtggtgaaacgtgtttgtttaccgacatattggccctatgttatggttttacatggttggcgatgacan

SEQ ID NO: 21285 - protein, 178 aa, Zea mays
  misc_feature: Ceres CLONE 1390331-F
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature (92)..(92): Xaa is any aa, unknown, or other
  misc_feature (145)..(145): Xaa is any aa, unknown, or other
MQIFVKTLTGKTITLEVESSDTIDNVKAKIQDKEGIPPDQQRLIFAGKQLEDGRTLADYNIQKESTLHLVLRLRGGIIEPSLQALARQYNQXQMICRKCYARLHPRAVNCRKKKCGHSNQLRAKKRSRTEGVLLVSFMGHGVWLXNPCLFTNCIFVWVVKRVCLPTYWPYVMVLHGWR

SEQ ID NO: 21286 - DNA, 744 bp, Zea mays
  misc_feature: Ceres CLONE 1390340-F
  misc_feature: Encodes the peptide sequence at SEQ ID NO. 21287
  misc_feature (217)..(217): n is a, c, t, g, unknown, or other
  misc_feature (220)..(220): n is a, c, t, g, unknown, or other
  misc_feature (241)..(241): n is a, c, t, g, unknown, or other
  misc_feature (383)..(383): n is a, c, t, g, unknown, or other
  misc_feature (385)..(385): n is a, c, t, g, unknown, or other
tccccgcggtggcggccgctctagaactagtggatcccccgggctgcaggaattcgcacgagaccattacctagaacatcctaatcgaaaaacgcgcgcccaaaggcccccaaggccccaaccccaaccttgcaggaaaaaaaaagagacgaccccccaaatcggaatccgcacacccatcatccatggccgccgccctgctccgccgctcgccggnggngcgcgcgctcctctcgccggnactctcgtcccgcctcgtcgcgtccaagccccactcctcgtcccccgcggcggcggcacctgggaaggccgactccagcacgaagaccttctcgatctaccgttgggacttgtcctcccccccgaggggggggcgggggaangnatacccaggtggaccctgtccaactggggggccaaaagaaggatgaacccgccgctccagatcgaaaaaaggaaaaagaacccgttggttctacctttcgcgccgaaatttgggggggaagggaatctggggggaagattcgccccttaaaaattcaacggggaaaaaggggctccccccgccccccccaaaaaaccccgggggccctccccccgggactcgagtgttgcccctttttcccccaaggatggccgcagaagaagggggggggggagtgggcccctcctctccccccgcaaaagagggctggcccttgctccccgcggaatctccccccccccttaagggggggagacccg

SEQ ID NO: 21287 - protein, 81 aa, Zea mays
  misc_feature: Ceres CLONE 1390340-F
  misc_feature (11)..(11): Xaa is any aa, unknown, or other
  misc_feature (12)..(12): Xaa is any aa, unknown, or other
  misc_feature (19)..(19): Xaa is any aa, unknown, or other
  misc_feature (66)..(66): Xaa is any aa, unknown, or other
  misc_feature (67)..(67): Xaa is any aa, unknown, or other
MAAALLRRSPXXRALLSPXLSSRLVASKPHSSSPAAAAPGKADSSTKTFSIYRWDLSSPPRGGRGXXYPGGPCPTGGPKEG

SEQ ID NO: 21288 - DNA, 776 bp, Zea mays
  misc_feature: Ceres CLONE 1390341-F
  misc_feature (228)..(228): n is a, c, t, g, unknown, or other
  misc_feature (310)..(310): n is a, c, t, g, unknown, or other
  misc_feature (360)..(360): n is a, c, t, g, unknown, or other
aagctggagctccccgcggtggcggccgctctagaatagtggatcccccgggctgcaggaattcgcacgagaccattacctagaacatcctaatcgaaaaattatctccctgactcgcctcgtcctccagatatcggccgccaccttcacctccaccgccccggcgcacctgtgcgtctccatcgtcgccgcctctcctccttcggacacgactgaccttccactggncgcaacgaagaaacacataggaagaagctcaccgccaaaccctcatcagatccagtcgctgccctccgaaggccgcatacgnaacgtctcgtctcttcctttgggatcgggggtaaactccatcaccccagnttcacctccctttaggccccctccgttcgttctcacccaacggttaaatttcgccacctttttcgttggaaaaaaaaaaccctggggattctggttttctggaaaccaattttttggaaaaaatttggggggaaaaaataaaaagggcttgggtctatttggggcccccacgcaaaaagggggggggttttttctggaaccccgtggtctttttaaagggacaccttctcccggggggggacaaaaagggggtaaaaggggggtgcgcgcccttaaaaaaaaaaagaggggggcggttgtgttaaaagaggagttccccccgcggggaaaaaagaggtgtttttttcggggggggcgggggggggggccccccctttttttttttttaaaaaagacccttcccccgcgccgggaaa

SEQ ID NO: 21289 - DNA, 732 bp, Zea mays
  misc_feature: Ceres CLONE 1390342-F
  misc_feature: Translation starting site: 572
  misc_feature (623)..(623): n is a, c, t, g, unknown, or other
aaactggagctccccgcggtggcggccgctctatcctagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtcggcctcggcacctgcgtctacctctggtccgcgtccaatagcaaggtcaccaagctctgcgatttggggcctagggacagcgtatgcgcagtgcattggtcacgggaaggctcttatctttccattggcaccggncttggagatgtccagatttgggattagtctcgttgtaagcggataagaatatgggaggtcaccaaacaggactggggaattagcatggagctcatgcatcttgtcatcg

SEQ ID NO: 21290 - DNA, 734 bp, Zea mays
  misc_feature: Ceres CLONE 1390352-F
  misc_feature: Encodes the peptide sequence at SEQ ID NO. 21291
  misc_feature (389)..(389): n is a, c, t, g, unknown, or other
  misc_feature (390)..(390): n is a, c, t, g, unknown, or other
  misc_feature (496)..(496): n is a, c, t, g, unknown, or other
aaagctggagctccccgcggtggcggccgctctataactagtggatcccccgggctgcaggaattcgcacgagaccattacctagaacatcctaatcgaaaactcttttctctctctctctctctctctctctctgatttcttctcttaactctcgcgtctcgcgtccttttcccttcctcccctccgttgcgtccctccgtccgtccgtccgtcgtcaccagcctcctccctcgcgcccaccgccgggatccgtccctcctcgtctgcgcccgcctcggtctagatttctgagaaaatggcgagaagtgcgggaactaggaggcgtgtggctcgccagctcaagtccacacatcccattccttcatatcgatggaagtcaaagcccanntgaaaagcgatgaaaaaatccaaccgaaaagcagtggttgcaaccttggcaaagatggactgggaaagatgccaattgctctgtgggcatggaataccaacataanggcggggccatcctttggccatccatgataaaggtgggcggcctttatgtggggggaactaactaccgcccctctaattggttgggatccgttcaaaaaaaccttaccccagggggtattggtttggaaaatccccgcaaaaaagggggggtctaaaccgggaattcgggccctttggggtggaaaaaaaaagggccccctttacccttggagggccctttggtgggggggaaaaggg

SEQ ID NO: 21291 - protein, 30 aa, Zea mays
  misc_feature: Ceres CLONE 1390352-F
MARSAGTRRRVARQLKSTHPIPSYRWKSKP

SEQ ID NO: 21292 - DNA, 714 bp, Zea mays
  misc_feature: Ceres CLONE 1390353-F
  misc_feature: Encodes the peptide sequence at SEQ ID NO. 21293
  misc_feature (363)..(363): n is a, c, t, g, unknown, or other
  misc_feature (364)..(364): n is a, c, t, g, unknown, or other
  misc_feature (418)..(418): n is a, c, t, g, unknown, or other
  misc_feature (517)..(517): n is a, c, t, g, unknown, or other
  misc_feature (518)..(518): n is a, c, t, g, unknown, or other
  misc_feature (530)..(530): n is a, c, t, g, unknown, or other
aagctggagctccccgcggtggcggccgctctatcacagtggatcccccgggctgcaggaattcgcacgagaccattacctagaacatcctaatcggaaactccctctcctctcgtccatccgttcctcccttcccctgcttcccggctctccctcccccccatccctgcacgccccttttcatgcgcgaggaggggccgtggggaccaccaccagcacctccatccgcgcgcatctcgcggtggtgctcctcctcctcctccccctgctcccggggcgggcgctctcctgttcctcctcctcctgctgctggtgccagggccgggagggcggcgcggaggtggcgctcatggggctcgccgnngacgggtcggcggacaccgcccacctcagtaatagtgaaaaatggtcggttcangtatggagttgcaaagtctcccgggaaaagagcatcgatggaggacttctatgaggcaaggatagacgaccgtgaccgaaaaaaaagtggaatggtggnngggaatgatggncatggaagagtcaaagccacttgatacggttaagcagcatcttttccggaattttatccaaacccccaagggttcttcctgggaaaccaaggcccttttgggtggaaattttacaccgcgccagaaattcagaattttcggaaagggggagaaccccccaaaccccgaaatggtgggggcccag

SEQ ID NO: 21293 - protein, 123 aa, Zea mays
  misc_feature: Ceres CLONE 1390353-F
  misc_feature (61)..(61): Xaa is any aa, unknown, or other
  misc_feature (79)..(79): Xaa is any aa, unknown, or other
  misc_feature (112)..(112): Xaa is any aa, unknown, or other
MREEGPWGPPPAPPSARISRWCSSSSSPCSRGGRSPVPPPPAAGARAGRAARRWRSWGSPXTGRRTPPTSVIVKNGRFXYGVAKSPGKRASMEDFYEARIDDRDRKKSGMVXGNDGHGRVKAT

SEQ ID NO: 21294 - DNA, 740 bp, Zea mays
  misc_feature: Ceres CLONE 1390361-F
  misc_feature: Encodes the peptide sequence at SEQ ID NO. 21295
  misc_feature (495)..(495): n is a, c, t, g, unknown, or other
  misc_feature (548)..(548): n is a, c, t, g, unknown, or other
  misc_feature (597)..(597): n is a, c, t, g, unknown, or other
aagctggagctccccgcggtggcggccgctctataactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtctggcctgctccttatctctgggcctttncagatcaatggagtaccgatccgccgtgtgaaccagacctatgtcattgctancatcaccaaagttgacatctctggtggtgatgtcgccaagtttgatgancagtactttgccccaggagaagaagcagaaggtgaagaaagaccgagggcgagctttttgagaaagaaaggaggcatccaagccactgcctgacttcagaaggatgaccaaaggctgtggattctgctctgatcagggtatcg

SEQ ID NO: 21295 - protein, 174 aa, Zea mays
  misc_feature: Ceres CLONE 1390361-F
  misc_feature (1)..(49): Pfam Name: Ribosomal_L6e_N Pfam Description: Ribosomal protein L6, N-terminal domain
  misc_feature (112)..(168): Pfam Name: Ribosomal_L6e Pfam Description: Ribosomal protein L6e
  misc_feature (110)..(110): Xaa is any aa, unknown, or other
  misc_feature (128)..(128): Xaa is any aa, unknown, or other
  misc_feature (144)..(144): Xaa is any aa, unknown, or other
MAPTSKLSTGIKRASRSHTYHRRGLWAIKAKNGGAFPKADKAAAAVEPKFYPADDVKPRVPSTRKPKPTKLRSSITPGTVLILLAGRFMGKRVVFLKQLKSGLLLISGPXQINGVPIRRVNQTYVIAXITKVDISGGDVAKFDXQYFAPGEEAEGEERPRASFLRKKGGIQATA

SEQ ID NO: 21296 - DNA, 724 bp, Zea mays
  misc_feature: Ceres CLONE 1390364-F
  misc_feature: Translation starting site: 471
  misc_feature (412)..(412): n is a, c, t, g, unknown, or other
  misc_feature (415)..(415): n is a, c, t, g, unknown, or other
  misc_feature (433)..(433): n is a, c, t, g, unknown, or other
  misc_feature (445)..(445): n is a, c, t, g, unknown, or other
  misc_feature (606)..(606): n is a, c, t, g, unknown, or other
  misc_feature (614)..(614): n is a, c, t, g, unknown, or other
  misc_feature (627)..(627): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctggcgccgnccnacatgcactaccctactncacccgcccggnctcagcctcatccccagccacacccatgcccgtgccaacagccgcatccaagcccgtgccagctgcaggggacccctgcgcgtggcagcaccccgatcctggggcagtgcgtcgagttcctgaggcatcagtgcagcccgacggcgacgccctactgctcngctcagtngcagtcgttgcgncagcagtggtgccagcagctcaggcaggtggagccgcagcaccggtaccagcgatcttcgggttggtcctcaagtcatcctggcagagcagccggaa

SEQ ID NO: 21297 - DNA, 567 bp, Zea mays
  misc_feature: Ceres CLONE 1390365-F
  misc_feature (567)..(567): n is a, c, t, g, unknown, or other
gctctagacagtggatcccccgggctgcaggaattcgacgagaccttacctagaaatcctaatcgaaaactgatggatcactcctgcagctgcagctgcagtgcgtcgccgctactccatcgtctattaattcctcgtgtagctcccgcgctcggctaagacagcctctcccacatgaagctcctggggtggatgcaccggaggtaccaccgaacagttatgatgggtttcaaaagttcaacaacgcttggaggggggaagggaaatgggatccccgggggtgggccgggggaaccgggacattttctctgcccccgcaaaaaaaaatttccgccgaaaaggattttcaaaaaattattttgtgggggggggggggaactttttacctttgggggggggggccccccccaatttggcacaatgaattcccccccccccggggggtccgaaaattttttaaaaatttttaaaaccccccccccgtttggttccccccttttttaaaaaacaaacccccccggggggggaaaaaaaaaaagggggagggggcgcccccccccctttttn

SEQ ID NO: 21298 - DNA, 716 bp, Zea mays
  misc_feature: Ceres CLONE 1390366-F
  misc_feature: Translation starting site: 180
  misc_feature: SWISSPROT Homolog: EC 1.2.1.12 Glyceraldehyde-3-phosphate dehydrogenase (phosphorylating)
  misc_feature (668)..(668): n is a, c, t, g, unknown, or other
aagctggagctccccgcggtggcggccgctctagaactagtggatcccccgggctgcaggaattcgcacgagaccattacctagaacatcctaatcgaaaaacactcgccaaccccgtcatcgatctcgtttcaaatccatccatcctcgtttcctccgtcccgcagcatctcaaccccatggccaagatcaagatcgggatcaatgggttcggcaggatcggaaggctggtggccagggtggctctgcagagtgacgatgtcgagctcgtcgccgtgaacgaccccttcatcagcaccgactacatgacctacatgttcaagtacgacactgtacacggacagtggaagcaccatgaaagtcaggtgaaggactccaaaacccttctcttttgtgagaaaggagttgctgtgtttggctgcaggaaccctgaggagatcccgtggggtttcgttggtgctgaatatgttgttgagtctactgttggtttcactgaccaggagaaggctgcagctcactttgaagggtggtgccaagaaagttgtcatctctgctcctagcaagaatgcccccatgtttgtcgtttgtgtcaacgagaaggagtacaagtctgacattaacattgtctccaatggtagctgaaaaaccaactggcttgctcctcttgntaaggtcatcaatgacaagttcggtaaccgttggaggtcctgaagacc

SEQ ID NO: 21299 - DNA, 723 bp, Zea mays
  misc_feature: Ceres CLONE 1390367-F
  misc_feature: Encodes the peptide sequence at SEQ ID NO. 21300
  misc_feature (478)..(478): n is a, c, t, g, unknown, or other
  misc_feature (559)..(559): n is a, c, t, g, unknown, or other
aaagctggagctccccgcggtggcggccgctctagaactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcgtctgtctgcgcacgcgcgaggtcagtgagtgagcattgcggtggtccgatcgcccgcggggggccatggcgtctgtggcgagatcgggcggcggagcaagcgcgggggccggtgggttgaatacttactttcagacccccgaggggcggcacaagctgcagtacgagaagacgcactcccccggcgtcgtgtactacaacaacaacggnaagaccgtcgcccagatgacggtggcatatttgaaggagaagtcagcaggccagggttccacgccctcaacaccaagtgcntggtaatgggatgcggtctgcaactggaaaactgcttggaactgggaatgggaaccggacactaacttccggaggaagggtaccacagggttgcttcaggaaacaaccccttggggggagggatttgggggggcacctaagggaaggggctcccagggttgggg

SEQ ID NO: 21300 - protein, 76 aa, Zea mays
  misc_feature: Ceres CLONE 1390367-F
MASVARSGGGASAGAGGLNTYFQTPEGRHKLQYEKTHSPGVVYYNNNGKTVAQMTVAYLKEKSAGQGSTPSTPSAW

SEQ ID NO: 21301 - DNA, 762 bp, Zea mays
  misc_feature: Ceres CLONE 1390368-F
  misc_feature: Encodes the peptide sequence at SEQ ID NO. 21302
  misc_feature (532)..(532): n is a, c, t, g, unknown, or other
aagctggagctccccgcggtggcggccgctctagaactagtggatcccccgggctgcaggaattcgcacgagaccattacctagaacatcctaatcgaaaacttgtgaacatcgcagtgctgtagcctccttcgtcttgagcgagcatggagatgtcagccatggaggaagccctccccaaggcgatggagaggaggaaggaaggcctcaaaaccattccgttcatcatcttaaacgagatattcgagaaggtggccacgttcgggctgtcggccaacatgatcctgtacctcaccgagcggtatctcatgaccaacgcctttgccaccgtcgtcctctacttctgggatgccttctccaacttcctgcccatcttaggcgccggggtcgccgacgcccgcctcggccggttccggggtcatcaccctcggctcctgcgttagcctcttcgggatgtgcctggtggtgctgacgccgaatctttccggtgtacaagaacaccccggagtgcgcgccggggccggccggtaanggtgcgcgggtgcctgccgtggaagctggccgttcatctttcaaggcggtccaggttcatggcccctcggggccgggggggataccgggcccgggaacgtttggggtttcgggggccaaaccagttgggaaaaggcgggaaaaacggcgcccaagaaaggggggaggaacgttggcaaaaccctctttaactggggaaaaaaaacgggggggtgggccctcctccattgg

SEQ ID NO: 21302 - protein, 98 aa, Zea mays
  misc_feature: Ceres CLONE 1390368-F
MEMSAMEEALPKAMERRKEGLKTIPFIILNEIFEKVATFGLSANMILYLTERYLMTNAFATVVLYFWDAFSNFLPILGAGVADARLGRFRGHHPRLLR

SEQ ID NO: 21303 - DNA, 728 bp, Zea mays
  misc_feature: Ceres CLONE 1390369-F
  misc_feature: Encodes the peptide sequence at SEQ ID NO. 21304
  misc_feature (329)..(329): n is a, c, t, g, unknown, or other
  misc_feature (330)..(330): n is a, c, t, g, unknown, or other
  misc_feature (464)..(464): n is a, c, t, g, unknown, or other
  misc_feature (469)..(469): n is a, c, t, g, unknown, or other
  misc_feature (500)..(500): n is a, c, t, g, unknown, or other
caaagctggagctccccgcggtggcggccgctctagaactagtggatcccccgggctgcaggaattcgcacgagaccattacctagaacatcctaatcgaaaaagcctgcctcggtgcgccgccgccacacctccaccatggctgcgaccacgccggccaccgacccgccggatgccttgcttgcagtaacagctgatgctcccactcctgctcgtcccaccccggcggagctggtagcccgcgccgtcgcccccgtcaagcccgccttcctctgcccgcctcccgtccgtgaggcacccaaggaggagggtaaagccgccggcggcgnngccgtcgtaaaggtggagaagaagtccagcgccagctcaagcgcgagcggcagcaggaacaaaaatctacttctcacctttgtatcgaagtagggaaaaagtggaaatggtgactcatgcaaatatggtacttncttgncgtttcagccatgacataaaatgctatttgnctcaaaaaccagttgaccttggaggcacatgcccatttactgcccggggaaaatttggggccataaggacaaatgggccaatccttaaaaaccataaaagataaccttggtcctcaaaactcccaaggggaaattgggggaaaaaaccttgggaaaaaaatccaaagctttttgggaaaaaaaaataaatttcccagggcgggccaaaaaaaattttggggttaaaga

SEQ ID NO: 21304 - protein, 94 aa, Zea mays
  misc_feature: Ceres CLONE 1390369-F
  misc_feature (64)..(64): Xaa is any aa, unknown, or other
MAATTPATDPPDALLAVTADAPTPARPTPAELVARAVAPVKPAFLCPPPVREAPKEEGKAAGGXAVVKVEKKSSASSSASGSRNKNLLLTFVSK

SEQ ID NO: 21305 - DNA, 699 bp, Zea mays
  misc_feature: Ceres CLONE 1390370-F
  misc_feature: Encodes the peptide sequence at SEQ ID NO. 21306
  misc_feature (391)..(391): n is a, c, t, g, unknown, or other
  misc_feature (408)..(408): n is a, c, t, g, unknown, or other
  misc_feature (409)..(409): n is a, c, t, g, unknown, or other
  misc_feature (485)..(485): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
aaagctggagctccccgcggtggcggccgctctagaactagtggatcccccgggctgcaggaattcgcacgagaccattacctagaacatcctaatcgaaaaagggaagaaaatacaatcgctgaaaccagatgtccaacggatgactggaactcctgtcagtttgcactgagcaatggttcatccattctcaataaccacagtgctccacaggatagcctcacttatggagataatgatctaaactacattgattggcctggcattgacaattttgaggatgttgacacattattcaggagatctgatttcacatatgatccgcagcagctggagaatacagatgggttatcttggcttccttcttcagatgctgtttactcttctgatngtgctttgcagcaaggnnttgactcgtcttattcgattatgatattctggatgatctctcgcattccatggcagagataatcctacctcagtgnccctctcggatatgacatagactcttcgcaatgagatgaatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 21306 - protein, 156 aa, Zea mays
  misc_feature: Ceres CLONE 1390370-F
  misc_feature (131)..(131): Xaa is any aa, unknown, or other
  misc_feature (137)..(137): Xaa is any aa, unknown, or other
KAGAPRGGGRSRTSGSPGLQEFARDHYLEHPNRKREENTIAETRCPTDDWNSCQFALSNGSSILNNHSAPQDSLTYGDNDLNYIDWPGIDNFEDVDTLFRRSDFTYDPQQLENTDGLSWLPSSDAVYSSDXALQQGXDSSYSIMIFWMISRIPWQR

SEQ ID NO: 21307 - DNA, 734 bp, Zea mays
  misc_feature: Ceres CLONE 1390371-F
  misc_feature (1)..(1): n is a, c, t, g, unknown, or other
  misc_feature (487)..(487): n is a, c, t, g, unknown, or other
  misc_feature (488)..(488): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
nagagctggagctccccgcggtggcggccgctctagaactagtggatcccccgggctgcaggaattcgcacgagaccattacctagaacatcctaatcaaaaatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaactccaagggcgcatgctccggttgctagctacgatgccgtgtgcgtagctgcggcagcccttgatcgatcaatcgatcgcttgtgcggaatgagccggatcgagtggagtcagctagctagatactccgtgggtcgtcgtcgtcgttggacgtacgccagaagagggagctagagaagaaatacgtacagctgcttccaacatggcagctgcctcgtctgcccacctgttcggactnncgcgacggcagatgcagatgcagccgcagcagcagcaggcgcccgcctcctcctcttgtgaacaacccgggccgcgccgccgcccaagaagaaggcggacccaacccggtaacccaaacccttgacggcggaggtgatcgggctttcccccaaggaggcggnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21308 - DNA, 731 bp, Zea mays
  misc_feature: Ceres CLONE 1390372-F
  misc_feature (329)..(329): n is a, c, t, g, unknown, or other
  misc_feature (489)..(489): n is a, c, t, g, unknown, or other
  misc_feature (498)..(498): n is a, c, t, g, unknown, or other
aaagctggagctccccgcggtggcggccgctctagaactagtggatcccccgggctgcaggaattcgcacgagaccattacctagaacatcctaatcgaaaaaaatagcaatttttccccctgggagcccgagacgcagcgcgaggtgcggccccgtcccctcgccaccggaggagcaggacgacgaggtggcgtcggcgcgaggtagtcgcgcgcctggaagagcggcggcatcggagtcgcaggcggaggcgaggaagtgaggggagagccctatagccaccgccgcggggcgtcgtgctcgctgcacgcactcccaccattttgtncccactcgaagctcagactcgtgctgtcgtgctgtgcacgacccctcccctagcatcccaagctcctaactgagaaacaggagatgggaagagacggggaacagactaggcgccggagccgccagagatcccgcgacgcctccccctcctcggcggattncgattcttncgactccccatcctctccgaggagtagccctgagcgacggagccgcagcagtaagggaaataaatctcttatcgcaccggcacaagcgaaagaaaagcgacgggtcgggaaaaatccgggacgagaacggcggggggggaaaaaaaggggcccaggaaaaaggggccgcggggggattttttaaaggccctccgacttccatggtccgaagaggatagggcggaaggagccgg

SEQ ID NO: 21309 - DNA, 707 bp, Zea mays
  misc_feature: Ceres CLONE 1390373-F
  misc_feature: Translation starting site: 236
  misc_feature: Pfam Name: vATP-synt_AC39 Pfam Description: ATP synthase (C/AC39) subunit
  misc_feature: SWISSPROT Homolog: EC 3.6.3.14 H(+)-transporting two-sector ATPase
  misc_feature (400)..(400): n is a, c, t, g, unknown, or other
  misc_feature (435)..(435): n is a, c, t, g, unknown, or other
  misc_feature (446)..(446): n is a, c, t, g, unknown, or other
agagctggagctccccgcggtggcggccgctctagaactagtggatcccccgggctgcaggaattcgcacgagaccattacctagaacatcctaatcaaaaacccagatctcatctgcgacgacctcctccctcccgatcccgctccgtctccccccaccgccaccgctgccgctgccgcctcccccaccgaggtcttgtcttcggcgatccagccggagcccgcggcggcgacgatgtacgggtgggagatgctgtcgttcaacatacacgatgggttcctggaggccatcgtgcggggcaaccgctcgggcctcctcaccgccgccgactacaacaacctctgccagtgcgagaccctcgacgacatcaagatgcacctcaccgccaccgagtacggnccctacctccagaacgaaccttcacccttgcacancacgacgattngtggagaagtgcactcttaaactagtcgatgagtacaagcacatgctgtggccagccactgaaccactatctacgtttttggcaaatataacttatgggcacatggatgacaatggtgtccttattggactgggaaccctgatgaaaaaaatgtaacgacttttgaaaaatgccacccatgggcatggttaggagatggcatcacttgttgtgtcaaaaagtgggggagtttaaaaagtggtttagccataacccctgccc

SEQ ID NO: 21310 - DNA, 766 bp, Zea mays
  misc_feature: Ceres CLONE 1390374-F
  misc_feature (348)..(348): n is a, c, t, g, unknown, or other
  misc_feature (354)..(354): n is a, c, t, g, unknown, or other
  misc_feature (355)..(355): n is a, c, t, g, unknown, or other
  misc_feature (401)..(401): n is a, c, t, g, unknown, or other
  misc_feature (402)..(402): n is a, c, t, g, unknown, or other
  misc_feature (417)..(417): n is a, c, t, g, unknown, or other
  misc_feature (427)..(427): n is a, c, t, g, unknown, or other
aaagctggagctccccgcggtggcggccgctctagaactagtggatcccccgggctgcaggaattcgcacgagaccattacctagaacatcctaatcgaaaactcctccattcctctccctctctctctcgtcggtgggaccgtgggatacgctgacggacggacgggctgaggcaaggccgcctgcgggcgggaggaagaaaagcgaagctgctgcgccctcccctcccccatctccgccccccgcctcacccaccagacgagagagcgagcgcagttcggccgccggtcgcgtccgactccagcaaagccgagcgcccaccccctcaccctatttacttcctctcnggtccnnattcgtgcctggctgactccgcacgtcttcccccctttttcctccnntcgacgacgaccgtncgtccaccancgggatcaggagcgaccctccctcgtgctcgtcgacgatcgaccggccggcgatcgtccaagaagggatgtcaagcctcgaaggagccgctgggtctccggaaacctgccaaggttgagtattacagactcgggggggttccggggccttggggggtttggaagccaccggccaaaaaaaaaaaccaaggggtggggaaataagggggaaggttcccggaaaaggggggcccctcagaggggtttcccctggggggaaattccccctttccctgggcccccagggggcccggggggggggtatctttgggggggggggggggtggtttaaaatttcccg

SEQ ID NO: 21311 - DNA, 730 bp, Zea mays
  misc_feature: Ceres CLONE 1390377-F
  misc_feature: Encodes the peptide sequence at SEQ ID NO. 21312
  misc_feature (484)..(484): n is a, c, t, g, unknown, or other
aaagctggagctccccgcggtggcggccgctctagaactagtggatcccccgggctgcaggaattcgcacgagaccattacctagaacatcctaatcgaaaaaatccactccactccatcatcccgtgcctcacgagtcacgagtcactccaggtccaggctgagcagcaatggcgccgcgaacgctcggcttcaacgcggccccgctcctccagattctgcggtccctgtgcctcctggccctcgccgcggcggcggcggtgtccgggcggcgccacggggcctccccggcgcgcggcagcgggcagagcatgtacctggcgccggcctgccgggcgcacacggcgtcggtggcggacttcggcggcgtgggcgacggcaccacttccaacaccgcggcgttccggtccgcggtggaccacctgtcgcagtactcgggcgagggcggcggcggtggcatgctgtacgtgccctgggcaagtgnctgacgggccccttcaacctgacagccacttcaccctctacctccaccagacgccgtcatcctcggctcccaggacgtaggcgagtgggcaatcgtggatccctggccttcttacgggagagggagggacaggccccggagggaggttcgctagcctcatcggcgatcgaacctgaccgacgtagtcatcactggcagcaacgggacgatcgatgggcagcgccccagggggtgggtcaaagtcca

SEQ ID NO: 21312 - protein, 104 aa, Zea mays
  misc_feature: Ceres CLONE 1390377-F
MAPRTLGFNAAPLLQILRSLCLLALAAAAAVSGRRHGASPARGSGQSMYLAPACRAHTASVADFGGVGDGTTSNTAAFRSAVDHLSQYSGEGGGGGMLYVPWAS

SEQ ID NO: 21313 - DNA, 722 bp, Zea mays
  misc_feature: Ceres CLONE 1390379-F
  misc_feature: Encodes the peptide sequence at SEQ ID NO. 21314
  misc_feature (240)..(240): n is a, c, t, g, unknown, or other
aaagctggagctccccgcggtggcggccgctctagaactagtggatcccccgggctgcaggaattcgcacgagaccattacctagaacatcctaatcgaaaaagggcagcgcgtgcggaaaccctagtcgccgccgatggtcgaccctttctacccgtactaccgcggagccttcccgggcggcgacggtgcgcagccgcccgcacgttactcggattttgaggtcgacctcatcgcggnccgttacgccggcaccctattgcctttatcatcctctggcgacgtcggcgccttcgactcgtatgtcggcgcggagacgatccgcgggagttctctatcaccaatcttttatgggaagtcatagtactgttggccagaatgaggctttatattcatccgatactatggctaaacgccctaggcttggaagcagcctttctatatatccacaacgaccgtgggaaaaggactgtgccttctatatgagcacctggaacctgtaatatgggaagacctgcaaatttgaccatccacaacgggttccagagggtggggttccaaactggaaagaggcccgaatgttgaatatcttatcctgagcgaccaggggaacagattgcccttattatggaaaataggaggaagttaaatctaaatgcaggtcaccatccgagggtttgggaaggcttaggaaagggacaacatggactccattggtgaag

SEQ ID NO: 21314 - protein, 66 aa, Zea mays
  misc_feature: Ceres CLONE 1390379-F
MSARRRSAGVLYHQSFMGSHSTVGQNEALYSSDTMAKRPRLGSSLSIYPQRPWEKDCAFYMSTWNL

SEQ ID NO: 21315 - DNA, 726 bp, Zea mays
  misc_feature: Ceres CLONE 1390380-F
  misc_feature: Encodes the peptide sequence at SEQ ID NO. 21316
  misc_feature (388)..(388): n is a, c, t, g, unknown, or other
  misc_feature (389)..(389): n is a, c, t, g, unknown, or other
  misc_feature (529)..(529): n is a, c, t, g, unknown, or other
  misc_feature (532)..(532): n is a, c, t, g, unknown, or other
  misc_feature (632)..(632): n is a, c, t, g, unknown, or other
  misc_feature (645)..(645): n is a, c, t, g, unknown, or other
  misc_feature (674)..(674): n is a, c, t, g, unknown, or other
  misc_feature (684)..(684): n is a, c, t, g, unknown, or other
aaagctggagctccccgcggtggcggccgctctagaactagtggatcccccgggctgcaggaattcgcacgagaccattacctagaacatcctaatcgaaaaatcatcacactcgaaacccaacagcttccttcctggcgatccaattaacggcttctcttctgagctcagcacgaacaatggccaccatcctcaccgtcgcaagcttcttcgcacttgtgtgcatctctcaacaagcgcgggctgcgaactacacgttcatgaaggacgcggtgcacgcgccgcggacgggcttctacgactacatcatagtcggcggcggcacggcgggctgcccgctggcggccaccctgtcggcccgcgcgcgggtgctgctgctggagcgcgnnggctctccgtacgaggacgcgcgcgtcctgaacatggcccacttctcggacgtgctggcggacacgtcggcgtcgtccccgtcgcagcggttcgtgtcggaggacggcgtgatcaactcccgcccgcgcgtgctgggcgncgncagctgcatcaacgccggcttctcacgcgccggcggggcgggctacgtcagggcccgccggctggacccccagggaggggccggcggcgtaccggtgggngggaagaccgggnccgggccccccccgcgctgggcccttggnaaggccaccnggggaatggccctgctgaaaaccgggggttgcggtaattggg

SEQ ID NO: 21316 - protein, 182 aa, Zea mays
  misc_feature: Ceres CLONE 1390380-F
  misc_feature: SWISSPROT Homolog: EC 4.1.2.10 Mandelonitrile lyase
  misc_feature (70)..(70): Xaa is any aa, unknown, or other
  misc_feature (117)..(117): Xaa is any aa, unknown, or other
  misc_feature (118)..(118): Xaa is any aa, unknown, or other
  misc_feature (156)..(156): Xaa is any aa, unknown, or other
  misc_feature (169)..(169): Xaa is any aa, unknown, or other
MATILTVASFFALVCISQQARAANYTFMKDAVHAPRTGFYDYIIVGGGTAGCPLAATLSARARVLLLERXGSPYEDARVLNMAHFSDVLADTSASSPSQRFVSEDGVINSRPRVLGXXSCINAGFSRAGGAGYVRARRLDPQGGAGGVPVGGKTGXGPPPRWALGKATXGMALLKTGGCGNW

SEQ ID NO: 21317 - DNA, 726 bp, Zea mays
  misc_feature: Ceres CLONE 1390382-F
  misc_feature: Encodes the peptide sequence at SEQ ID NO. 21318
aaagctggagctccccgcggtggcggccgctctagaactagtggatcccccgggctgcaggaattcgcacgagaccattacctagaacatcctaatcgaaaaaattccggccacaccccccgctacgcctgtgctgccgcctccccttcctcttcgcttcccgtgcaagcttcaccgccgccatctcgtcctctcgtcgcgatgcttccccttccgcgccgcggttcctctatccccgccttccctgcccgctccggctcttgcacctgacccagtccgccaatctgttccccttttccgtacgagggtactatcgccggccatttcgattcggggttgatcggatcagcgtaggctgatgggtcgcgatgctgagaagacctctccgccggtgccatcgtcggaattggaacaggaagaagacgacgactgctacctaagcgatcaggaggacgatgccctagaagagtccgttctccatgtcctcgaggacgagcacctcgaggactgccattggtccgcctcatgcgtgatcaccaaggaatccctcttggcagcgcagaaggaggatcttaggaaggtgatggagctgctagggttgagggagcaccatgcccggacgctcctcatccactaccgctgggacgtggaagaggatttttgagcttctcgatcagaagggaagggatagcctcttctcggaggctggtattcctcttcagtaca

SEQ ID NO: 21318 - protein, 101 aa, Zea mays
  misc_feature: Ceres CLONE 1390382-F
  misc_feature: The sequence is a functional homolog of SEQ ID NO 330 in the 10/374,780 US patent application
  misc_feature: The sequence is a functional homolog of SEQ ID NO 56 in the 11/375,241 US patent application
  misc_feature: The sequence is a functional homolog of SEQ ID NO 854 in the 10/225,066 US patent application
  misc_feature: The sequence is a functional homolog of SEQ ID NO 274 in the 10/666,642 US patent application
MGRDAEKTSPPVPSSELEQEEDDDCYLSDQEDDALEESVLHVLEDEHLEDCHWSASCVITKESLLAAQKEDLRKVMELLGLREHHARTLLIHYRWDVEEDF

SEQ ID NO: 21319 - DNA, 700 bp, Zea mays
  misc_feature: Ceres CLONE 1390384-F
  misc_feature: Encodes the peptide sequence at SEQ ID NO. 21320
  misc_feature (368)..(368): n is a, c, t, g, unknown, or other
  misc_feature (416)..(416): n is a, c, t, g, unknown, or other
aaagctggagctccccgcggtggcggccgctctagaatagtggatcccccgggctgcaggaattcgcacgagaccattacctagaacatcctaatcgaaaaaagtagccctccctgttccatcgaacccagcagagcagccagccgaacaacgaagcatgccgtcgaagccgaacgccgcgtcgcgcctcgtcttcctcgctttcctcctcgtcatcagcgccgccgcggccaacgatgacgccgcggcgcggcggacgatggagcagttcgccggcttccccgcctccgacgacggggagggcccttccagcgacttccacgtcgactccgagggcctccagcgtcagatcgatgaactgggctcgntctccgactcggcgggggcggcggtgacccgcggtctgtacaccgacnaggatgtggcaggctcgaaggtatataaaagggataatggaatcacttggcccttgttgtacaagagatgctgttggaacatatttggcgctgggaggggtccgaggctggactaggagcagtggcactggatctcatggtgatgccattcattctcagcaaatttgattgggtggtggagtcctggggtctggaggaaatagtttggtgaaagggctgcttcctggcaaaagacttggagggtattatgttacctcgaggagctacccatttggaataggtgg

SEQ ID NO: 21320 - protein, 124 aa, Zea mays
  misc_feature: Ceres CLONE 1390384-F
  misc_feature (71)..(71): Xaa is any aa, unknown, or other
  misc_feature (87)..(87): Xaa is any aa, unknown, or other
MPSKPNAASRLVFLAFLLVISAAAANDDAAARRTMEQFAGFPASDDGEGPSSDFHVDSEGLQRQIDELGSXSDSAGAAVTRGLYTDXDVAGSKVYKRDNGITWPLLYKRCCWNIFGAGRGPRLD

SEQ ID NO: 21321 - DNA, 742 bp, Zea mays
  misc_feature: Ceres CLONE 1390386-F
  misc_feature: Translation starting site: 371
  misc_feature (596)..(596): n is a, c, t, g, unknown, or other
  misc_feature (620)..(620): n is a, c, t, g, unknown, or other
  misc_feature (690)..(690): n is a, c, t, g, unknown, or other
  misc_feature (731)..(731): n is a, c, t, g, unknown, or other
atagctggagctccccgcggtggcggccgctctagaactagtggatcccccgggctgcaggaattcgcacgagaccattacctagaacatcctaatcgaaaaagtgcccactgtcctatacgctaacacgggtgcccagccgccgcacagtctttcgaactgaggaaccctaggcccagcactcggcgacggcggcgcgccaccggcgacgggatcagcggcatcactcccctccttccccggcgcggcggcgccctgcacctaggccctagcactgcagcactcgacaacaggatcagcggtcgcgcccccctcctccttccccggcgcggcggcgccctgcagatctgccactgtccgcctgccggtcatggagcacctccggtggcgccccacagtgaacgagcgcgacttcattgagtgtgcgctccagtctgacctccgtgttgacggccgccactcctttgacttccgcaagctcaagatcaccttcgggcagggaggatggctcgtcagaggtgcagctcggggagacacacgtgatgggctacgtgaccgtgcagctggtgcagccataccgtgacaggccgaatgangggacgctggccatattcaccgangtctcacccatggccgacccctcttgggagcctgggcgtcctgggggattagcattgagcttggccgagntattgacctggccttcaggagagtcgagctgttgactggantcctttggggg

SEQ ID NO: 21322 - DNA, 717 bp, Zea mays
  misc_feature: Ceres CLONE 1390388-F
  misc_feature: Encodes the peptide sequence at SEQ ID NO. 21323
  misc_feature (581)..(581): n is a, c, t, g, unknown, or other
aaagctggagctcaccgcggtggcggccgctctagaactagtggatcccccgggctgcaggaattcgcacgagaccattacctagaacatcctaatcgaaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggcgctccgctctacctctccctctccgcccggtggccgcgcactctgctcggattgctggtgagatgcccaaagcctttgtgatcttagatgatgttgtgcaacacaccctgactaatttgcacagtattcacaaaagcttactattttggcaggccaaggctgagggaacaattctcagaaagtgactttatgaattttgagagaggtcaagggccctttgttgatgcaacatatcanacactcactagactcgggagcaatggacgccctgtccaatacattttgcattctgcatcctggatatggtgtcaacaaaactcgctgccctgacagtatgcaacactgcttgggcgctttttcttggagaggttca

SEQ ID NO: 21323 - protein, 130 aa, Zea mays
  misc_feature: Ceres CLONE 1390388-F
MATSPPQNPSSGEPSDASSLAAAALEAPVRVWRSLVARFPPLPDSSSFLAGVSDLQLRYFGNSRPRRRRRSALPLPLRPVAAHSARIAGEMPKAFVILDDVVQHTLTNLHSIHKSLLFWQAKAEGTILRK

SEQ ID NO: 21324 - DNA, 706 bp, Zea mays
  misc_feature: Ceres CLONE 1390392-F
aaagctggagctccccgcggtggcggccgctctagaactagtggatcccccgggctgcaggaattcgcacgagaccattacctagaacatcctaatcgaaaaattctcttctcgatttaagccttactacgacgcagttcccgtattcccacggagtatatggcgttgctatgggaaagaagagcaacatctagtacacgtcgtcggcctcgttcaggccgattaaggcctccccgactgccaggtctgccaccgctaaggtcgctgggctatctgaggtactccgaccagtaaaggctacatcgcagaagctgccgcagcgtccatgcgccaataatgtaaaggaatgcgagcctgattcgatggtcgagaaagatgtgtggctgtaccatgatcaagagcgcgagagcgtctaggcttcgatccaggagctgctggattcaatctccatggacatgtcgtcgagctgttactcgacatgtgcatcgttcttggtgacgtgatcaacaacgatcgggaaagtgtcgacgtcgaccctgatcatgggaagatcttcggacacgtactcggatgataatcccatccgacagcctcaccgatgtcttctggcatacggaatctacaggaactcagggtcgtcacagacgatatacgttcagtgcagggggcatggttgaatcgcttcatcatctgtccgagccgaagt

SEQ ID NO: 21325 - DNA, 715 bp, Zea mays
  misc_feature: Ceres CLONE 1390394-F
  misc_feature: Encodes the peptide sequence at SEQ ID NO. 21326
  misc_feature (679)..(679): n is a, c, t, g, unknown, or other
aaagctggagctccccgcggtggcggccgctctagaactagtggatcccccgggctgcaggaattcgcacgagaccattacctagaacatcctaatcgaaaaattggatttgccccagtgtactacagactcgacaggtgagcataaaagaggagagccgataagcacaatggcgcctgaggaaaggatgaagcagacagagggcagtcacaaggtggtaacagcagcaggtggcaagatggcggtcggagtgaggagcatcgtgacctcccttggctttcttcatcctagccagctccgtcgtgttcctcctcctcgacagagaagccgggctccaagaagaacaggcgataagagccggcggcggcgacgaggagtgcagctggtctcgggggcgctgggtgtacgacaacgtgtcccggccgctgtacgacgggctcaagtgcgccttcatcttccccgaggtggcctgtgacaagtatgggcaggaaggatgtcatgtaccagcactggagatggcagcctcatgggtcatggatgcgacctccaaagattcgatgggcatcagctgctttgagagctgagaacaagaaaactgggtgttggtggggcgactccgtgacaggaaaccatgggtctctctcgtgggggatggtggaggcctccatacctgacgacnggctcaagatgcgcatctttcatggctcgctcatct

SEQ ID NO: 21326 - protein, 78 aa, Zea mays
  misc_feature: Ceres CLONE 1390394-F
  misc_feature (67)..(67): Xaa is any aa, unknown, or other
MGRKDVMYQHWRWQPHGSWMRPPKIRWASAALRAENKKTGCWWGDSVTGNHGSLSWGMVEASIPDDXLKMRIFHGSLI

SEQ ID NO: 21327 - DNA, 691 bp, Zea mays
  misc_feature: Ceres CLONE 1390395-F
  misc_feature (238)..(238): n is a, c, t, g, unknown, or other
  misc_feature (262)..(262): n is a, c, t, g, unknown, or other
  misc_feature (264)..(264): n is a, c, t, g, unknown, or other
  misc_feature (265)..(265): n is a, c, t, g, unknown, or other
  misc_feature (281)..(281): n is a, c, t, g, unknown, or other
  misc_feature (330)..(330): n is a, c, t, g, unknown, or other
  misc_feature (341)..(341): n is a, c, t, g, unknown, or other
  misc_feature (373)..(373): n is a, c, t, g, unknown, or other
  misc_feature (387)..(387): n is a, c, t, g, unknown, or other
  misc_feature (401)..(401): n is a, c, t, g, unknown, or other
  misc_feature (402)..(402): n is a, c, t, g, unknown, or other
  misc_feature (448)..(448): n is a, c, t, g, unknown, or other
  misc_feature (449)..(449): n is a, c, t, g, unknown, or other
  misc_feature (475)..(475): n is a, c, t, g, unknown, or other
  misc_feature (504)..(504): n is a, c, t, g, unknown, or other
  misc_feature (505)..(505): n is a, c, t, g, unknown, or other
  misc_feature (545)..(545): n is a, c, t, g, unknown, or other
  misc_feature (548)..(548): n is a, c, t, g, unknown, or other
  misc_feature (551)..(551): n is a, c, t, g, unknown, or other
  misc_feature (559)..(559): n is a, c, t, g, unknown, or other
  misc_feature (586)..(586): n is a, c, t, g, unknown, or other
  misc_feature (655)..(655): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
aaagctggagctccccgcggtggcggccgctctagaactagtggatcccccgggctgcaggaattcgcacgagaccattacctagaacatcctaatcaaaaaattgattggttgcttggttgcttgcttcgtttcacgctttccccttcctttgctgagatccaaaagctgagactcagcttgtcgatccatctgttctgtgcgcctactcgtatcttaggatccatctgtatgttgntttaacttggttttcctggattgnannatcgcggcatttgggnaattgggcccccttggggggtgggggggttttttgggggcgccgccccnccctttttttntttttgggggggggggggggggggccgcgcgncccccccgcccctnttcttttttcgttnntttgtgtcgggttgtggtcgcgccccgccctcgccgcgccgttccnnttgcccccgcccgtgtgggtgttggnttgtctcggggggggcggtggcggggggnngcgctgcgcgcggtgggcggcgtccgtgttgtgcgtctcntgnctnccctgctntgctgctgtgtcgcgtctccgctgctnccgtgtttctttttttgttttttgtgccgtcctctttcctgttttgttgttgttggcggtgttgtgttncccgccggcgttccccgtgtctnnngcggtttgtcg

SEQ ID NO: 21328 - DNA, 726 bp, Zea mays
  misc_feature: Ceres CLONE 1390397-F
  misc_feature: Encodes the peptide sequence at SEQ ID NO. 21329
  misc_feature (282)..(282): n is a, c, t, g, unknown, or other
  misc_feature (373)..(373): n is a, c, t, g, unknown, or other
  misc_feature (374)..(374): n is a, c, t, g, unknown, or other
atagctggagctccccgcggtggcggccgctctagaactagtggatcccccgggctgcaggaattcgcacgagaccattacctagaacatcctaaaaaaaaaaaacccccgtcctcctcgccgctccgccgcgcggttgagcgccgacgagcgagcccaccgctgcctcgtccgccctatggatatggatgtccgccgcagggttccaccgccgcacgggagcgtccctaggcgccagcaggcgaccggggccgagggggagcgggtgcgtgtgcaggcggntgatgcgctaccgctgccgatccggcacacgaacctcatcttctcggcgctgttcgccgcgtcgctggtgtacctgatgcgtcggtggcgnnggaagatccgcgcctccacgccgctccacgtggtctccccccgcgagatcttcgccatctgcgggctcgtcgcgtcgctcatctacctcctcagctttcttcgggatcgccttcgtgcagtccgtcgtctccagcagcgacgacgacgaggacttcatcggcgactcccgcacggggggggggggggcggccgcgacgcctgggcaaacccggtgggggctgttggggacccccgcggccgcgagggaaaaatgccggaggaggaccaggagattggggccggggttgtgggaagaaaaaccccgcctaagggctgggactaggctgggaaaatgcccccggcccccggaat

SEQ ID NO: 21329 - protein, 172 aa, Zea mays
  misc_feature: Ceres CLONE 1390397-F
  misc_feature: SWISSPROT Homolog: EC 1.1.1.34 Hydroxymethylglutaryl-CoA reductase (NADPH)
  misc_feature (35)..(35): Xaa is any aa, unknown, or other
  misc_feature (66)..(66): Xaa is any aa, unknown, or other
MDMDVRRRVPPPHGSVPRRQQATGAEGERVRVQAXDALPLPIRHTNLIFSALFAASLVYLMRRWRXKIRASTPLHVVSPREIFAICGLVASLIYLLSFLRDRLRAVRRLQQRRRRGLHRRLPHGGGGGGRDAWANPVGAVGDPRGREGKMPEEDQEIGAGVVGRKTPPKGWD

SEQ ID NO: 21330 - DNA, 721 bp, Zea mays
  misc_feature: Ceres CLONE 1390398-F
  misc_feature: Encodes the peptide sequence at SEQ ID NO. 21331
  misc_feature (501)..(501): n is a, c, t, g, unknown, or other
caaagctggagctccccgcggtggcggccgctctagaactagtggatcccccgggctgcaggaattcgcacgagaccattacctagaacatcctaatcaaaaaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgcgttctccgggtcggtgaacctcaagcacgtcaagctggggtaccagtacctggtgaaccacttcctgacgctgctgctggtgccggtgatggccgccacggcgctggagctggcgcgccctcgccccggcgagcggctctcgctgtggcgctcgctggagctggacctggtcacatcctctgctcggcgttcctggtcttctttcgtcgnaccgtgtacgtgatgtcgcggcccaggccggtgtacctgtgggaatacgccggctacagccccccgcagggtgccggggggccttcgccaccttcatggaggaacccggctcatcagggacgacaaaagaaggggggctccaaccaggatcgggagcgttcgggcctggggagggaagtgcctcccgcccgcaaacattaattccgcccacccccggggg

SEQ ID NO: 21331 - protein, 79 aa, Zea mays
  misc_feature: Ceres CLONE 1390398-F
  misc_feature: SWISSPROT Homolog: EC 2.3.1.119 Icosanoyl-CoA synthase
  misc_feature (76)..(76): Xaa is any aa, unknown, or other
MPSGSAFSGSVNLKHVKLGYQYLVNHFLTLLLVPVMAATALELARPRPGERLSLWRSLELDLVTSSARRSWSSFVXPCT

SEQ ID NO: 21332 - DNA, 670 bp, Zea mays
  misc_feature: Ceres CLONE 1390399-F
  misc_feature (243)..(243): n is a, c, t, g, unknown, or other
  misc_feature (277)..(277): n is a, c, t, g, unknown, or other
  misc_feature (315)..(315): n is a, c, t, g, unknown, or other
  misc_feature (327)..(327): n is a, c, t, g, unknown, or other
  misc_feature (345)..(345): n is a, c, t, g, unknown, or other
  misc_feature (351)..(351): n is a, c, t, g, unknown, or other
  misc_feature (514)..(514): n is a, c, t, g, unknown, or other
  misc_feature (591)..(591): n is a, c, t, g, unknown, or other
aaagctggagctccccgcggtggcggccgctctagaatagtggatcccccgggctgcaggaattcgcacgagaccattacctagaacatcctaatcgaaaacccgggatcctcgttttgtttcccttcccccacccttcctcttcctccctatctatcagcactgctcgccggcgccgcctctgcaaaagctcacttttgcctccggacccagcggaatccgccggcggaccggaaaactcgntcgcccccctcccccctgtctgcccgggcgtcgnagcgcgtcgcctccgggcgtgcagcaacagtccgtggnaggtgagcccgnaggaggaggaggaggacnaggacnaggcataatctgccgagagcgggacagcagggagtggctgctccgctcgcgctggagccaagctactgagtgccttgtcctgaccaggaaaagaggggatctttgggagcaatcaggaggggggttcggtttttggtaaaacaaaacctcaactccccttttnaaaggttttctgcaaacttttttgtttctaatttggaaaaaaaaaaaagggggccccttgtgggggtttgcccctcngaagggaaaaaaaaaaaggtgtttgtttttttttttttgttttctaggaaaggggggccccctaaaaaaataatttttt

SEQ ID NO: 21333 - DNA, 706 bp, Zea mays
  misc_feature: Ceres CLONE 1390400-F
  misc_feature: Encodes the peptide sequence at SEQ ID NO. 21334
  misc_feature (249)..(249): n is a, c, t, g, unknown, or other
  misc_feature (253)..(253): n is a, c, t, g, unknown, or other
  misc_feature (499)..(499): n is a, c, t, g, unknown, or other
  misc_feature (500)..(500): n is a, c, t, g, unknown, or other
  misc_feature (504)..(504): n is a, c, t, g, unknown, or other
  misc_feature (626)..(626): n is a, c, t, g, unknown, or other
  misc_feature (667)..(667): n is a, c, t, g, unknown, or other
  misc_feature (695)..(695): n is a, c, t, g, unknown, or other
caaagctggagctccccgcggtggcggccgctctagaactagtggatcccccgggctgcaggaattcgcacgagaccattacctagaacatcctaatcaaaaaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcggncggnaagcagcagcaggcgggcgacatgccgagcggcagcgcgttctccgggtcggtgaacctcaagcacgtcaagctggggtaccagtacctggtgaaccacttcctgacgctgctgctggtgccggtgatggccgccacggcgctggagctggcgcgcctcggccccggcgagctgctctcgctgtggcgctcgctggagctggacctggtcacatcctctgctcggcgttctggtcttcttcgtcgnnacgnggtacgtgatgtccggcccaggcccgtggtacctggtggactacgcctgctacaagcccccccgcaggtggcgcgtgcccttcgccacttcatggagcacacgcgcctcatcagcgacgacnaacagagggggcgctccagacaggatcctggacgctcgggnctcggggaggaacgtgcctcccgcccgncaacattactc

SEQ ID NO: 21334 - protein, 144 aa, Zea mays
  misc_feature: Ceres CLONE 1390400-F
  misc_feature: SWISSPROT Homolog: EC 2.3.1.119 Icosanoyl-CoA synthase
  misc_feature (76)..(76): Xaa is any aa, unknown, or other
  misc_feature (77)..(77): Xaa is any aa, unknown, or other
  misc_feature (118)..(118): Xaa is any aa, unknown, or other
  misc_feature (141)..(141): Xaa is any aa, unknown, or other
MPSGSAFSGSVNLKHVKLGYQYLVNHFLTLLLVPVMAATALELARLGPGELLSLWRSLELDLVTSSARRSGLLRRXXVRDVRPRPVVPGGLRLLQAPPQVARALRHFMEHTRLISDDXQRGRSRQDPGRSGLGEERASRPXTLL

SEQ ID NO: 21335 - DNA, 647 bp, Zea mays
  misc_feature: Ceres CLONE 1390402-F
  misc_feature: Encodes the peptide sequence at SEQ ID NO. 21336
aaagctggagctccccgcggtggcggccgctctagaatagtggatcccccgggctgcaggaattcgcacgagaccattacctagaacatcctaatcgaaaagccgacgcttcccaactccttccaatcgattcttcgtctcgtcctcgtgtaatccccagcttgccctcctcgctcttccctcccaaaaccctacgcctccctgaccaagctccggggacgaatggacggaggagccggcttccctggcacgccggtcccgcgcttcgccggagggacgtttttccggggaactaaccggggggggggccaaggggccggggcctaataaataagggggggggcctctccccccccggggtggggggggaaaaaaaatttttttttctggggggggcccccccaaaaaaaaaaattggggtggtagggggcccccccggggggggggggggaaaaaatttcgcggggggggggggcctctttataaaaaaaaaaaagggggggggaaaaaaatttttttcccgggggggggggaaaaaaaaaaaatatttttttttttttttttgggagaaaaaaaggatttttcgggaggggggggggggttttttttttttgtgggggggggggggggggaacaaacaaacaaaa

SEQ ID NO: 21336 - protein, 34 aa, Zea mays
  misc_feature: Ceres CLONE 1390402-F
MDGGAGFPGTPVPRFAGGTFFRGTNRGGGQGAGA

SEQ ID NO: 21337 - DNA, 758 bp, Zea mays
  misc_feature: Ceres CLONE 1390403-F
  misc_feature: Encodes the peptide sequence at SEQ ID NO. 21338
  misc_feature (443)..(443): n is a, c, t, g, unknown, or other
  misc_feature (505)..(505): n is a, c, t, g, unknown, or other
  misc_feature (577)..(577): n is a, c, t, g, unknown, or other
  misc_feature (687)..(687): n is a, c, t, g, unknown, or other
  misc_feature (689)..(689): n is a, c, t, g, unknown, or other
  misc_feature (690)..(690): n is a, c, t, g, unknown, or other
  misc_feature (705)..(705): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (725)..(725): n is a, c, t, g, unknown, or other
  misc_feature (729)..(729): n is a, c, t, g, unknown, or other
  misc_feature (730)..(730): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
aaagctggagctccccgcggtggcggccgctctagaactagtggatcccccgggctgcaggaattcgcacgagaccattacctagaacatcctaatcgaaaaagtgccaccactcgccagctcgccacttcctcccgtctcctcccttgcagaggcggcgcgtaaaccccgatggccgcctctctcctccacgccgccgccgccgccgcctcgctcctgagctccacccagcacgcccgcgcgggtgccgccgcctttcaccccctcgcgtgtgccccatccctacgccttacgcgctcctcgttctcgaccaatcgccacctcgagatttcactccgggcgatctcggccagcgcccgtttccgcgggggaggggggcaccccgggaccgccgcgttgtcgccgccctagcgggggagcaaaccgagggttcagagggtggnggatgacagaaacggggagataaagcccgaggaagctcaggaaatttggaaggtaatgctgnagcagttcaaggctgaagccctgcggatgcaggccctggtcatgcaggcttatgatgtctactccgagaggnacgagggaggtcttgctggaagcatcagagaagctgaagatacaggcagacaaagcacagagggacctgagcgtggtagctaccgaatttggtcagaggaagaaattttngnntggggggggggggcntctnnnnnnnnnnnnnnntntgtnngggggatttnnnnnnnngggttgggggt

SEQ ID NO: 21338 - protein, 79 aa, Zea mays
  misc_feature: Ceres CLONE 1390403-F
MAASLLHAAAAAASLLSSTQHARAGAAAFHPLACAPSLRLTRSSFSTNRHLEISLRAISASARFRGGGGHPGTAALSPP

SEQ ID NO: 21339 - DNA, 730 bp, Zea mays
  misc_feature: Ceres CLONE 1390405-F
  misc_feature: Encodes the peptide sequence at SEQ ID NO. 21340
caaagctggagctccccgcggtggcggccgctctagaactagtggatcccccgggctgcaggaattcgcacgagaccattacctagaacatcctaatccaaaaagaggctggcgcacctgcgtcactcgctccgcgctgccgcgatctcctctgacgtcgaagtcgcccgggggatgacacagggggaaggggtggtgtgggaggggtgaacaggagctcggtgacttttgtgaggggcgcctgatggaggagcgccggctcgacacgccggcgatgaggagaatcagcgagtggtatatacgttcctagcttctcctaccttccctcctgcgtctccttgctctacttttcattaattggcatgtcgctgctgctgtttcgcatttgattcgacgagttcgtgtccgtaaccggcgccgctgatagcttgttcagtccgattttgaactggaaacaaacagctatcgtcattaagctagcaacacgtgacctgtgctttcagatctttccggtctttaccggtggaacggtcggtctagccaaaccctgcaattgaagttttgcggggttggaggggggtccttttgttcgcttggtggtggaggattctttccctaaggttccaggggatttaccattcggggtggggagggggctttaatttgaacaagtcccgtgggttcgagggggtgtaaaaggggagggtgggcgggaataagggttccgggc

SEQ ID NO: 21340 - protein, 58 aa, Zea mays
  misc_feature: Ceres CLONE 1390405-F
KAGAPRGGGRSRTSGSPGLQEFARDHYLEHPNPKRGWRTCVTRSALPRSPLTSKSPGG

SEQ ID NO: 21341 - DNA, 719 bp, Zea mays
  misc_feature: Ceres CLONE 1390406-F
  misc_feature: Encodes the peptide sequence at SEQ ID NO. 21342
  misc_feature (558)..(558): n is a, c, t, g, unknown, or other
  misc_feature (569)..(569): n is a, c, t, g, unknown, or other
  misc_feature (637)..(637): n is a, c, t, g, unknown, or other
  misc_feature (683)..(683): n is a, c, t, g, unknown, or other
  misc_feature (691)..(691): n is a, c, t, g, unknown, or other
aagctggagctccccgcggtggcggccgctctagaactagtggatcccccgggctgcaggaattcgcacgagaccattacctagaacatcctaatcgaaaaacgagtcggatacccgaacctcggcggcgtcggcgcacgggagcaaaaaccctagtgcgagcaagcgagagaggcagagacctcagtgcctcgagcaacgcgcgcccggcccgacggcatggagagcctcgtcctcgcctcctcctgctccgcgtccccacggctcccgctactctcctcctccgctcgcttccgcgggctgcccggttccgtgccgccgccgtcttcggcgtccatcggcggtgccgcgaggaaagggccgatgaggcccaggctcttcgttgccgcggcggcggctcctcgcggctcaggaaacgttttcgagggattgagagcaaaatgctttgcaagcatgtcatcttcgactggcaatgagaatatgtctactggaactggtacactacctcccatggcacccacatcatcatatattggttcacctggtgtctggattggnagtttgtgtancattgtctgtggcgtttaccacggtctcttccatgttaaagagatatggcatgcaccaagcatttaangtcatgatgacccagtcagcaccaaactcatttggctcccactcgnctttcccnatttagcatgccgccacaggcatctcct

SEQ ID NO: 21342 - protein, 138 aa, Zea mays
  misc_feature: Ceres CLONE 1390406-F
  misc_feature (117)..(117): Xaa is any aa, unknown, or other
MESLVLASSCSASPRLPLLSSSARFRGLPGSVPPPSSASIGGAARKGPMRPRLFVAAAAAPRGSGNVFEGLRAKCFASMSSSTGNENMSTGTGTLPPMAPTSSYIGSPGVWIGSLCXIVCGVYHGLFHVKEIWHAPSI

SEQ ID NO: 21343 - DNA, 664 bp, Zea mays
  misc_feature: Ceres CLONE 1390407-R
  misc_feature: Pfam Name: DUF563 Pfam Description: Protein of unknown function (DUF563)
acgattgggtaccgggccccccctcgaggtcgacggtatcgatagaagtcgtggaacagattcccagtgtagcctgtcagggaaaagatcacagcaggcacgtcatggtacttgactgcactcgggggccactttgcttgattttaccggcagctctgggatatggctaaagcagaactcgtcccctttccgagggtaacgggttgattttccacagctcatctcctctgcgaatgcccaggctccatgagcatgattgatgcagcatttgggtgaactctaacgtcaccacgcatctcgcacacgtttgctctgaaatttgagaagtcgcacaggggcttgctcccctgctggtcataacttgtatcggctagcttggcactttgggtgtcctcggtgtcatgaatagtgtagttggaaacggttgggagcgtcactttatgcttctccgagacgtgaccgcgctcctccttacttttccctcgcagtactacgccgctagcacttcctcgtgatttacgacgctgcgtacttgtctgggacagtacatcatccgctggcgggactgctcgttcataaccgatttcttcccctcggcttgaccccttgagcttgggacgcctctaaaacaaccccccggggccccaaaaaggtggctttaaaa

SEQ ID NO: 21344 - DNA, 726 bp, Zea mays
  misc_feature: Ceres CLONE 1390407-F
  misc_feature (410)..(410): n is a, c, t, g, unknown, or other
aaagctggagctccccgcggtggcggccgctctagaactagtggatcccccgggctgcaggaattcgcacgagaccattacctagaacatcctaatcgaaaaataggtcacgaagtccgccttctctctctctataacccactgacagccacctctgcgaccgtcgtgaccactcgccaagtaaatattcttccaccaacatgactacgcctcgacctctgcctcggcgccgcatccatctgccggacgcgccagctatgacgcctgcgccgcggctcaagcgctccaccacgcagaccatcaatctgacgccgcacgacacgaggctggatgtcaacgatgtcaagttgtcactatcgcgtcctaccgcgcgtgttgtcgttctctaaaaaagggagtccgcgacgcgncttctgagggcttctggcactgtaggagtgtacaccactcttgcagctacgccagaagggaaaaaccgcaaatggagtaccagaccggcccatcccaagggggccgccgcaagaactcggggggcccggcttctgtccatcggcggagattaatgcgcctccccagaactttggggggactgaaaggccaaataaaactgtccccccttaaaagaaaatttgggggggggaggggctccaaaattttttttttaccacaaaagggtaattccccccccccaccccgttgtggaactctccccacaccctggggggg

SEQ ID NO: 21345 - DNA, 730 bp, Zea mays
  misc_feature: Ceres CLONE 1390408-F
  misc_feature: Encodes the peptide sequence at SEQ ID NO. 21346
  misc_feature (534)..(534): n is a, c, t, g, unknown, or other
  misc_feature (725)..(725): n is a, c, t, g, unknown, or other
  misc_feature (730)..(730): n is a, c, t, g, unknown, or other
aaagctggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagcccttgctgccggcgctgatgtgtccatgattggccagntcgcggcgtcggtttctactctgcctacctcgtcgccgattggagttgtcgtgaccaccaagcacaacgatgacgagcagtacggtgtgggagtccccagcgggggcggggtcgttcacttgttactcgtggacacgtcaggggagccaagcttggcagggggcactaaagatcacactgttcctttaggnacgan

SEQ ID NO: 21346 - protein, 186 aa, Zea mays
  misc_feature: Ceres CLONE 1390408-F
  misc_feature (122)..(122): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQXAASVSTLPTSSPIGVVVTTKHNDDEQYGVGVPSGGGVVHLLLVDTSGEPSLAGGTKDHTVPLGT

SEQ ID NO: 21347 - DNA, 710 bp, Zea mays
  misc_feature: Ceres CLONE 1390410-F
  misc_feature: Encodes the peptide sequence at SEQ ID NO. 21348
  misc_feature (589)..(589): n is a, c, t, g, unknown, or other
  misc_feature (618)..(618): n is a, c, t, g, unknown, or other
  misc_feature (691)..(691): n is a, c, t, g, unknown, or other
  misc_feature (698)..(698): n is a, c, t, g, unknown, or other
aaagctggagctccccgcggtggcggccgctctagaactagtggatcccccgggctgcaggaattcgcacgagaccattacctagaacatcctaatcgaaaagcgatccccgtaattaacctgtcccagccgcaccgatccaccccccctcggcctcggcctcggcctccctccggccatggaggtgttctactacgtcgtgttcggcgcgctggccgccgtcgtggcggggctcgagctcggcaagagcggcaaggaccgcgtcgccaccacctccgccttcaactccttcaagaacaactacgtcctcgtctactccctcatgatgtccggggactggctgcagggcccctacgtctactacctctacagccagtatggcttcgacaagggcgacatcggccgcctcttcatcgccggcttcggatcctccatgctcttcggcaccatcgtcggctccctcgccgacaaacagggccgcaagagggcctgcgtcacctattgcatcagctacatcctcagctgcatcaccaagcactcccccgagtacagggtcctcatgatcggccgcaatcctcgggggcatcgncacctcgctgctcttctcccgcttcgagntctgggctcgtcgccgagcacaaacaagagaggttttgaccccgcaggtggctggtcataacattctccaagncatcttnccttggaacggt

SEQ ID NO: 21348 - protein, 166 aa, Zea mays
  misc_feature: Ceres CLONE 1390410-F
  misc_feature (4)..(165): Pfam Name: DUF791 Pfam Description: Protein of unknown function (DUF791)
  misc_feature (147)..(147): Xaa is any aa, unknown, or other
MEVFYYVVFGALAAVVAGLELGKSGKDRVATTSAFNSFKNNYVLVYSLMMSGDWLQGPYVYYLYSQYGFDKGDIGRLFIAGFGSSMLFGTIVGSLADKQGRKRACVTYCISYILSCITKHSPEYRVLMIGRNPRGHRHLAALLPLRXLGSSPSTNKRGFDPAGGWS

SEQ ID NO: 21349 - DNA, 750 bp, Zea mays
  misc_feature: Ceres CLONE 1390414-F
  misc_feature: Translation starting site: 157
  misc_feature (182)..(182): n is a, c, t, g, unknown, or other
aagctggagctccccgcggtggcggccgctctagaatagtggatcccccgggctgcaggaattcgcacgagaccattacctagaacatcctaatcgaaaaaaaagccgaaagcccgaaaccagaggcgggtagggttctagctgcaggcgacggccatggccgcctccgccgccgccccggngctgcttcgacgcctcttctgcagctctattccagcctcctcctccgtactgcgcgctaccttttgctcctcccgcggcttcggctcgtcttctccgtccctcatattcggcgacgccacccgaggtcgccacgtgccaccggtcaccacgcccaacctcttcgtcagtggcctttcaaggttaacgacagatgagaggctccagggtgcatttgctcctttcgggaggctccttgaagcaaaagtggtgacggatagaggtttctggaggtcaaaggggtttcggtttcgtgagatatgccaccatagaagaggccgagagagcgcggaaggagatgaccgccaagtccctgggatggatgggtcatctttcgttggaccctgccaagcaagggaagccaagccccgctcctcaggaaggaactgggttcatccgagggctggctccaccacaaaacaagaattggagggatggggcggcttaggcttcattgatccggtccggaaattttcccgggcccaaaactttggattaagggtggcaagcttttacttaaagtggaagggg

SEQ ID NO: 21350 - DNA, 719 bp, Zea mays
  misc_feature: Ceres CLONE 1390415-F
  misc_feature: Encodes the peptide sequence at SEQ ID NO. 21351
  misc_feature (184)..(184): n is a, c, t, g, unknown, or other
  misc_feature (394)..(394): n is a, c, t, g, unknown, or other
  misc_feature (424)..(424): n is a, c, t, g, unknown, or other
  misc_feature (431)..(431): n is a, c, t, g, unknown, or other
  misc_feature (685)..(685): n is a, c, t, g, unknown, or other
aaagctggagctccccgcggtggcggccgctctagaatagtggatcccccgggctgcaggaattcgcacgagaccattacctagaacatcctaatcgaaaaaattttctcagtctcgagcgcccgcgtccctcgccccgtcgcgactcgcgacttcgcgagtcgccccgtcccagcctcccagncgtcccggctccccgcgaccccgccctccgggagtccggggcgggggctcctctcccgatcggtgagccgaacgaggatcccaactccccgaagaaagcgccacagccagaggcagggtggctcggctctcctctcacagactgcggcgcagcgcctagcgctcggctgggagcggctcgggcggtcggccccgggcccccgcccctggntgctacatcggcctggaggcagagatctgncctcagngaccgccctggctgcccttggtgctcctggggttctgcacacaacacacgcattttgccccaaacaagggggggggggatgagaatctcaaaagaccttccccgggaaggaattgacggggaggaggagttctccttcagcgggggaggacctcatcccacgaaataaccatctcaagaaaaatatccccccggaccggaaaaaaaaaaaaggaggaactcctccaaggggatggttaattcccaaagacggcnaatgattccacaatacgaatttaaggggcaacag

SEQ ID NO: 21351 - protein, 29 aa, Zea mays
  misc_feature: Ceres CLONE 1390415-F
MRISKDLPREGIDGEEEFSFSGGGPHPTK

SEQ ID NO: 21352 - DNA, 659 bp, Zea mays
  misc_feature: Ceres CLONE 1390427-F
  misc_feature: Encodes the peptide sequence at SEQ ID NO. 21353
  misc_feature (497)..(497): n is a, c, t, g, unknown, or other
  misc_feature (502)..(502): n is a, c, t, g, unknown, or other
  misc_feature (503)..(503): n is a, c, t, g, unknown, or other
  misc_feature (511)..(511): n is a, c, t, g, unknown, or other
  misc_feature (526)..(526): n is a, c, t, g, unknown, or other
  misc_feature (650)..(650): n is a, c, t, g, unknown, or other
ggagctccccgcggtggcggccgctctagaactagtggatcccccgggctgcaggaattcgcacgagaccattacctagaacatcctaatcgaaaaataaagattactcatagattaaagtagggtttggacgtctgcctgtccatttcggcgtctgttcttagcggccgacaagcggaatctggatcaagtcccctgcttcaacccatcccctctcatcgattcattgccacaaggcagctgattgctcacagcgttggatgtgagaattggattcggacccaccgatcgatatgccgttcggccacacgcggctcgatgtccggcgtccgccgcagtcgtcctacctctgctgctccacaaccaccgtcgccgtattcgtcgcgctctgcctggtggctgtgtggatggcgtcgtccatgctcgtcacccctgcccgagtccctccatttcagtcccaagtgcgtcccactgaggctcatgactctcctcctggncacgnnaagcttancagtgctgatcaggncgatggcatcaccacccatgatgatccaccacctgctacacaacattttgctctgtaccagacagcatggatggggaaaatcagcacagaacttttcactacagagcgcggaccatggtcaacnaggctgaaa

SEQ ID NO: 21353 - protein, 122 aa, Zea mays
  misc_feature: Ceres CLONE 1390427-F
  misc_feature (70)..(70): Xaa is any aa, unknown, or other
  misc_feature (73)..(73): Xaa is any aa, unknown, or other
  misc_feature (78)..(78): Xaa is any aa, unknown, or other
MPFGHTRLDVRRPPQSSYLCCSTTTVAVFVALCLVAVWMASSMLVTPARVPPFQSQVRPTEAHDSPPGHXKLXSADQXDGITTHDDPPPATQHFALYQTAWMGKISTELFTTERGPWSTRLK

SEQ ID NO: 21354 - DNA, 652 bp, Zea mays
  misc_feature: Ceres CLONE 1390433-F
  misc_feature: Encodes the peptide sequence at SEQ ID NO. 21355
ggagctccccgcggtggcggccgctctagaactagtggatcccccgggctgcaggaattcgcacgagaccattacctagaacatcctaatcaaaaagaggaagttcagttccgtgccgtgctcgcgcgcacccaccccgcacgccgcatgccgccttactccgcgctgctgctgctgctgggacgaagaaaatcttttccttcacctttctctcctctttcccagttcatgcacgggctctgattgacgccatgggggatgccgccgccgccgcaacggcctccacgtccgctcccgccacgcccacctccatcctcatctgcctggaggacggcagcgaccttctctccgacgcctacgatggcgccggcgccaccgacttcgtcgtcgcccgcgacgagcatctgcttgtcgaggaccaggacgaggagtacgtcgcgctgctcctgtccaaggagagcgcggcagtatgcgccccggcggaggaggaaacggaggagtggatgaagaccgcacgctccggatgcgtccgctggatcatcaagaccacggcgatgttcgggttcggcgggaagaccgcgtacgtcgcagtgacttacctcgatcgcttcctggttcaacggcgagtcaatagggggaacgagtgggcttt

SEQ ID NO: 21355 - protein, 133 aa, Zea mays
  misc_feature: Ceres CLONE 1390433-F
MGDAAAAATASTSAPATPTSILICLEDGSDLLSDAYDGAGATDFVVARDEHLLVEDQDEEYVALLLSKESAAVCAPAEEETEEWMKTARSGCVRWIIKTTAMFGFGGKTAYVAVTYLDRFLVQRRVNRGNEWA

SEQ ID NO: 21356 - DNA, 636 bp, Zea mays
  misc_feature: Ceres CLONE 1390436-F
  misc_feature: Encodes the peptide sequence at SEQ ID NO. 21357
gctctagaactagtggatcccccgggctgcaggaattcgcacgagaccattacctagaacatcctaatcgaaaataccgcctgatccaccgcggtttgcttgccgcgagcatggaaattattagtcattcgacaagtcagagagattttatttcctctcgtcgtctcgtggccgctggtgcccgcgcgtcagatttggcctgctccgctccgcctccgcagtgtgaatttctgagagataggtttctgtgctgcagacagcccggcggcgacgcggtggcagtttgcggcgaggtccggcgtcgcgccggcgttcatgtcgttcaggacggaggcgacgggcgagggctctgaggcgttctcggtctccgagctccggccggccggagacgccttcgacggcatcaagaagcagagctccatgctttcgatctaccagcagaggcagtttggccacaacagcagccaggccacggcacagcagcagtaccctgcagcggcgcacaggcagcgctcgcaggtggcggattacggcgcggcggcaccgcatcgtctccctggtggtggtggtggtggatgcaggctagtgcagccggtgtcggtgcgccaccctgtgccgttccatcaggccaacctg

SEQ ID NO: 21357 - protein, 107 aa, Zea mays
  misc_feature: Ceres CLONE 1390436-F
MSFRTEATGEGSEAFSVSELRPAGDAFDGIKKQSSMLSIYQQRQFGHNSSQATAQQQYPAAAHRQRSQVADYGAAAPHRLPGGGGGGCRLVQPVSVRHPVPFHQANL

SEQ ID NO: 21358 - DNA, 630 bp, Zea mays
  misc_feature: Ceres CLONE 1390437-F
  misc_feature: Encodes the peptide sequence at SEQ ID NO. 21359
gctctagaactagtggatcccccgggctgcaggaattcgcacgagaccattacctagaacatcctaatcaaaaaattaatttccagggatgcacgcaggcaagtttaatttggaggatcaatggtagctagctagagctactagagacatacatggcggatcctctggtgcgagcgcgacccaaaaggaagaaggtcttagcggactacttggtgcgactccgatggattcctgccctcttcgtggcccttccaatatctgcgctgatctacctgagcgtcttcctggggaacacgtggtccgccatgaaatccgagaagcgtcgacagaaggaacaccaggagaacgtagagaggctgagagggtcgtgaagcgtctcaaggagagggatccgaagagggacggcctcgtctgcaccgcgaggaagccatgggtggtcgtgggcatgcgcaacgtggactacaagcgcgccagacgcttcgaggtcgacctctccgcgttgaggaacatcctcgagatcgacgcggagaggatggtcgccagggtggagtctctcgtcagcatggcccagataaccaaggctacctgccccatgaacctctcgctcgccgtggctcctgagttggacga

SEQ ID NO: 21359 - protein, 135 aa, Zea mays
  misc_feature: Ceres CLONE 1390437-F
MDSCPLRGPSNICADLPERLPGEHVVRHEIREASTEGTPGERREAERVVKRLKERDPKRDGLVCTARKPWVVVGMRNVDYKRARRFEVDLSALRNILEIDAERMVARVESLVSMAQITKATCPMNLSLAVAPELD

SEQ ID NO: 21360 - DNA, 638 bp, Zea mays
  misc_feature: Ceres CLONE 1390443-F
  misc_feature: Encodes the peptide sequence at SEQ ID NO. 21361
cgcggtggcggccgctctagaactagtggatcccccgggctgcaggaattcgcacgagaccattacctagaacatcctaatcaaaaatcatcacaggcaacaaggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgagaggacgacgacgacgaggcgtataaatataatagcagcgtctaaataagatcctgtcaactgcacccgccattatcgatccatggtcgctcctggggttcatgttcatctgtgtaacgtgctcgcggtcatgtccgtctcgtgccggaattaatatttatatgcatgtatttgtgtttttctg

SEQ ID NO: 21361 - protein, 80 aa, Zea mays
  misc_feature: Ceres CLONE 1390443-F
  misc_feature (1)..(79): Pfam Name: Metallothio_2 Pfam Description: Metallothionein
MSCSSGKCNCGSSCSCGSSCNCMSPDVETAAASSIKTMVLAAPTTKASAGGFEAATEGGGCDCNTCNCGTSCGCSCCSCN

SEQ ID NO: 21362 - DNA, 646 bp, Zea mays
  misc_feature: Ceres CLONE 1390445-F
  misc_feature (341)..(341): n is a, c, t, g, unknown, or other
  misc_feature (343)..(343): n is a, c, t, g, unknown, or other
  misc_feature (345)..(345): n is a, c, t, g, unknown, or other
  misc_feature (348)..(348): n is a, c, t, g, unknown, or other
  misc_feature (351)..(351): n is a, c, t, g, unknown, or other
aagctggagctccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaaccctaaccgccgacggtggccatgatggccaccgagcccttgtccccgggaatctcgtcgaggacgtcgaaacactacccctgaactcctcctcactctcgcggtacgacgancngntgntcngcaaactcccccctcgtcaccttttctccaacccggtgaaaaccatggcgttttctggacaagaaaataagactggtggatagaatcaccctcccctggtcccatgcccataaggcggaaaaatcccccgggggtcccccgtgtcccgaaaaaacggtccccaaccaaaaaaacacgggcccccccccggggcggggggtttttccccgtggggagaaaaattcccccccccccccccccgggggcccccaaaaggaaaaccccccggcgggaaaattaaccgaggaagggggcc

SEQ ID NO: 21363 - DNA, 666 bp, Zea mays
  misc_feature: Ceres CLONE 1390450-F
  misc_feature: Encodes the peptide sequence at SEQ ID NO. 21364
tccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcctgcgtccgagcgagcgggtcgaggtacggcggaaccgctacaaggtggcggttcacgcgtaggaggggcggcggcggcgcgaggacaatatggtggagatccgcaagagccgccgtgaggagagcctcctcaaagaggcgcgtgaggggctccaagcccagttccctgcccctcccctccgggccaagaaaagcttgaaagcctcccagctattgggtaggggggttaattcggatgaaaatacccttcacttgtaggccccccccagttccccaaattggctccaaaagaaaggagccccccctcgaaaaattatcaaaaccgggggaatcccaaaatttgggagcccctccccaaaaaagattccccccaccggaatttgaaaactggggggccccccaaaaattgtt

SEQ ID NO: 21364 - protein, 55 aa, Zea mays
  misc_feature: Ceres CLONE 1390450-F
MVEIRKSRREESLLKEAREGLQAQFPAPPLRAKKSLKASQLLGRGVNSDENTLHL

SEQ ID NO: 21365 - DNA, 693 bp, Zea mays
  misc_feature: Ceres CLONE 1390454-F
  misc_feature: Encodes the peptide sequence at SEQ ID NO. 21366
cgcggtggcggccgctctagaactagtggatcccccgggctgcaggaattcgcacgagaccattacctagaacatcctaatcgaaaagtctctccccacagggaaccgccgcccgtcgcctccagatacgtgcctccggcggaaaatcggtatcgagctcgctttgttcgaatcttctgtatagccagcaaggaggcctctccatctcctccgggaaggctgtgcagcaatggagaagtataacagcaagactcagttagcacccttgagagataccccatttgctctccgtggtgctcttggtagttcaagctcataccttgagcaagccaggggctacacgtcttcccctctagcagctctgcgaccaaagatgtcttctactaatggaaatcgactcctgcactcgagttggccccctggcttctccttggaaaaaaccgcccggtggccccccccccttccctttgaaaaagccaaaggtcaagggggaattttctaaactccaaatagaaaaatccgggggcccggggtggaaagtgccactgtattttggtcccccccccccccacaattccccccaaattttttgggtgtaagaaaaaaatttttctcccccccacaagagaaaaaaccttttttccgggttttgggggggggttttttccccccgcgcggaaaatctcgggaaaa

SEQ ID NO: 21366 - protein, 90 aa, Zea mays
  misc_feature: Ceres CLONE 1390454-F
MEKYNSKTQLAPLRDTPFALRGALGSSSSYLEQARGYTSSPLAALRPKMSSTNGNRLLHSSWPPGFSLEKTARWPPPLPFEKAKGQGGIF

SEQ ID NO: 21367 - DNA, 629 bp, Zea mays
  misc_feature: Ceres CLONE 1390458-F
  misc_feature: Encodes the peptide sequence at SEQ ID NO. 21368
tcttaactagtggatcccccgggctgcaggtattcgcacgagaccattacctagaacatcctaatcgaaaaaaaaacgcaactgaaaaacctcgtctacattcgcatctaggcgcccctccacctcgttccgatccagctcgccggcgcccggcggccatgtcgcagcccacggcggcggtggccgcggaggcgcagccgcagggtcgcggcctcgcggggcgccaggccggcggcggcggccttgggcagagcatctctggtatcgtgcggctggcggtgttctggtacttcgcggccaacttcttcggccccaagtgcccgcccgcggaccccgggattctcatgtccaacctcttccagaagggcgagccaatgtatatgcggatgtatttatcacagagtgacaagttcaacgattttgctaatgaggacgcacttatttggcatgaggcaaacataccatacgcccccatggggacctaccagtactagaacatggttattaacatactacgcttcacaggctctcaagcataatggatctttgtatgctcatgtttactttgcccgctccggctaccctgtggacccacagatcctgaatatgaggagacatctgcatttgag

SEQ ID NO: 21368 - protein, 111 aa, Zea mays
  misc_feature: Ceres CLONE 1390458-F
MSQPTAAVAAEAQPQGRGLAGRQAGGGGLGQSISGIVRLAVFWYFAANFFGPKCPPADPGILMSNLFQKGEPMYMRMYLSQSDKFNDFANEDALIWHEANIPYAPMGTYQY

SEQ ID NO: 21369 - DNA, 626 bp, Zea mays
  misc_feature: Ceres CLONE 1390463-F
  misc_feature: Encodes the peptide sequence at SEQ ID NO. 21370
gagctccccgcggtggcggccgctctagaactagtggatcccccgggctgcaggaattcgcacgagaccattacctagaacatcctaatcgaaaaatcgatcgatcgaccaagaattgcctgagcacgcaggtggacgcaagagaagctcgccgttggcggccaccgggaagagaagttcgatacctcaccagcctgcgcgcacggaacaatggcgcacgcgaaggccgtcgccgtcctcggcgccgtggtgatcgcgtcgctcctcctcgcggctgagagccgccacattgcccgaaaagacctgggcgtcggccttggtgggggcggcagcggcggcggtggcggcagcctcggtgtcggcacgggtggtggcgtcggggttggtacaggcggcggacttggggttggcacgggtgccgggctgggtgtcggctcagggatcggcgccgcgccggcggtggcggctcagggcccgggtctaactcgggctccgggtccggtccgtggcaaggttcaggctccggggtctgggcgctccaggcctcatcgggtgggttccttaggttgaaaaaaagaatcccgggcaaaaaccgaaggccccccttgccccgtgggtgcaccaaa

SEQ ID NO: 21370 - protein, 119 aa, Zea mays
  misc_feature: Ceres CLONE 1390463-F
MAHAKAVAVLGAVVIASLLLAAESRHIARKDLGVGLGGGGSGGGGGSLGVGTGGGVGVGTGGGLGVGTGAGLGVGSGIGAAPAVAAQGPGLTRAPGPVRGKVQAPGSGRSRPHRVGSLG

SEQ ID NO: 21371 - DNA, 656 bp, Zea mays
  misc_feature: Ceres CLONE 1390465-F
  misc_feature: Encodes the peptide sequence at SEQ ID NO. 21372
  misc_feature (379)..(379): n is a, c, t, g, unknown, or other
  misc_feature (575)..(575): n is a, c, t, g, unknown, or other
  misc_feature (576)..(576): n is a, c, t, g, unknown, or other
  misc_feature (579)..(579): n is a, c, t, g, unknown, or other
ggagctccccgcggtggcggccgctctagaactagtggatcccccgggctgcaggaattcgcacgagaccattacctagaacatcctaatcgaacaagcaatactcactcctagtcctggagtatagtcactactacccctagaagggaagcgcatccgctcgatacggggggtggcaggttgtcgaggagacgaaaggcacggcgagcgagagcccaacgaccgtccagttccagttccagcggtccgagcgagatcgatcgcccctccgcaaggccgcaacaacagacgcggcaagcgggtacaagggagttcttctggaggcgcgggagatcacgcgagtgtgttgcgcttgaaagaagaaaaaaacaggcagggnaggagggagtcccgttcccgaacccgaactacaagcccacgcaactgctgctgccgccgcccgcccaggaggagcgagggcattgcccggacccatcgccgtcgcggccgtcgccgtcaccgcgctgcaggtagaggaggacggcgccggtcagcatggtggggtacgagctcgcaggaattggacaacgcggtannacnagattcaagagaacaacagtgattttgagaacgtcttcctctctaggggggaggaatcgagctctttcgttggattt

SEQ ID NO: 21372 - protein, 40 aa, Zea mays
  misc_feature: Ceres CLONE 1390465-F
  misc_feature (14)..(14): Xaa is any aa, unknown, or other
MVGYELAGIGQRGXTRFKRTTVILRTSSSLGGRNRALSLD

SEQ ID NO: 21373 - DNA, 647 bp, Zea mays
  misc_feature: Ceres CLONE 1390466-F
  misc_feature: Encodes the peptide sequence at SEQ ID NO. 21374
  misc_feature (415)..(415): n is a, c, t, g, unknown, or other
  misc_feature (600)..(600): n is a, c, t, g, unknown, or other
  misc_feature (605)..(605): n is a, c, t, g, unknown, or other
tggagctccccgcggtggcggccgctctagaactagtggatcccccgggctgcaggaattcgcacgagaccattacctagaacatcctaatcgaaaaaggatcggggatcggagcttgtgctgctactgctactataccagcgctagctagcagcagccgccggccggctcgcgcaagctaaggaagggtcgacatgacgatggggctccgcgtccgcgactcctccgcgctgctggctctggccgtcgcgctcgcctgctgctccgttgcagtggtggcctacgaccccctggacccgaacggcaacatcaccatcaagtgggacgtgatctcgtggacgcccgacgggtacgtggcgatggtgacgatgagcaactaccagatgtaccggcacatcatggcgcccgggtggangttgggggtggtcgtgggccaagaaggaggtgatctggtccatcgtggggggcgcaggccacgggagcagggggactgctccaagttcaaggggcggcatcccgcactgctgcaagcgcacccccggccgtggtggactccctccccgggggtgccctacaaccagcagatcgccaactgctgcnagggncggcgttgggtgtccgccgtacgggcagggaaccgggggggg

SEQ ID NO: 21374 - protein, 151 aa, Zea mays
  misc_feature: Ceres CLONE 1390466-F
  misc_feature: The sequence is a functional homolog of SEQ ID NO 4 in US patent 7109001
  misc_feature (74)..(74): Xaa is any aa, unknown, or other
  misc_feature (136)..(136): Xaa is any aa, unknown, or other
MTMGLRVRDSSALLALAVALACCSVAVVAYDPLDPNGNITIKWDVISWTPDGYVAMVTMSNYQMYRHIMAPGWXLGVVVGQEGGDLVHRGGRRPREQGDCSKFKGRHPALLQAHPRPWWTPSPGVPYNQQIANCCXGRRWVSAVRAGNRGG

SEQ ID NO: 21375 - DNA, 686 bp, Zea mays
  misc_feature: Ceres CLONE 1390468-F
  misc_feature: Encodes the peptide sequence at SEQ ID NO. 21376
  misc_feature (226)..(226): n is a, c, t, g, unknown, or other
  misc_feature (351)..(351): n is a, c, t, g, unknown, or other
  misc_feature (391)..(391): n is a, c, t, g, unknown, or other
  misc_feature (407)..(407): n is a, c, t, g, unknown, or other
  misc_feature (426)..(426): n is a, c, t, g, unknown, or other
  misc_feature (427)..(427): n is a, c, t, g, unknown, or other
  misc_feature (431)..(431): n is a, c, t, g, unknown, or other
  misc_feature (439)..(439): n is a, c, t, g, unknown, or other
tggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagnatggatgtgaacgacgtgctgctagtggtgctggcggcggcgctggctggcatgtgggtggcgtcggtgctcaaggaacggcgggtgtcgacggcctcccgccggggccctccgggttggccggntggtgggggaaacctgttccaggtgatcctggcagcgacnggcctttcatgtacgntggtgcgcgacctcccggnnaaangtacgggnccatctttcaccatggcggatgggggcagcgcacccctcatcgtggtcaacctcggcggagctcatccgcgaggcgcttggtgaagcaggggccccatgttcgcgagccggccccgaggacagccccacccgccttcctctttaggggtcgggaagtgcaccggtcaactcgggggccctacgggcccccctgtggcggggctctgcgccgcaactttcgtcgccgaaaaaggtggcccccgcacct

SEQ ID NO: 21376 - protein, 98 aa, Zea mays
  misc_feature: Ceres CLONE 1390468-F
  misc_feature (42)..(42): Xaa is any aa, unknown, or other
  misc_feature (61)..(61): Xaa is any aa, unknown, or other
  misc_feature (67)..(67): Xaa is any aa, unknown, or other
  misc_feature (69)..(69): Xaa is any aa, unknown, or other
MDVNDVLLVVLAAALAGMWVASVLKERRVSTASRRGPPGWPXGGGNLFQVILAATGLSCTXVRDLPXKXTGPSFTMADGGSAPLIVVNLGGAHPRGAW

SEQ ID NO: 21377 - DNA, 673 bp, Zea mays
  misc_feature: Ceres CLONE 1390469-F
  misc_feature (319)..(319): n is a, c, t, g, unknown, or other
  misc_feature (331)..(331): n is a, c, t, g, unknown, or other
  misc_feature (345)..(345): n is a, c, t, g, unknown, or other
  misc_feature (374)..(374): n is a, c, t, g, unknown, or other
  misc_feature (454)..(454): n is a, c, t, g, unknown, or other
  misc_feature (457)..(457): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
ggagctccccgcggtggcggccgctctagaactagtggatcccccgggctgcaggaattcgcacgagaccattacctagaacatcctaatcgaaaaacgccacccagttgcttctctgtgtactctccaactcatcaccggctccatccttgtcctacactgacctcgtccccatcccgcaaccgcaagcaaccaccgatccagcccgttcggcctttcggcgaatggtgacgaaccaggacgcggaggcggcatcggcggcagccccggggccaggggcgacggtggacccgatgcgcctagcgtcgcgggtgggcgncccaaaccggangggaaccgcgcggngccgaaactggaaggtgagccggaaccgncccagcttcacaccggcaaacaggccgggaatctttctcggtcgtctctaaggaaaaagttccccgggaaaaaccccggnaancattaccacggagggccggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21378 - DNA, 658 bp, Zea mays
  misc_feature: Ceres CLONE 1390472-F
  misc_feature: Encodes the peptide sequence at SEQ ID NO. 21379
  misc_feature (455)..(455): n is a, c, t, g, unknown, or other
  misc_feature (530)..(530): n is a, c, t, g, unknown, or other
  misc_feature (537)..(537): n is a, c, t, g, unknown, or other
  misc_feature (561)..(561): n is a, c, t, g, unknown, or other
tccccgcggtggcggccgctctagaactagtggatcccccgggctgcaggaattcgcacgagaccattacctagaacatcctaatcgaaaacccctctcgactgcccttggtatttggggggccctgggcaaattgcggtggccggggcccgccgccgcgacagcgccgtccgtcctcggttccgctcctccgtccgatccatacgtttccgttccctataaattctttaaattcccgcaaagtcccgtaccgctcagccaacccaacacgacggcgagtcggcggcgagtgggagggaacaccgcagcagcgatgcgtcggggctcgctgccgcggctgctgctgctgctgcttgcggcggcggcggcggtagcggccaccgcggttcccgccgagccggcgtcgacgctgtccgggccgtcgcggccggtgacggtggcgatcggagacaggngccacgcggtggacctgccggacacggacccgcgggtgcagcgccgcgtcacgggctgggcgcccgagcagatcngcgtcgngttctcccgcctcgccacctccgnctgggtctcctggatcacaggggactaccagatggggcggcgcccgtggagccgctgaacccccggggcggggggcagccgtcgtgggggaacggct

SEQ ID NO: 21379 - protein, 101 aa, Zea mays
  misc_feature: Ceres CLONE 1390472-F
  misc_feature (48)..(48): Xaa is any aa, unknown, or other
  misc_feature (73)..(73): Xaa is any aa, unknown, or other
  misc_feature (75)..(75): Xaa is any aa, unknown, or other
  misc_feature (83)..(83): Xaa is any aa, unknown, or other
MRRGSLPRLLLLLLAAAAAVAATAVPAEPASTLSGPSRPVTVAIGDRXHAVDLPDTDPRVQRRVTGWAPEQIXVXFSRLATSXWVSWITGDYQMGRRPWSR

SEQ ID NO: 21380 - DNA, 658 bp, Zea mays
  misc_feature: Ceres CLONE 1390474-F
  misc_feature: Encodes the peptide sequence at SEQ ID NO. 21381
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaaaacccaacccaaccgcgctttttgtcacctctcacctggaaagggaagacaagtcgagattcgagaaggcaaatcgaattcgccatgggcatggctgctccgcgcgcgccgctgcctctcccccaactgctgctcctcctcgttgctgcgctcctcgccgccgctcccctccctagggcggccggggcggacgagttcgacgtccgccgccacctctccaccgtcaccaggtatgatgtggccagggagtccagtagtgtcatctccatgccgtcaatcccagacgggtgccgtgtcattcacctcaatctagtggcaagacatgggactcgtgctcctaccaagaagcgcatcaaggagctggatagattggcagttcgactggaagcccttctgaaagaggcaaatcaggtccttgatagtgattctctgaagaaaattccatcctggattaaaggctgggaatcacgctggaagggtaggactaaaggtggtgagctgattagtgaagggaangaggagctgtacaatttagctaccaatagggaggagaagt

SEQ ID NO: 21381 - protein, 157 aa, Zea mays
  misc_feature: Ceres CLONE 1390474-F
  misc_feature: SWISSPROT Homolog: EC 3.1.3.8 3-phytase
  misc_feature (144)..(144): Xaa is any aa, unknown, or other
MGMAAPRAPLPLPQLLLLLVAALLAAAPLPRAAGADEFDVRRHLSTVTRYDVARESSSVISMPSIPDGCRVIHLNLVARHGTRAPTKKRIKELDRLAVRLEALLKEANQVLDSDSLKKIPSWIKGWESRWKGRTKGGELISEGXEELYNLATNREEK

SEQ ID NO: 21382 - DNA, 672 bp, Zea mays
  misc_feature: Ceres CLONE 1390476-F
  misc_feature (252)..(252): n is a, c, t, g, unknown, or other
  misc_feature (253)..(253): n is a, c, t, g, unknown, or other
  misc_feature (286)..(286): n is a, c, t, g, unknown, or other
  misc_feature (343)..(343): n is a, c, t, g, unknown, or other
  misc_feature (395)..(395): n is a, c, t, g, unknown, or other
  misc_feature (410)..(410): n is a, c, t, g, unknown, or other
  misc_feature (413)..(413): n is a, c, t, g, unknown, or other
  misc_feature (429)..(429): n is a, c, t, g, unknown, or other
  misc_feature (430)..(430): n is a, c, t, g, unknown, or other
  misc_feature (436)..(436): n is a, c, t, g, unknown, or other
  misc_feature (437)..(437): n is a, c, t, g, unknown, or other
  misc_feature (470)..(470): n is a, c, t, g, unknown, or other
aaagctggagctccccgcggtggcggccgctctagaactagtggatcccccgggctgcaggaattcgcacgagaccattacctaagaacatcctaatcgaaaaaggctggatttgagcctgtttagcagcgctatccgcttggcccaattcgtctactgctcctccagctcctccgctgcgccgccggtcgccgcccgacaccgccgaagaagagcagacgccgagtccaggacgtcgccgcggggctcggnngaacgcggtgttgccatcgcgaggaaggtcggnaaagtcgctgttcgcccgccggatcggcaccgtcgccaccgcccatggcaacgtcgncccccgtcgtctccgacctcgtcgacttcctcaacgcgtcgccaccgctttncacggcggtgacgangcnaaacggcgctgaaggnnggcggnntcctgcacctgtccgaccggagggatgggcccntcctcaacccgggcggaaggaattttttcacggcaaacactcacatatgggcgttttgccatcggcgaaaaaaaggtggggggaaggggtccccatttctggggggacacactggaggcccttgtgctggaactaaggggggttccagagaaaacaggaggggtccccttggggggggggccccacacattgggggggggga

SEQ ID NO: 21383 - DNA, 648 bp, Zea mays
  misc_feature: Ceres CLONE 1390477-F
  misc_feature: Encodes the peptide sequence at SEQ ID NO. 21384
  misc_feature (356)..(356): n is a, c, t, g, unknown, or other
  misc_feature (366)..(366): n is a, c, t, g, unknown, or other
  misc_feature (373)..(373): n is a, c, t, g, unknown, or other
tggagctccccgcggtggcggccgctctagaactagtggatcccccgggctgcaggaattcgcacgagaccattacctagaacatcctaatcgaaaaagtgtgagagctcgattcgttgccgtccacttgtctcacggcctgtcgccatctccttcctggttttttcatccgaccatccccggctcctccgcgccgtcggcgacgactccatcgagtcactcggccgcagcaaccggcgaccatgtaccgagtcgcctccgggctcggcgccctcaagaggcatggggcatatgctcaaatgatgaatgctgcaattaggtgtgccagcacaagtgttgcacagaaggtctttcgntggcttgtgnacctggntggactggtgcgcgtcaaatgaaatacctccctcagattcacacttccgggagggactattcctcctccgctgcctgaccatgggggaggctgggaaaacaggaggccaacacttccccaatggggttaaaaaaccccctgaaaattcggcgggatcttcttgttccggtgggagttaagggtggaaggggggggtccgggaaatagaagcaccctggaaaaaaagggggccccgtcaactggggtaaaaacaaatgggctttccaacccctggg

SEQ ID NO: 21384 - protein, 50 aa, Zea mays
  misc_feature: Ceres CLONE 1390477-F
  misc_feature (42)..(42): Xaa is any aa, unknown, or other
  misc_feature (44)..(44): Xaa is any aa, unknown, or other
MYRVASGLGALKRHGAYAQMMNAAIRCASTSVAQKVFRWLVXLXGLVRVK

SEQ ID NO: 21385 - DNA, 665 bp, Zea mays
  misc_feature: Ceres CLONE 1390483-F
  misc_feature: Translation starting site: 244
  misc_feature (616)..(616): n is a, c, t, g, unknown, or other
  misc_feature (665)..(665): n is a, c, t, g, unknown, or other
tggagctccccgcggtggcggccgctctagaactagtggatcccccgggctgcaggaattcgcacgagaccattacctagaacatcctaatcgaaaagggtctccgtgtcgtctctgcgactccacttgctcttttcgctggccctggctacttgcggcaactcccatctccacgcgctctcccatccgagatctcaaccgcctcgccggcgagcgactgacgggcggacggtcccgccggctatggggaactgctgctccgatgaggtgagccacgccggtgctcatcccgtcggctccgccaccgccaaagccgcctccgcagcctccgccgcggtcgatcgctttctccgctcccgtggtgccggcgcgtccacgcagatcgagttatctctctctgcatcagatttgggtgatcaagaatattttctcaagagtaatctcatgggtgattgtgtattccaaaaagagagatgctacactataagaaattgcgcgcagtgaagtaattctagattcattgaacccattttggacgaccaatatcagtgtgcagcaccacgtttgaggttcttcagcagttggatgtttcaggtctttgacatcatccaccggntccggagagtcactgcaatagagctgacgctagagggaccatagtttcn

SEQ ID NO: 21386 - DNA, 653 bp, Zea mays
  misc_feature: Ceres CLONE 1390486-F
  misc_feature: Encodes the peptide sequence at SEQ ID NO. 21387
  misc_feature (478)..(478): n is a, c, t, g, unknown, or other
  misc_feature (611)..(611): n is a, c, t, g, unknown, or other
  misc_feature (614)..(614): n is a, c, t, g, unknown, or other
aagctggagctccccgcggtggcggccgctctagaactagtggatcccccgggctgcaggaattcgcacgagaccattacctagaacatcctaatcgaaaaaatttgcttgcagttttgataatttgcttgcagttttgcactaggcattgattgcatctctagtgcccgtcctccgtcctccggagcggctatgggcgaagagagggagttcgtgggcgctaggttggacgccggcctccgcgctgcccgcttctcgtcgccgccgtctgccgacgagtttgcggcagatgtcgagcccaagaacgtccctgcggtctttcgcggcgtggttaaggagtgggcggcctcctcccgttgggatcctctccatggcggcctcgattacctgctggaaaaagtgggacctgacgtggctgtggaagctatgatgtcaaacactggccatgtgttctacggggatctcagaagccatgagnagggtgtctgtttcattctccacgttcattcagtcgtgcaagtcttacctggatcatatgaatgcagctagtgattcatccaaggagcagggaaatgcttggggagccagctagttcaagggagacatgttcnaancagttcagagaacttggagcaagtctatttggcacgaaa

SEQ ID NO: 21387 - protein, 118 aa, Zea mays
  misc_feature: Ceres CLONE 1390486-F
  misc_feature (96)..(96): Xaa is any aa, unknown, or other
MGEEREFVGARLDAGLRAARFSSPPSADEFAADVEPKNVPAVFRGVVKEWAASSRWDPLHGGLDYLLEKVGPDVAVEAMMSNTGHVFYGDLRSHEXGVCFILHVHSVVQVLPGSYECS

SEQ ID NO: 21388 - DNA, 678 bp, Zea mays
  misc_feature: Ceres CLONE 1390487-F
  misc_feature: Translation starting site: 214
  misc_feature: Pfam Name: VWA Pfam Description: von Willebrand factor type A domain
  misc_feature (354)..(354): n is a, c, t, g, unknown, or other
  misc_feature (399)..(399): n is a, c, t, g, unknown, or other
  misc_feature (457)..(457): n is a, c, t, g, unknown, or other
  misc_feature (458)..(458): n is a, c, t, g, unknown, or other
  misc_feature (523)..(523): n is a, c, t, g, unknown, or other
  misc_feature (571)..(571): n is a, c, t, g, unknown, or other
  misc_feature (594)..(594): n is a, c, t, g, unknown, or other
aaagctggagctccccgcggtggcggccgctctagaactagtggatcccccgggctgcaggaattcgcacgagaccattacctagaacatcctaatcgaaaagtgatacacatccgtcccttctagtctcctaataactagtttctatcttgctccccaaaccagcgcaaaccctgccctgacaccggcagcgacacgtccaccggcggcgccatggtgctcgaggcaacgatgatctgcatagactattcggaatggatgcggaacggcgactacccttccgtcgcggttccaggcgcagggccgatgccgtcaacctcatctgcggcgccaagacccagtcaaacccggagnaacacggtaggcgtgatgacatggcccggggaaagggtttgtccncggtgcttgtcactcccaccagcgaccttcgggaagattctcgcctgtatgccggggnnttaagaaggttggcgctggagggcaaacttggctgcggcaaatccaggtttgcccagctttgctnctgaagcatcgccagaacaagaggcagcagcagaggattatagttttncattggaagggcctgtgagaccnaacaaagaaggttttggagaccatttgggaaaagctgaaaaagacaatgttgctctttgacttgttgactttggggaatccgat

SEQ ID NO: 21389 - DNA, 637 bp, Zea mays
  misc_feature: Ceres CLONE 1390490-F
  misc_feature: Encodes the peptide sequence at SEQ ID NO. 21390
  misc_feature (345)..(345): n is a, c, t, g, unknown, or other
  misc_feature (396)..(396): n is a, c, t, g, unknown, or other
  misc_feature (452)..(452): n is a, c, t, g, unknown, or other
  misc_feature (453)..(453): n is a, c, t, g, unknown, or other
  misc_feature (535)..(535): n is a, c, t, g, unknown, or other
tggagctccccgcggtggcggccgctctagaactagtggatcccccgggctgcaggaattcgcacgagaccattacctagaacatcctaatcaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcacggacgncctcccacgggggtccggatgcacgctattgggttccggcggggccgtggnttcggcccgacgaggacttccctggctgacgtgaggatcccgggtgcccgtccagnnactgccctgggcgtccaacccacgggaggactacgacggggcgccgaggactttttgaggagatgctaccatctccctgggncgacgaactgctgggttgcggatgccccccggtggaggggccaaattttgggaaagagcagcgggcccgttctatgaattgcccggggggtcggggcttttg

SEQ ID NO: 21390 - protein, 92 aa, Zea mays
  misc_feature: Ceres CLONE 1390490-F
  misc_feature (65)..(65): Xaa is any aa, unknown, or other
  misc_feature (82)..(82): Xaa is any aa, unknown, or other
MGALRSLAISYPEFLVAGLCFVSLSALRHAMRERRQRAPLSWPVVGMLPFVLANLGRLYDAITDXLPRGSGCTLLGSGGAVXSARRGLPWLT

SEQ ID NO: 21391 - DNA, 656 bp, Zea mays
  misc_feature: Ceres CLONE 1390491-F
  misc_feature: Encodes the peptide sequence at SEQ ID NO. 21392
  misc_feature (543)..(543): n is a, c, t, g, unknown, or other
  misc_feature (593)..(593): n is a, c, t, g, unknown, or other
  misc_feature (600)..(600): n is a, c, t, g, unknown, or other
aaagctggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtgccgctgggcatgtgccgtgctccgtgtcttgcttcgtcgtgctcactagtcacgagagagggaggaggctctgcttctgctgccgcttcttcttctcctgctgctcttccggagataagcaggagctcgggacagctgactagctgagaggcatggtgatggacgccggcggcgaaaagctgccgtacagctactccggtcagcaggacggcgcaaagctggtgaacagcgtcagccgcgtggatgcgcgcatgttcggcctgtgcctcgtggagggcattctctgtcgcacatgtcgctactctccaacgacgagttcgacgccatcgagatcgccatgaccngactgatcgtctcatgaatggcggatggtgtcagagacgagtccgatggnagtgggnactgctgctgcccacatctctgaggcgtaaggaagagattaaatattggaagtcat

SEQ ID NO: 21392 - protein, 62 aa, Zea mays
  misc_feature: Ceres CLONE 1390491-F
MVMDAGGEKLPYSYSGQQDGAKLVNSVSRVDARMFGLCLVEGILCRTCRYSPTTSSTPSRSP

SEQ ID NO: 21393 - DNA, 666 bp, Zea mays
  misc_feature: Ceres CLONE 1390492-F
  misc_feature: Encodes the peptide sequence at SEQ ID NO. 21394
  misc_feature (361)..(361): n is a, c, t, g, unknown, or other
  misc_feature (390)..(390): n is a, c, t, g, unknown, or other
  misc_feature (391)..(391): n is a, c, t, g, unknown, or other
  misc_feature (394)..(394): n is a, c, t, g, unknown, or other
  misc_feature (444)..(444): n is a, c, t, g, unknown, or other
  misc_feature (626)..(626): n is a, c, t, g, unknown, or other
tggagctccccgcggtggcggccgctctagaactagtggatcccccgggctgcaggaattcgcacgagaccattacctagaacatcctaatcgaaaaattcgcggcttcgcctgatcgcgtacgccgcttcgtcctgattctcaatctctggtgctcccatgaagaaagacagggaatgaaggaccgccacctcgcgctgaaccagacccagagggtccgcctcgaggccgcgcttcaagagctccagtccgttgcgcccgccgccgcgcccgccgctgccgtcaccgtcgcgggcaccattcccgtcaatcaagaggacaacatcctcaaggggcatgggacgtcggaccaggacggggnaaggtggttgcgacgctctgcgggggggnntgnagcgggtcaacaaacttggtctacgtccgcactcttcgcgcgagctgcanattctcgatggaaatttggatggggggttctgcaagccgcggatgcaaaggtactgcgtttacaaagggtggagggcgccgcgaaatctcatcctcagctacaccggctcatcccctacatggcttggcaagggtattggcgggtcaagaagcttctaaatgacaagtccagctgccacccnagtggtatgggcttctcaatcatgacaaactcctgtgggc

SEQ ID NO: 21394 - protein, 163 aa, Zea mays
  misc_feature: Ceres CLONE 1390492-F
  misc_feature (62)..(62): Xaa is any aa, unknown, or other
  misc_feature (72)..(72): Xaa is any aa, unknown, or other
  misc_feature (73)..(73): Xaa is any aa, unknown, or other
  misc_feature (90)..(90): Xaa is any aa, unknown, or other
MKDRHLALNQTQRVRLEAALQELQSVAPAAAPAAAVTVAGTIPVNQEDNILKGHGTSDQDGXRWLRRSAGGXXAGQQTWSTSALFARAAXSRWKFGWGVLQAADAKVLRLQRVEGAAKSHPQLHRLIPYMAWQGYWRVKKLLNDKSSCHPSGMGFSIMTNSCG

SEQ ID NO: 21395 - DNA, 644 bp, Zea mays
  misc_feature: Ceres CLONE 1390494-F
  misc_feature: Encodes the peptide sequence at SEQ ID NO. 21396
  misc_feature (498)..(498): n is a, c, t, g, unknown, or other
  misc_feature (499)..(499): n is a, c, t, g, unknown, or other
  misc_feature (553)..(553): n is a, c, t, g, unknown, or other
  misc_feature (590)..(590): n is a, c, t, g, unknown, or other
  misc_feature (644)..(644): n is a, c, t, g, unknown, or other
tggagctccccgcggtggcggccgctctagaactagtggatcccccgggctgcaggaattcgcacgagaccattacctagaacatcctaatcgaaaaagtgtgagagctcgattcgttgccgtccacttgtctcacggcctgtcgccatctccttcctggttttttcatccgaccatccccggctcctccgcgccgtcggcgacgactccatcgagtcactcggccgcagcaaccggcgaccatgtaccgagtcgcctccgggctcggcgccctcaagaggcatggggcaaatgctcaaatgatgaatgctgcaattaggtgtgccagcacaagtgttgcacagaggtcttccggtggcttgtggacctggttgactggtgcgcgttcaaatgaaatacctcctccagatttcacactttccgggagtgactattcctcctccgctgcctgaccatgtggaggctggcaaaacaagagtcacaacacttccccatggnntgtaaatagcctctgagacatctgcgggatcatcttgttctggttgagttatgntttgattggggggtctgtatatgaagcactgaaacancagtggccagtcaactggtgaggacatgggcttcacaccactgcaaaggggggn

SEQ ID NO: 21396 - protein, 69 aa, Zea mays
  misc_feature: Ceres CLONE 1390494-F
MYRVASGLGALKRHGANAQMMNAAIRCASTSVAQRSSGGLWTWLTGARSNEIPPPDFTLSGSDYSSSAA

SEQ ID NO: 21397 - DNA, 671 bp, Zea mays
  misc_feature: Ceres CLONE 1390495-F
  misc_feature: Encodes the peptide sequence at SEQ ID NO. 21398
  misc_feature (443)..(443): n is a, c, t, g, unknown, or other
  misc_feature (519)..(519): n is a, c, t, g, unknown, or other
tggagctccccgcggtggcggccgctctagaactagtggatcccccgggctgcaggaattcgcacgagaccattacctagaacatcctaatcaaaaaatccaacggactgcacccaacatgcttgcgaacgtctgccggcggcggctcaccatccccctctccccaatcctcgccgccgccgccgccgccgccagcggcaagaatcccatccactccaaccacgcgcgcgccctcctctctcaaagctactactcgtccgcctttcaggcggcgcccgaccgcgagccctgccccactacggtctcctacctggtttcctgcggtgtctcccccgccgtcgccgccgctcgcaaggtccgcatccgggacacggagcgggggcgaacgcagttcgggccctcctggcgcaagtacgggcttctccgaggcggatatcacccgncacgggtgcgtttagacccgctgctgctcaccttcgatccagaccgcaccattcgccccaagctcgacttcttctntttcggtcgggaccaaagccccgcttgctcgccaccgagccccacatcctcgcccggcagcctggaaaaaacatcaaccctggggaatcgagtttttccgcaccatcttttcgtaccgatgacactttcccgcatcgcgggttctcccgcgt

SEQ ID NO: 21398 - protein, 184 aa, Zea mays
  misc_feature: Ceres CLONE 1390495-F
  misc_feature (109)..(109): Xaa is any aa, unknown, or other
  misc_feature (134)..(134): Xaa is any aa, unknown, or other
MLANVCRRRLTIPLSPILAAAAAAASGKNPIHSNHARALLSQSYYSSAFQAAPDREPCPTTVSYLVSCGVSPAVAAARKVRIRDTERGRTQFGPSWRKYGLLRGGYHPXRVRLDPLLLTFDPDRTIRPKLDFFXFGRDQSPACSPPSPTSSPGSLEKTSTLGNRVFPHHLFVPMTLSRIAGSPA

SEQ ID NO: 21399 - DNA, 672 bp, Zea mays
  misc_feature: Ceres CLONE 1390496-F
  misc_feature: Translation starting site: 292
  misc_feature: SWISSPROT Homolog: EC 4.2.1.20 Tryptophan synthase
  misc_feature (235)..(235): n is a, c, t, g, unknown, or other
  misc_feature (306)..(306): n is a, c, t, g, unknown, or other
  misc_feature (405)..(405): n is a, c, t, g, unknown, or other
  misc_feature (423)..(423): n is a, c, t, g, unknown, or other
  misc_feature (444)..(444): n is a, c, t, g, unknown, or other
  misc_feature (445)..(445): n is a, c, t, g, unknown, or other
  misc_feature (462)..(462): n is a, c, t, g, unknown, or other
  misc_feature (465)..(465): n is a, c, t, g, unknown, or other
  misc_feature (563)..(563): n is a, c, t, g, unknown, or other
  misc_feature (665)..(665): n is a, c, t, g, unknown, or other
ggagctccccgcggtggcggccgctctagaactagtggatcccccgggctgcaggaattcgcacgagaccattacctagaacatcctaatcgaaaaactcgcaatcgcaaagtcgcaagcggatcgcaaactcgcaatcaaggctgctcccctccgtctccgtgttcgccactcggttcaccgcccgccgccgccgagacctcctcctcgccggctactcctgaccccacaaagngcagcgctcggaggtgggccctctgtcgggtgggagtggtggacacatccgcgcccatggccaacggcggncgctgcggccggcaagctcaccgtcgccgagaccttctccaacctcagggagcaaggcaagagtgcattcatcccgttcataaactggctggtgatccntgacctggtaaccacatncgaaatcattgaagattctcnnattcctgcgggttcganggntaaatagaaggttggcgtaccatactcggatccactggctggatggggccagttattcaggcttctgcaacacggggcgcttaagaaaggcactacancttgattctgtcatagagatgcctgaagggggttacacctgagctttcttgccccattgttcttttccatactataatccaatctgaaaacgtgggtgtggnaaacttc

SEQ ID NO: 21400 - DNA, 656 bp, Zea mays
  misc_feature: Ceres CLONE 1390497-F
  misc_feature: Encodes the peptide sequence at SEQ ID NO. 21401
tggagctccccgcggtggcggccgctctagaactagtggatcccccgggctgcaggaattcgcacgagaccattacctagaacatcctaatcgaaaactctcttcttccaccaccacctcctactccgctgcaaccccaaatctctccttcctcgcatacgcgcgcagcggaggagctgagaccaacgaagaagaagaagaacaaccgagcaagcacaagcttagctagcgtgtaggtgtccaaggcgacgacggccgccgcgccaggctagccaaccagctgctcatcgctcctagctgcggagccgatatggctggcgccgacgtcgacgtcgggacggagctccgtctcggtctgccgggaggaggcgccgatgcggccagggctgccaagaggtgcttcgaggacaccatcgacctcaagctgaagctgcccaccgccggcatggaggaagctgccgccgccgccgccgccgccgccaagtccgagccggcagccgagaaagccaagaggcccgccgaggcgccggtcgctgatgccgagaagccacccgcacccaggcacaagctgggggttggccacaagtccggtcataacgcaggaaacgcatgaccggccaggtctgggaaaaacaagaaggaagaagagccctgaa

SEQ ID NO: 21401 - protein, 100 aa, Zea mays
  misc_feature: Ceres CLONE 1390497-F
MAGADVDVGTELRLGLPGGGADAARAAKRCFEDTIDLKLKLPTAGMEEAAAAAAAAAKSEPAAEKAKRPAEAPVADAEKPPAPRHKLGVGHKSGHNAGNA

SEQ ID NO: 21402 - DNA, 683 bp, Zea mays
  misc_feature: Ceres CLONE 1390499-F
  misc_feature: Translation starting site: 379
  misc_feature (395)..(395): n is a, c, t, g, unknown, or other
  misc_feature (424)..(424): n is a, c, t, g, unknown, or other
  misc_feature (453)..(453): n is a, c, t, g, unknown, or other
  misc_feature (454)..(454): n is a, c, t, g, unknown, or other
  misc_feature (485)..(485): n is a, c, t, g, unknown, or other
  misc_feature (514)..(514): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (612)..(612): n is a, c, t, g, unknown, or other
  misc_feature (613)..(613): n is a, c, t, g, unknown, or other
  misc_feature (616)..(616): n is a, c, t, g, unknown, or other
  misc_feature (617)..(617): n is a, c, t, g, unknown, or other
  misc_feature (619)..(619): n is a, c, t, g, unknown, or other
  misc_feature (646)..(646): n is a, c, t, g, unknown, or other
  misc_feature (649)..(649): n is a, c, t, g, unknown, or other
tggagctccccgcggtggcggccgctctagaactagtggatcccccgggctgcaggaattcgcacgagaccattacctagaacatcctaatcaaaaaaaactttagtctactcgtcctcggtcctcctcttctcgcagcagccagcagaccaatcgggacaagcaaactcccccgattagtttaagcagcccgggcccggcgacgaccagctccgttccgcgcggggatttaaacgcgcgaagcgagaaggcacgcagcaggcggcagcggcaagcaacgaacgcgatcgcgcgccgacgacgacgcgcggtgccggcgcctggtggtgccgtgttgcggactccgctgcatcgtctcggtcggtcgtcgtcgttatcatgggtgtccggctgcngggtggcgttggtccgccgtcctcgtccntcctcgtggcgggcggccgtgggcgcggnnagtacgcggccatcttcaaacttcggggacntccctgggtggacgccggcaaaccctggntgggtgggacggcatccccggactacctgggccacgggcgcgcctggccctacggcatggacccacttcggctaccccaccggcgnnntgctcgacgnncgnncnttcggtggttgacttcatcgcgcaggnaanttgggccgtgccgcttcctgccggcgttccaagg

SEQ ID NO: 21403 - DNA, 661 bp, Zea mays
  misc_feature: Ceres CLONE 1390500-F
  misc_feature: Encodes the peptide sequence at SEQ ID NO. 21404
  misc_feature (444)..(444): n is a, c, t, g, unknown, or other
  misc_feature (512)..(512): n is a, c, t, g, unknown, or other
  misc_feature (516)..(516): n is a, c, t, g, unknown, or other
  misc_feature (524)..(524): n is a, c, t, g, unknown, or other
  misc_feature (527)..(527): n is a, c, t, g, unknown, or other
caaagctggagctccccgcggtggcggccgctctagaactagtggatcccccgggctgcaggaattcgcacgagaccattacctagaacatcctaatcgaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtncgacacctccccgggctcgcccgcgcagcgcttcgtgtcggaggacggcgtcatcaactcgcgcccgncggntgctgggncgncgcagctgcatcaacgccggcttctacacgcgggcagcgacgactagtgcggggggggttcggtgggaaactgggcgccgcccggggcgccctaaacggtgtgggtggaaagacacttttttggtttccacccc

SEQ ID NO: 21404 - protein, 141 aa, Zea mays
  misc_feature: Ceres CLONE 1390500-F
  misc_feature: SWISSPROT Homolog: EC 4.1.2.10 Mandelonitrile lyase
  misc_feature (99)..(99): Xaa is any aa, unknown, or other
  misc_feature (122)..(122): Xaa is any aa, unknown, or other
  misc_feature (123)..(123): Xaa is any aa, unknown, or other
  misc_feature (126)..(126): Xaa is any aa, unknown, or other
  misc_feature (127)..(127): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLXDTSPGSPAQRFVSEDGVINSRPXXAGXXQLHQRRLLHAGSDD

SEQ ID NO: 21405 - DNA, 680 bp, Zea mays
  misc_feature: Ceres CLONE 1390507-F
  misc_feature: Translation starting site: 269
  misc_feature: SWISSPROT Homolog: EC 3.6.3.14 H(+)-transporting two-sector ATPase
  misc_feature (343)..(343): n is a, c, t, g, unknown, or other
  misc_feature (416)..(416): n is a, c, t, g, unknown, or other
  misc_feature (433)..(433): n is a, c, t, g, unknown, or other
  misc_feature (447)..(447): n is a, c, t, g, unknown, or other
  misc_feature (448)..(448): n is a, c, t, g, unknown, or other
  misc_feature (466)..(466): n is a, c, t, g, unknown, or other
tggagctccccgcggtggcggccgctctagaactagtggatcccccgggctgcaggaattcgcacgagaccattacctagaacatcctaatcgaaaaaaacacgcaaaacgtgcttctgtccctctcctgttataatttcgtcttcttccctctcccaccggtgtcctcgcctcgcctatccgatctgccacctcgccgtctcgcacgttcctttccccaactccccagcgcctctccgcgccgcgatccagatccaggttgttcagcatgggtctggtgaaggaaggcgtcgacatggaggaggcaaccctagagatcggcatggagtacaggactgtatcntggtgtggccgggcctctgcttatcttggataaagtaaaggacccaaagtaccaagaaattgtaaacatccgnacttggagatgcaccanctcgcccgtgatcnngtcccttggagctgatgnacaaaaagctgcctgtgcagggtttttgaaggaagcttctggaatagactacaaatactccacgcgggcagttaaacggggcgaggtgttggaaaactcctggtctcactcggatatggcttgggcgcatttttaaatggttgcctggaaaaacttatgggacaatgggccccccgatattaccctgaagcctacttggataaacctctgggag

SEQ ID NO: 21406 - DNA, 629 bp, Zea mays
  misc_feature: Ceres CLONE 1390512-F
  misc_feature: Encodes the peptide sequence at SEQ ID NO. 21407
  misc_feature (273)..(273): n is a, c, t, g, unknown, or other
  misc_feature (288)..(288): n is a, c, t, g, unknown, or other
  misc_feature (295)..(295): n is a, c, t, g, unknown, or other
  misc_feature (425)..(425): n is a, c, t, g, unknown, or other
  misc_feature (427)..(427): n is a, c, t, g, unknown, or other
  misc_feature (428)..(428): n is a, c, t, g, unknown, or other
  misc_feature (527)..(527): n is a, c, t, g, unknown, or other
  misc_feature (629)..(629): n is a, c, t, g, unknown, or other
ggagctccccgcggtggcggccgctctagaactagtggatcccccgggctgcaggaattcgcacgagaccattacctagaacatcctaatcgaaaaaaaatcgggtttgccgtgcggcacttgcgtttcgggtcgggtacggacccgcaaaaagagctccgtcagttcctctacctcctctgtaggagcacacttgtttcggaaaggaacgcagattcacgccacgccgccgcctcaattatatggcgccggcgttctcggcacaggtcccgncgctccgacgggcancactgcngcgtgcggtgggtcacggctgcgctgttctcatcggggattctcgccggcaacaagccgattctggtgcgtgacttcgtgaggtcagcgttgtacgaccccaaccatggctacttctccaagcgggcggngnncgggtgggcgttcttgacgccagcatccgcttcaaccagctcggaggggaggagtgcatatatacagcaccttgataagctgtataagaagcatgatantcgcttgggttactcccgtggagctctttaagccatggtatgcctacgcaatagcagcatcgattctgcgtacagcaaatctttcagtcccattgaagaaan

SEQ ID NO: 21407 - protein, 185 aa, Zea mays
  misc_feature: Ceres CLONE 1390512-F
  misc_feature (96)..(96): Xaa is any aa, unknown, or other
  misc_feature (99)..(99): Xaa is any aa, unknown, or other
  misc_feature (142)..(142): Xaa is any aa, unknown, or other
  misc_feature (143)..(143): Xaa is any aa, unknown, or other
  misc_feature (176)..(176): Xaa is any aa, unknown, or other
GAPRGGGRSRTSGSPGLQEFARDHYLEHPNRKKIGFAVRHLRFGSGTDPQKELRQFLYLLCRSTLVSERNADSRHAAASIIWRRRSRHRSRRSDGXHCXVRWVTAALFSSGILAGNKPILVRDFVRSALYDPNHGYFSKRAXXGWAFLTPASASTSSEGRSAYIQHLDKLYKKHDXRLGYSRGAL

SEQ ID NO: 21408 - DNA, 647 bp, Zea mays
  misc_feature: Ceres CLONE 1390513-F
  misc_feature: Encodes the peptide sequence at SEQ ID NO. 21409
tggagctccccgcggtggcggccgctctagaactagtggatcccccgggctgcaggaattcgcacgagaccattacctagaacatcctaatcgaaaaaaacccacagcagtaacaggggcacactagctaagctaaacctcgccacggcacagcaatggcgccgctccccgcttccctcctgccctgcctctggctcttcctctgcctcctcgccgcgccgtgccccacagcgcgggcggcgcggttcgcgtgcaacgccacggcgccgcgagcgtccacgtgccaggcgctcgtctcctacgcgccgcccaacgggacggccacgcccacgctggccgccgtgcgcgcgctcttccagctccgctcccaccgcgcgctgctggccgccaacggcctcccgctctccacgccgcccacggcgcccgcgcccgagccgctgcgagtccgcctgccctgcctctgctcggggggcgccgagtccacattccagcggcccacgtaccgggtccgcgccgaggacacgatcgacgccgacgcgcggggcgtctacacgggccgcgtcacctaccaggacatcgccgccgccataacgactcggacccgaaaagggtcgccaggcgtcagcatctctggatcccccggacca

SEQ ID NO: 21409 - protein, 164 aa, Zea mays
  misc_feature: Ceres CLONE 1390513-F
MAPLPASLLPCLWLFLCLLAAPCPTARAARFACNATAPRASTCQALVSYAPPNGTATPTLAAVRALFQLRSHRALLAANGLPLSTPPTAPAPEPLRVRLPCLCSGGAESTFQRPTYRVRAEDTIDADARGVYTGRVTYQDIAAAITTRTRKGSPGVSISGSPGP

SEQ ID NO: 21410 - DNA, 633 bp, Zea mays
  misc_feature: Ceres CLONE 1390514-F
  misc_feature: Translation starting site: 176
  misc_feature (355)..(355): n is a, c, t, g, unknown, or other
  misc_feature (409)..(409): n is a, c, t, g, unknown, or other
  misc_feature (411)..(411): n is a, c, t, g, unknown, or other
  misc_feature (493)..(493): n is a, c, t, g, unknown, or other
  misc_feature (494)..(494): n is a, c, t, g, unknown, or other
aagctggagctccccgcggtggcggccgctctagaactagtggatcccccgggctgcaggaattcgcacgagaccattacctagaacatcctaatcgaaaaacgaggcaatgctgtcccgtcgccgcagctcgccgcgcccgctcgcacctggcctcctcctgttacttctcgccatggcgccgccaccgccggcttccgcggtgggtgtgaactggggcttcgcgtcctcccactcgctcccggcggcgcaggtcgtacggggcctcctcctccccaactctgttccccgcgtccgcctcgccgccgcctcctccgacgcgctcacggcgctcgaaggcaccggcatcgccgtncagcgtcgggatccccgacgcgctgctccggcccctcgcctcctccacaaggangncggccgcgtgggtccacgacaacatcacccgttactcctccagcggtgcggttcgaggtatatttggtgggtgggggatgannccttttctccaaaggcaggaaaaaattttcttcccttttggaggccggggagccaaaaaaagggtcaacaagggataagccccatggaaaaatttgcctgggcaaaaaagaaaggggggaaaaaacccctggggggggt

SEQ ID NO: 21411 - DNA, 654 bp, Zea mays
  misc_feature: Ceres CLONE 1390515-F
  misc_feature: Encodes the peptide sequence at SEQ ID NO. 21412
  misc_feature (463)..(463): n is a, c, t, g, unknown, or other
  misc_feature (638)..(638): n is a, c, t, g, unknown, or other
  misc_feature (645)..(645): n is a, c, t, g, unknown, or other
tggagctccccgcggtggcggccgctctagaactagtggatcccccgggctgcaggaattcgcacgagaccattacctagaacatcctaatcgaaaaagtttcgacagtcgtcgtcccctctactctcccggcttccgcagaatcccagcttctctggccctctcactccaaacatcgggctccaggccgtctcccgccaacccaaattcgcttcccgccgctccccattaaacccgcttgaaaggtcgcgccctcgagcagagcaacccctgaccacaaatccgatccgtagccgccgtgcctcgatttcgtctcttcccctctgctcgagtacgagcggctactcccggcggcggcggcggcggcggcgatgagcgcggtgagctcgaccatatcaaggagctgatcaagtggggaacagactacatcctcaaaaccttcaattcatctgctgacacgatnagacaggattgtcgctcaggtggggtgtaggtgacacctctaaaaggcagcagtcagcctaatgaccattactgctggatgagaccagaggacatcgactacaaaaggcaggtcaccgagtgtcactcttgctcagatctagcgtctgaaatggctgctgccctggctgcagctnccatagnggttcaagg

SEQ ID NO: 21412 - protein, 37 aa, Zea mays
  misc_feature: Ceres CLONE 1390515-F
  misc_feature: SWISSPROT Homolog: EC 3.2.1.4 Cellulase
  misc_feature (33)..(33): Xaa is any aa, unknown, or other
  misc_feature (35)..(35): Xaa is any aa, unknown, or other
MRPEDIDYKRQVTECHSCSDLASEMAAALAAAXIXVQ

SEQ ID NO: 21413 - DNA, 653 bp, Zea mays
  misc_feature: Ceres CLONE 1390517-F
  misc_feature: Translation starting site: 249
  misc_feature (515)..(515): n is a, c, t, g, unknown, or other
  misc_feature (572)..(572): n is a, c, t, g, unknown, or other
  misc_feature (573)..(573): n is a, c, t, g, unknown, or other
  misc_feature (613)..(613): n is a, c, t, g, unknown, or other
tggagctccccgcggtggcggccgctctagaactagtggatcccccgggctgcaggaattcgcacgagaccattacctagaacatcctaatcgaaaaaactccgacccacacccacggcacggcagtcggcagcagccagcgtcgagcgcagtgccctcttgtctgctgcctcctacctccccgcccgctgccccgcgcccagtctcactcacacactcacacgatccgatcggagggggctgaggagatggagccagattcggcgacgacgaggctcgcattgctggcgctgcttctcctggcggcgcccgcccgcccggcctcggcggctccgggtggaggatggcctgctcagcaatggtgactttgagacggaggcggccggcggtttcgtaagatctgcgtctgttgctgagggtgcatcgtcaatccctgggtggacaatccatggcacagtcgagctcatttcagcaggcagcaccagggtggcatggatcctgattgttccacaggnagaccatgctgtagggctagggaatgatgctagcgttggggcaggtggtggacgtcnnagagggctcggactacgctgtcacatccagcgctgccccnacatgtgcacaactggaggactgaacgtctccgtgctagg

SEQ ID NO: 21414 - DNA, 645 bp, Zea mays
  misc_feature: Ceres CLONE 1390518-F
  misc_feature: Encodes the peptide sequence at SEQ ID NO. 21415
  misc_feature (474)..(474): n is a, c, t, g, unknown, or other
  misc_feature (475)..(475): n is a, c, t, g, unknown, or other
tggagctccccgcggtggcggccgctctagaactagtggatcccccgggctgcaggaattcgcacgagaccattacctagaacatcctaatcgaaaagtccttcttccttctctcacacactccactccacgtccccctccttcaaatcctttcaacacccaagcacaaggagagagaagccgccgccgccgccatggacaatattgaggtgaggaggaggaagaagaaagggagaagcagcggacgccgccaggggggacgggtacaggcggtcctgcgcgccggcctcgtcgccatggccttcgccctcctctgcctctgctcctccacgccctccgccattgccctcaccccagacggcgaggcgttgctggagctcaagctggccttcaacgccaccgtgcagcggctcaccagctggcgtcccagcgacccaacccctgcgggctgggagggcatctcctgctccgtcnnctgactcagggtccaatccataaacctccattcatggcagctcgggggcatcatttcgcccaggcatcgggaggctcgacaagctgcagagactagctctgcaccagaccagctgcacggcccatcccctgcagagaatcagaactgcaccgagctcagggcattttacc

SEQ ID NO: 21415 - protein, 93 aa, Zea mays
  misc_feature: Ceres CLONE 1390518-F
  misc_feature (52)..(92): Pfam Name: LRRNT_2 Pfam Description: Leucine rich repeat N-terminal domain
  misc_feature: SWISSPROT Homolog: EC 2.7.11.1 Non-specific serine/threonine protein kinase
MDNIEVRRRKKKGRSSGRRQGGRVQAVLRAGLVAMAFALLCLCSSTPSAIALTPDGEALLELKLAFNATVQRLTSWRPSDPTPAGWEGISCSV

SEQ ID NO: 21416 - DNA, 666 bp, Zea mays
  misc_feature: Ceres CLONE 1390520-F
  misc_feature (330)..(330): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (349)..(349): n is a, c, t, g, unknown, or other
  misc_feature (361)..(361): n is a, c, t, g, unknown, or other
  misc_feature (364)..(364): n is a, c, t, g, unknown, or other
  misc_feature (367)..(367): n is a, c, t, g, unknown, or other
  misc_feature (473)..(473): n is a, c, t, g, unknown, or other
  misc_feature (560)..(560): n is a, c, t, g, unknown, or other
  misc_feature (629)..(629): n is a, c, t, g, unknown, or other
  misc_feature (636)..(636): n is a, c, t, g, unknown, or other
  misc_feature (640)..(640): n is a, c, t, g, unknown, or other
  misc_feature (644)..(644): n is a, c, t, g, unknown, or other
  misc_feature (647)..(647): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcaaaaagagggcgcgcattactctgcagcgcggacacgcccggcacggcaagccagccactcttctcgcgtgaagctgccaggacgagagagagagaggaggaggattagcttagccattcttgcggctgggcaaggaaactgctgaagccactagccggctgcctgctctacttcctccgaaccgaacgaggtgcatcgtgaggaagcagcagcagggggggcagtggccggnccgggatgacgnnnnaggnaggccgtggcgncgncgnaggcgaagctggatcaggactcggcggcggcggcggcgcccgtgctgctgaccccgctcagcgagacgctggggcgcgacagggcgaaggcgagggcgggccggcntcctccaacggccacctgggcggcggccctcgtagggggacgacccaacccgtgaacagtgcggctccggtgccgacgacacccaantcctggggctggtcgtgcattgcaaaaaaacccgcctcccgggctccgccaacccccactatggctccnaccccgnaccngganaancccancaaccccgaacgtt

SEQ ID NO: 21417 - DNA, 687 bp, Zea mays
  misc_feature: Ceres CLONE 1390522-F
  misc_feature (307)..(307): n is a, c, t, g, unknown, or other
  misc_feature (308)..(308): n is a, c, t, g, unknown, or other
  misc_feature (437)..(437): n is a, c, t, g, unknown, or other
  misc_feature (474)..(474): n is a, c, t, g, unknown, or other
tggagctccccgcggtggcggccgctctagaactagtggatcccccgggctgcaggaattcgcacgagaccattacctagaacatcctaatcgaaaaattcggatttccttccgccttccgacagcggctgtctcggcgacccaaccccagcctgaccccacctcccgccgccgccgccgccgccgccgcgccttcgtcgtcaggagaagggtcccggtggctgcgtctctctcccctgcccccctgctccacactcggttcacgcgtcggctcgctaccgcaggccctcgactcgtacgcccgtcnnccggcggcgatccggccggcaccgtaaccctaggactccgacggagcagggaatgatgagtcatgaacaacaaattgtcctccctaagaaagggttctgggtgaatgggttcccccatagaaaactggnataagggagggcagtggaaacgcaaagtagaaataanttttggtgaggtcatcccctctgggtggttttactaatttcaggggcagggaaacccattccagggacccgcttaatctatggttctaacacaaacttattggggcatcaatggggggacgtgcattgggaaataccggcttctataatcctctgggatttttccatggaaccaaaccctgacaaagaattttgggcgtcgtcttaaaaaaag

SEQ ID NO: 21418 - DNA, 668 bp, Zea mays
  misc_feature: Ceres CLONE 1390524-F
  misc_feature: Translation starting site: 527
  misc_feature: SWISSPROT Homolog: EC 3.2.1.4 Cellulase
  misc_feature (299)..(299): n is a, c, t, g, unknown, or other
  misc_feature (489)..(489): n is a, c, t, g, unknown, or other
  misc_feature (507)..(507): n is a, c, t, g, unknown, or other
  misc_feature (564)..(564): n is a, c, t, g, unknown, or other
  misc_feature (570)..(570): n is a, c, t, g, unknown, or other
  misc_feature (580)..(580): n is a, c, t, g, unknown, or other
  misc_feature (604)..(604): n is a, c, t, g, unknown, or other
  misc_feature (644)..(644): n is a, c, t, g, unknown, or other
tggagctccccgcggtggcggccgctctagaactagtggatcccccgggctgcaggaattcgcacgagaccattacctagaacatcctaatcgaaaaagtttcgacagtcgtcgtcccctctactctcccggcttccgcagaatcccagcttctctggccctctcactccaaacatcgggctccaggccgtctcccgccaacccaaattcgcttcccgccgctccccattaaacccgcttgaaaggtcgcgccctcgagcagagcaacccctgaccacaaatccgatccgtagccgcgntgcctcgatttcgtctcttcccctctgctcgagtacgagcggctactcccggcggcggcggcggcggcgggaatgagcgcggtgagctcgaccatatcaaggagctgatcaagtggggaacagactacatcctcaaaaccttcaattcatctgctgaacgaaaagacaggattgtcgcttcaggtggggngggtaggtgacacctctnaagggcagcagtcagcctaatgaccattaactgctggatggagaccagaggactcgnactacnaaaggcaagnccaccgagtgtcactcttgctcanaatctagcggtctggaaatggctgctgccctggctgagcntttcattaaggggtcaaggacagc

SEQ ID NO: 21419 - DNA, 677 bp, Zea mays
  misc_feature: Ceres CLONE 1390526-F
  misc_feature: Translation starting site: 145
  misc_feature (221)..(221): n is a, c, t, g, unknown, or other
  misc_feature (392)..(392): n is a, c, t, g, unknown, or other
  misc_feature (403)..(403): n is a, c, t, g, unknown, or other
  misc_feature (416)..(416): n is a, c, t, g, unknown, or other
  misc_feature (510)..(510): n is a, c, t, g, unknown, or other
  misc_feature (529)..(529): n is a, c, t, g, unknown, or other
tggagctccccgcggtggcggccgctctagaactagtggatcccccgggctgcaggaattcgcacgagaccattacctagaacatcctaatcgaaaaaccacacagctcccacgctcaccgacgccacagcttgtgcgcgcgcaatggcactcgtgtccgcctcctcgtcctccaccaccgccgtcgcggcgctccccaggaatgggcagcagcgggcgtncgtcgtcgttgttctcctcctcctcctcttcctccttcctcgtcggcaagacgctgctgaggcaggccgagcaagcccggccggtcgttcgccgtggcgcgccgcggcggattccgaacaggccgatctggttccccggcagcacccctccgccgtgggctcgacggcagnccttcccggcngacttcggctttngatccctgggggcctcggatctggacccggagaaagcctgcggtggaacgtgcagggcggagctggtgcaactggccggtgggcgatgctcggncgcgggcgtgtatcttccntcccggagttcctgaccaagatcggcgtcctcaacacgcccttctggtacaccgcccggcgagcagcagtacttcaccgacaccaccaccctcttcatcatcgagctcatcctccatcgctgggcccgaggcccgcccgttgggctga

SEQ ID NO: 21420 - DNA, 945 bp, Zea mays
  misc_feature: Ceres CLONE 1390530-R
  misc_feature (314)..(314): n is a, c, t, g, unknown, or other
  misc_feature (315)..(315): n is a, c, t, g, unknown, or other
accgggccccccctcgaggtcgacggtatcgataagcttttttttttttttttttgccccccaaacggcaccatgttttattcattggtcgaggcctccacactcggatgctacccacccaacacgacaacaacaacaaccaaaccccccagatttgcctggggttccccccttaccttttgaccaaaaacgggaaacaccccaacaaaaattaaacccggtttacagtaatccccccgcaacaaatattttcgtatagaactacatatatttgggaatcctttcccattcgaaatcagataaggaacaccaannaaaaacccaacgttaaccgggcgggttccaggaacgggcccagttcgttagatggggacaacgactaccacttgatcaggatttaaccccctccggttccctggaaaaaggggacacagggaaattcttcaaagccggggtttttcgctggggcggggggcctttaaatttttagatcccggggaacactccctgccgggcacccaggggggttttataatcgaaaggatgcccctccaaaaaaaatagatggggcctcccggggtggaaaaaaacccctttggtataaaagggaaaaagtcgttccaaaaaaattccggtttttctacctccagacgggcttttttgggccaggggggggaaaacaatcccggggggggcgactactggaaagatatccaagcgcttttcctatgggagtaaggggtgggcccaggggtcgtcatattttctccgcaattgctttagaaatgttgcgtaaaaacaccccgccccatcggaaacaactagcaaattggagattttacctgagcatcctggggggagaatttctattggggataggttcaaaaaccccctccggaaggggaattcgaaagtgtttggctgttttctaaagaaacgggggga

SEQ ID NO: 21421 - DNA, 640 bp, Zea mays
  misc_feature: Ceres CLONE 1390530-F
  misc_feature: Encodes the peptide sequence at SEQ ID NO. 21422
  misc_feature (289)..(289): n is a, c, t, g, unknown, or other
  misc_feature (538)..(538): n is a, c, t, g, unknown, or other
tggagctccccgcggtggcggccgctctagaactagtggatcccccgggctgcaggaattcgcacgagaccattacctagaacatcctaatcgaaaagtgttgccaaagttatcgttgtcttctctagcgacggcgaggcttgagcgctcacgtccaggcgttcccgtgccggtggccaagccagcagccgacgagatggactacctcaggacggtggttccgtcacaactcttggcagagcgcggctccaatcttgtcgtcatcaacccaggatcgggaaatgtgcgnaatgggggtttgctagtcaggatgtgccattcaatataccacattgcattgcccgacacatcaatccacaagagggcgaagaaccaagattctctgtgcgcaatcagatgctcaactgccatgctacttcatcgcaaaatgcagaagcgggagagtgcatatgatattattgcagcactgatgaaatcccatttttggacgatgaagaaatgccttcaccgaacaacccctcctccaaagatgggaacngggttgatggcttctcttcgcagcaaaacagagacgataataaatcactttgggacaggatgtgtccaaaagagaattattaagcccatcccaccatttgga

SEQ ID NO: 21422 - protein, 148 aa, Zea mays
  misc_feature: Ceres CLONE 1390530-F
MDYLRTVVPSQLLAERGSNLVVINPGSGNVRNGGLLVRMCHSIYHIALPDTSIHKRAKNQDSLCAIRCSTAMLLHRKMQKRESAYDIIAALMKSHFWTMKKCLHRTTPPPKMGTGLMASLRSKTETIINHFGTGCVQKRIIKPIPPFG

SEQ ID NO: 21423 - DNA, 674 bp, Zea mays
  misc_feature: Ceres CLONE 1390532-F
  misc_feature: Encodes the peptide sequence at SEQ ID NO. 21424
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (476)..(476): n is a, c, t, g, unknown, or other
  misc_feature (540)..(540): n is a, c, t, g, unknown, or other
  misc_feature (541)..(541): n is a, c, t, g, unknown, or other
  misc_feature (621)..(621): n is a, c, t, g, unknown, or other
  misc_feature (624)..(624): n is a, c, t, g, unknown, or other
aagctggagctccccgcggtggcggccgctctagaactagtggatcccccgggctgcaggaattcgcacgagaccattacctagaacatcctaatcaaaaaacccaaaatcctacgcagagacatgagtggcggcggcggcggcggcggggaggaccggatcagcatcctcccggacggcgttatcggcgagatcgtcacccgccttcccaccgccgatgccgtccgcgttcaggtcctctctcgccgttggcggcacatatggatctcctgtccgttgaacctcgatctcggttccccaaactactacaccgactacaagcgcgtcgtgtccggaatcctcgcggcccaccctggcccctgccgccgcctcaaagttgactgggcgtacgacgacggcgagtcgtacaaccactggctcagtctccgnnncttggtcggtcttcaggagctcgggatcgagccagagtactcttnccttgtggctagacaagaaagcactggccgcggggagacaacacgagagcactgccagagcggnnaatttatcccagttcgctcccacgctgcgccctccctaaggattggctaccatacctccccctcttgtcggtggcgtggncgncccctccggttgccacacctcgaggctcctctcggttctgggtgggtgga

SEQ ID NO: 21424 - protein, 183 aa, Zea mays
  misc_feature: Ceres CLONE 1390532-F
  misc_feature (11)..(58): Pfam Name: F-box Pfam Description: F-box domain
  misc_feature (103)..(103): Xaa is any aa, unknown, or other
  misc_feature (118)..(118): Xaa is any aa, unknown, or other
  misc_feature (140)..(140): Xaa is any aa, unknown, or other
MSGGGGGGGEDRISILPDGVIGEIVTRLPTADAVRVQVLSRRWRHIWISCPLNLDLGSPNYYTDYKRVVSGILAAHPGPCRRLKVDWAYDDGESYNHWLSLRXLVGLQELGIEPEYSXLVARQESTGRGETTREHCQSGXFIPVRSHAAPSLRIGYHTSPSCRWRGRPLRLPHLEAPLGSGWV

SEQ ID NO: 21425 - DNA, 663 bp, Zea mays
  misc_feature: Ceres CLONE 1390533-F
  misc_feature: Encodes the peptide sequence at SEQ ID NO. 21426
  misc_feature (228)..(228): n is a, c, t, g, unknown, or other
  misc_feature (346)..(346): n is a, c, t, g, unknown, or other
  misc_feature (414)..(414): n is a, c, t, g, unknown, or other
  misc_feature (445)..(445): n is a, c, t, g, unknown, or other
  misc_feature (478)..(478): n is a, c, t, g, unknown, or other
  misc_feature (529)..(529): n is a, c, t, g, unknown, or other
  misc_feature (552)..(552): n is a, c, t, g, unknown, or other
  misc_feature (647)..(647): n is a, c, t, g, unknown, or other
tggagctccccgcggtggcggccgctctagaactagtggatcccccgggctgcaggaattcgcacgagaccattacctagaacatcctaatcgaaaaaagcctctcaattccaactccatcgcaacagcctatcgagtccccgaacagtcctgcgcgcgtccgcaatggcggagacggccggcgcggctccagcacagcagcccgctagagtagctacgacgacacgnaacagcgatgtctccacgtgggcgtggttgcagcaggtcctcgcgctgctgttcccgtccgccttcgccgcgaaaggccgcgctggtttgcgctcgtgggtggcgctgctgccgctgnctgcccgtcggggcaggcgcccaggatctggggagctgccgcacctcctcctgctcggcatcatctcntcctacggcgtcttcggccagaagaacgcgnaccgccgaggtggccaccgctgcctacgcccgncccgtcgacgtggaggcggtcggtggaggcctacgtctcgcagatgatgcngggctcgcttgtcttcgacgaanacgacggcaacgatggcgcccacaaggatggcagcgtccaacagcaggcgtgggagctctcggaaccttccagacgacccggctcgtggtcgtcncggacacttcagcgct

SEQ ID NO: 21426 - protein, 119 aa, Zea mays
  misc_feature: Ceres CLONE 1390533-F
  misc_feature (61)..(61): Xaa is any aa, unknown, or other
  misc_feature (94)..(94): Xaa is any aa, unknown, or other
  misc_feature (105)..(105): Xaa is any aa, unknown, or other
MAETAGAAPAQQPARVATTTRNSDVSTWAWLQQVLALLFPSAFAAKGRAGLRSWVALLPLXARRGRRPGSGELPHLLLLGIISSYGVFGQKNAXRRGGHRCLRPXRRRGGGRWRPTSRR

SEQ ID NO: 21427 - DNA, 660 bp, Zea mays
  misc_feature: Ceres CLONE 1390535-F
  misc_feature: Encodes the peptide sequence at SEQ ID NO. 21428
  misc_feature (287)..(287): n is a, c, t, g, unknown, or other
  misc_feature (299)..(299): n is a, c, t, g, unknown, or other
  misc_feature (300)..(300): n is a, c, t, g, unknown, or other
  misc_feature (332)..(332): n is a, c, t, g, unknown, or other
  misc_feature (338)..(338): n is a, c, t, g, unknown, or other
  misc_feature (351)..(351): n is a, c, t, g, unknown, or other
  misc_feature (352)..(352): n is a, c, t, g, unknown, or other
  misc_feature (360)..(360): n is a, c, t, g, unknown, or other
  misc_feature (637)..(637): n is a, c, t, g, unknown, or other
tggagctccccgcggtggcggccgctctagaactagtggatcccccgggctgcaggaattcgcacgagaccattacctagaacatcctaatcgaaaacttccgtccttggcaaccaggcccaggcatcgtttcaccgctattcctcctgccccatctcctcccgatccatccgagcccaaaccctagtccagccagatctccgccgccgccggcgagagcacggcatcagatccgccgcgatggcgttccgccgcatcttatccacagcggtgcgccgccgctcggncatcgcccgcgnnagcggcgggaacgcgcgcgaggccttcacggncgtcgncgcggggcccggnngtgctagnccccgacgcgaacccggtgggcggtccggtgatggccgtacgatcgcatcgccgaaagcggtaacggcagggttcgggggggttgagcaaccagaaccgggcttccttcggtatggaaggccgggggcggtccaaggcgaacaaaacggcattcttgggggggccggaaaaacggggtcaccaagctgggccaggggctggggggggggaaccgaagatctcccctctccccgcgcacgggtaaaggggggggtgggggaaaaaaggcgggaaaaanggtacaaaaacaggagagggggg

SEQ ID NO: 21428 - protein, 140 aa, Zea mays
  misc_feature: Ceres CLONE 1390535-F
  misc_feature (16)..(16): Xaa is any aa, unknown, or other
  misc_feature (20)..(20): Xaa is any aa, unknown, or other
  misc_feature (31)..(31): Xaa is any aa, unknown, or other
  misc_feature (33)..(33): Xaa is any aa, unknown, or other
  misc_feature (38)..(38): Xaa is any aa, unknown, or other
  misc_feature (40)..(40): Xaa is any aa, unknown, or other
  misc_feature (133)..(133): Xaa is any aa, unknown, or other
MAFRRILSTAVRRRSXIARXSGGNAREAFTXVXAGPGXAXPRREPGGRSGDGRTIASPKAVTAGFGGVEQPEPGFLRYGRPGAVQGEQNGILGGAGKTGSPSWARGWGGGTEDLPSPRARVKGGVGEKRREKXYKNRRGG

SEQ ID NO: 21429 - DNA, 667 bp, Zea mays
  misc_feature: Ceres CLONE 1390538-F
  misc_feature: Translation starting site: 218
  misc_feature: SWISSPROT Homolog: EC 2.3.1.97 Glycylpeptide N-tetradecanoyltransferase
  misc_feature (284)..(284): n is a, c, t, g, unknown, or other
  misc_feature (398)..(398): n is a, c, t, g, unknown, or other
  misc_feature (431)..(431): n is a, c, t, g, unknown, or other
  misc_feature (433)..(433): n is a, c, t, g, unknown, or other
  misc_feature (516)..(516): n is a, c, t, g, unknown, or other
  misc_feature (553)..(553): n is a, c, t, g, unknown, or other
  misc_feature (617)..(617): n is a, c, t, g, unknown, or other
  misc_feature (649)..(649): n is a, c, t, g, unknown, or other
  misc_feature (650)..(650): n is a, c, t, g, unknown, or other
ggagctccccgcggtggcggccgctctagaactagtggatcccccgggctgcaggaattcgcacgagaccattacctagaacatcctaatcgaaaaacaagacgagatctacccgctgccccctcgcattcccctcccccgcgtcgtcatctccccaaatccccccaaaccctaccgccgatccggccccagatcgccatggccgcgcccaacagcaatgacgccgccagcgccagcggcaccggcccggctgggcgaggaggacatctccatcgaggcgttgncgcggcgcgtgcaagagcacatgaccctcaactcgaaccccgccgctcgccgccacaaagttctgggagaacacagcccgtcggccagttccggcgacgccgccgacgcatcgnctaccgaacggccccatcgagccgcccacgcancntcctccgaggtgcgcgccgacccctacccactgcccgccgggccttcgagtggctcacctggccgacctcgatgacgacgcgnctcctcgccgaccctctactcgttgctcgcccaaacntacggtcgaggatgacgagaacatgttccgcttcaactactcccggtttttcttccgctggggntttcaagccggcgtttcttcttccgggctggnnaacatcggcgttcggcg

SEQ ID NO: 21430 - DNA, 654 bp, Zea mays
  misc_feature: Ceres CLONE 1390550-F
  misc_feature: Translation starting site: 168
  misc_feature (357)..(357): n is a, c, t, g, unknown, or other
  misc_feature (363)..(363): n is a, c, t, g, unknown, or other
  misc_feature (367)..(367): n is a, c, t, g, unknown, or other
  misc_feature (420)..(420): n is a, c, t, g, unknown, or other
  misc_feature (421)..(421): n is a, c, t, g, unknown, or other
  misc_feature (427)..(427): n is a, c, t, g, unknown, or other
  misc_feature (430)..(430): n is a, c, t, g, unknown, or other
  misc_feature (436)..(436): n is a, c, t, g, unknown, or other
  misc_feature (439)..(439): n is a, c, t, g, unknown, or other
  misc_feature (441)..(441): n is a, c, t, g, unknown, or other
  misc_feature (442)..(442): n is a, c, t, g, unknown, or other
  misc_feature (446)..(446): n is a, c, t, g, unknown, or other
  misc_feature (458)..(458): n is a, c, t, g, unknown, or other
  misc_feature (460)..(460): n is a, c, t, g, unknown, or other
  misc_feature (466)..(466): n is a, c, t, g, unknown, or other
  misc_feature (622)..(622): n is a, c, t, g, unknown, or other
tggagctccccgcggtggcggccgctctagaactagtggatcccccgggctgcaggaattcgcacgagaccattacctagaacatcctaatcgaaaaaaccgaaaaacaccatctccacctcgccgccgccgctcggatttccctctacctcaccctgtccggctccatggcgaccgccgcggtggagagcaagaggggcagcgcccggggccgcaaggcgctcgtggccgtgctcgacaacgaggctaacatctccgccgggaaggccgcccaggccgccgatctctcgtcctgctcagcgcagaagaaggcgaagcgggcgccgtcaaggagcagcaaggccaaggccgccgcgncgtcgncggnccgtggtcgtggacgacatagccgagctgcaggggatgctagagcgcctgcgnnctgganaangagaangcngnnaganatggttaggagncnggatgnaggttcctccggaagagggagggaggagatcgagacccagagacagggagcaggagcgtctccaggcgaagctcagtaaagcgcacggccgcccaggggagtcaaggctaccgtgagcctcccttcgtcaagtcgttgctggagaaagagcagaancaacgacaaggaaaagaagaaaaaggggaaag

SEQ ID NO: 21431 - DNA, 650 bp, Zea mays
  misc_feature: Ceres CLONE 1390552-F
  misc_feature: Encodes the peptide sequence at SEQ ID NO. 21432
  misc_feature (179)..(179): n is a, c, t, g, unknown, or other
  misc_feature (180)..(180): n is a, c, t, g, unknown, or other
  misc_feature (195)..(195): n is a, c, t, g, unknown, or other
  misc_feature (196)..(196): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
aagctggagctccccgcggtggcggccgctctagaatagtggatcccccgggctgcaggaattcgcacgagaccattacctagaacatcctaatcgaaaactccttcccctccctctttccacgacaccaaaagaaaccgaaaacatcgacgcgctccgtccaccctcccctaacccgnngtctcctccctacgnnctccagcccagggnnnaaactaaccctagatggggcgcccgtcactctacggtcggcggggcgctttgcttttttcccgcgaggcccgcgtcttaaggtttcgaggagccggggccggtttccgcccctggcaaacccgaggcttcgggcccgggcaatccaagacgcgggctccgggcccgggaaacaccagagggcggcttcggggccggggaaaacaaaaagcccccaagggggagggaaaaaaaggggttgcccccctttttaaaccccccggccgccccccggggaggaaaaaagggaggacgcggggtttgggaaaaaaaggggccccggagtggttcccataaaacccccgcccccacagnnnaaaaaattttatttttttttctcccccggaaggagccgccccaccccggcaaaaaagaagaatcttcttcgagaaacatccccg

SEQ ID NO: 21432 - protein, 106 aa, Zea mays
  misc_feature: Ceres CLONE 1390552-F
MGRPSLYGRRGALLFSREARVLRFRGAGAGFRPWQTRGFGPGQSKTRAPGPGNTRGRLRGRGKQKAPKGEGKKGVAPLFKPPGRPPGRKKGRTRGLGKKGAPEWFP

SEQ ID NO: 21433 - DNA, 678 bp, Zea mays
  misc_feature: Ceres CLONE 1390555-F
  misc_feature: Encodes the peptide sequence at SEQ ID NO. 21434
aaagctggagctccccgcggtggcggccgctctagaactagtggatcccccgggctgcaggaattcgcacgaaccattacctagaacatcctaatcgaaaaatccaatccgtcagtacccaaccttcccctacaccagaaaaatccccagttctttggtccgcgtcacagaggcggcgctgatgtctggccgcggcaagggtggcaagggtctgggtaagggcggcgcgaagcgccaccggaaggtgctccgcgacaacatccagggcatcaccaagccggcgatccgcaggctgcctaggaggggtggcgtgaagcgcatctcggagctcatctacgaggagacccgcggggtgctcaagatctttctcgagaacgtcatccgcggaccccgtcccctacaccgaggacgcgcgccgcaagaccgtgaccggcatggacgtcgtctacgcgctcaagcgccagggccgcaccctctacgggttcggagggtaggctaggcccctcttcattggcggggactggttaggggacatggctccttgggggtggtttccgggggaaatatttgctgcaataggtggggaaatcccatccccttcctgaatggaagctatggttggggccgggggggggaattggattttctgggacccaaaaggggatttcttccccgaat

SEQ ID NO: 21434 - protein, 105 aa, Zea mays
  misc_feature: Ceres CLONE 1390555-F
MSGRGKGGKGLGKGGAKRHRKVLRDNIQGITKPAIRRLPRRGGVKRISELIYEETRGVLKIFLENVIRGPRPLHRGRAPQDRDRHGRRLRAQAPGPHPLRVRRVG

SEQ ID NO: 21435 - DNA, 660 bp, Zea mays
  misc_feature: Ceres CLONE 1390559-F
  misc_feature: Encodes the peptide sequence at SEQ ID NO. 21436
  misc_feature (305)..(305): n is a, c, t, g, unknown, or other
  misc_feature (328)..(328): n is a, c, t, g, unknown, or other
aaagctggagctccccgcggtggcggccgctctagaatagtggatcccccgggctgcaggaattcgcacgagaccattacctagaacatcctaatcgaaaagctctccaaagtttcgtccaccatttggctcccgcaagcaccgatttgtttactgctctctccgacgcgcggcggcggagctccctacgacaactgaaccatgtgcggcggcgcgatccttgccaaccttcgcgagccggcgccgcgccggctcacagagcgggacatctggcagcagaagaagaagctcaagaggggcggcgncggcggaaggcgctcgttcgcgncggaggacgatgaggacttcgaggccgactttgaggtcttcgaggcagactccagtgattcagatttggagctcagggaggggactgacgacgacgtcgtcgagatcaagcccttcactgccaagaggactttctccagcgatggcttaagcaccatgactagtgctgtagcaggtcagccaagaggaagagaaagatctatacaggggtatccgcagaggccttggggcaagtgggctgctgaaatcaagatcctcagaaaggggggccggggggttgggcttggaacttccataggccctgaggagctgcaagagctatgatgtggagcc

SEQ ID NO: 21436 - protein, 149 aa, Zea mays
  misc_feature: Ceres CLONE 1390559-F
  misc_feature (35)..(35): Xaa is any aa, unknown, or other
  misc_feature (43)..(43): Xaa is any aa, unknown, or other
MCGGAILANLREPAPRRLTERDIWQQKKKLKRGGXGGRRSFAXEDDEDFEADFEVFEADSSDSDLELREGTDDDVVEIKPFTAKRTFSSDGLSTMTSAVAGQPRGRERSIQGYPQRPWGKWAAEIKILRKGGRGVGLGTSIGPEELQEL

SEQ ID NO: 21437 - DNA, 655 bp, Zea mays
  misc_feature: Ceres CLONE 1390568-F
  misc_feature: Encodes the peptide sequence at SEQ ID NO. 21438
  misc_feature (324)..(324): n is a, c, t, g, unknown, or other
  misc_feature (379)..(379): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (591)..(591): n is a, c, t, g, unknown, or other
  misc_feature (614)..(614): n is a, c, t, g, unknown, or other
aaaagctggagctccccgcggtggcggccgctctagaactagtggatcccccgggctgcaggaattcgcacgagaccattacctagaacatcctaatcgaaaactcttcgtcgtcctatcttataatcgcatttcgaaatccccaaacggaggcctcgccactcttccgaacctgaacaatcaccaccgttattaagaagatgatgcgctgcgctgcaacgggcggcgggtgcgtcgcttcgtggagcggcgattggagattgccggcggtcaacccctgcagcgtgcggatgctgacgggcaacgatgggtggtgcgccggcntgaggtcgcgggcggcggatctcgccggcctcgagatggcaacctgcgcggcggncgtcggggggctcttccgcgcgagcccgcgctacgggcgcttgcaagccacggcggcagttgaccctgaagaattccattggaggaagttcaagttaaatcctcaggacatgttctgccatatgttggcgttgcttgtttgnnnngctattctgtttgttaccatccttgtgtggtcaatggcgcacttgatatctcgcgaaggatcttggnattgctgaaatgctgttttgcanggggtgggtggtaacacatccttggctgtggaacactaggt

SEQ ID NO: 21438 - protein, 132 aa, Zea mays
  misc_feature: Ceres CLONE 1390568-F
  misc_feature: SWISSPROT Homolog: EC 5.2.1.2 Maleylacetoacetate isomerase
  misc_feature (42)..(42): Xaa is any aa, unknown, or other
  misc_feature (60)..(60): Xaa is any aa, unknown, or other
  misc_feature (107)..(107): Xaa is any aa, unknown, or other
  misc_feature (108)..(108): Xaa is any aa, unknown, or other
  misc_feature (131)..(131): Xaa is any aa, unknown, or other
MMRCAATGGGCVASWSGDWRLPAVNPCSVRMLTGNDGWCAGXRSRAADLAGLEMATCAAXVGGLFRASPRYGRLQATAAVDPEEFHWRKFKLNPQDMFCHMLALLVXXAILFVTILVWSMAHLISREGSWXC

SEQ ID NO: 21439 - DNA, 703 bp, Zea mays
  misc_feature: Ceres CLONE 1390570-F
  misc_feature (317)..(317): n is a, c, t, g, unknown, or other
  misc_feature (347)..(347): n is a, c, t, g, unknown, or other
  misc_feature (348)..(348): n is a, c, t, g, unknown, or other
  misc_feature (443)..(443): n is a, c, t, g, unknown, or other
  misc_feature (450)..(450): n is a, c, t, g, unknown, or other
  misc_feature (456)..(456): n is a, c, t, g, unknown, or other
  misc_feature (457)..(457): n is a, c, t, g, unknown, or other
  misc_feature (507)..(507): n is a, c, t, g, unknown, or other
aaagctggagctccccgcggtggcggccgctctagaactagtggatcccccgggctgcaggaattcgcacgagaccattacctagaacatcctaatcaaaaaaccatcaccgcctcgtgtgcagcgtgctcgcccacctcctctgtcgacactcagggtactgacgcaccaccccgaagccctcccgccgcgctcgcagggtgttcgacccttcgcccgcgcgccctcacgacatgcctcctccgtctccgccgccgccaaggccgccgcggcgttcgcgcacaaggtccagaaggagctgggccgcgccggcgagncgcccgcgcgggcttgacccgcgggacagnncgggggcagcggtggcgcgccgtcgcttcgcccgcgcgcggccctgtcgtccaccgggctcggtgaagagcgcgatgacgatggacggagaaatnactgggncgcggnncgtcggagcgccgcggcgctgggagccccgggagaaacgtggtggtcccnacggtcgacggtgctcatgaacgcaccgacggtctgcggggcccggcgcccttcgacatctttcaaagaaggaggttcggggaagggacgcccagggtcctgggaaccgcgagaaagctccgtcgtcatccccgggaccactaacttctttcaccaggcgaacggcccggggcaaaaaggcaacggtccaacttcc

SEQ ID NO: 21440 - DNA, 664 bp, Zea mays
  misc_feature: Ceres CLONE 1390571-F
  misc_feature: Encodes the peptide sequence at SEQ ID NO. 21441
  misc_feature (166)..(166): n is a, c, t, g, unknown, or other
  misc_feature (167)..(167): n is a, c, t, g, unknown, or other
  misc_feature (559)..(559): n is a, c, t, g, unknown, or other
aaagctggagctccccgcggtggcggccgctctagaactagtggatcccccgggctgcaggaattcgcacgagaccattacctagaacatcctaatcgaaaaattaggacaagcattagtgttcgctcgtcactcgtcagtactcagtggaggaggcggcggcggnnagggagacagatgcgggaggcccaccgcggggtcgccggaccagatggacacgccggataggccccgcgccggcgccggcgccgggttcgaggattctcctgtgttcaatttcatcaacaatctctcgcctataccaccacctaaacctttagactcagcacataatgtgcagctattcaagtcatcagatttggcacctgtttcttcgatctttgcctcaccacatgttaatccaacaaagggactaaagttctgatcagggacgaatctgttcagcttcctcatgaattgcctccacctagcagtgtcagaactcggataggcacctcaggctcttttagaatgatcagatgcaaagacattgtgccagagaattgtaatatcacttgtncactaaacgaggcatctattgattcttcagatcatacatcaagctctaccgggcaaaggactcaatccataaaagatgctgctggcaggatgggaagcgataagg

SEQ ID NO: 21441 - protein, 70 aa, Zea mays
  misc_feature: Ceres CLONE 1390571-F
MDTPDRPRAGAGAGFEDSPVFNFINNLSPIPPPKPLDSAHNVQLFKSSDLAPVSSIFASPHVNPTKGLKF

SEQ ID NO: 21442 - DNA, 659 bp, Zea mays
  misc_feature: Ceres CLONE 1390574-F
  misc_feature (396)..(396): n is a, c, t, g, unknown, or other
  misc_feature (398)..(398): n is a, c, t, g, unknown, or other
  misc_feature (571)..(571): n is a, c, t, g, unknown, or other
  misc_feature (612)..(612): n is a, c, t, g, unknown, or other
aagctggagctccccgcggtggcggccgctctagaactagtggatcccccgggctgcaggaattcgcacgagaccattacctagaacatcctaatcgaaaaatcgacctgttctacaaatttttcaacatctgcttgatcgatcttactggcgaagcgcttttggggccttcccctcctcttctttgcaggcacgacttcttcgccgctgctacctttgtcgcccctcctccttctccggccactgcgcacaagggcgacggcaatggctgctgctgccacattggtgagcagtcaccgtcaccgatctccacctcagaccactgtcgctcgtcctccatctcccagcgcccacaccattccctgtgcgcccactgccgacgatcccacggtcagngncccgctcctccttcccacgcccgacaactccaacgtcgtggcgcagggccagcgggtgcgccgccgagcggaaacgcttctcgtgcacgacgacggccgcgggcggcaggtgtggcgcgcactgcagcgccaggaacaccgtccccagggactcgccctctccaccgcctctngtgaccaggcaaaggacgagcagcaagggcgtaaaacgcgncgaggccaccgatcgtcgcgacctctggtcatctacatctcagacgg

SEQ ID NO: 21443 - DNA, 626 bp, Zea mays
  misc_feature: Ceres CLONE 1390576-F
  misc_feature: Translation starting site: 206
  misc_feature: SWISSPROT Homolog: EC 2.7.11.1 Non-specific serine/threonine protein kinase
  misc_feature (273)..(273): n is a, c, t, g, unknown, or other
  misc_feature (298)..(298): n is a, c, t, g, unknown, or other
  misc_feature (332)..(332): n is a, c, t, g, unknown, or other
  misc_feature (404)..(404): n is a, c, t, g, unknown, or other
  misc_feature (444)..(444): n is a, c, t, g, unknown, or other
  misc_feature (567)..(567): n is a, c, t, g, unknown, or other
  misc_feature (585)..(585): n is a, c, t, g, unknown, or other
caaagctggagctccccgcggtggcggccgctctagaactagtggatcccccgggctgcaggaattcgcacgagaccattacctagaacatcctaatcaaaaaaccaggcaagcaagcgggagccgccaactcgtgcctctcggcagcggcgtctgaactctgaaccgaccgaccgaccgaccgttccgttccgttcaccccaccatggaggcgccgccgggaccggggcccatggagctggacgccccacctcccgccgccgccgccgcggngattcctcccgccggcagcgacagnccacaaggacggggaagggggagacgctgtgacnggccatatcatctccacccacatcggcgggaagaacggcgagcccaagcggacatcagttacatggcagaancgtgtcgtgggcacaggcttcattttggatcgtcttccangctaagtgtctggaaacaggagagacctcgcccattcagaaggtgctgcaagatcggcgttacaagaaccgggagctgcaacttatgcgtggcatggagcaccccacgtcatctggctgaagnactgcttctctcgacagnagaggggaaaggaattgtttttaaacttgccatgggattcg

SEQ ID NO: 21444 - DNA, 682 bp, Zea mays
  misc_feature: Ceres CLONE 1390579-F
  misc_feature (325)..(325): n is a, c, t, g, unknown, or other
  misc_feature (336)..(336): n is a, c, t, g, unknown, or other
  misc_feature (344)..(344): n is a, c, t, g, unknown, or other
  misc_feature (358)..(358): n is a, c, t, g, unknown, or other
  misc_feature (478)..(478): n is a, c, t, g, unknown, or other
aaagctggagctccccgcggtggcggccgctctagaatagtggatcccccgggctgcaggaattcgcacgagaccattacctagaacatcctaatcgaaaaaaaatcaaatgattccttgcttgcccccctttccctccaaaattctcgctgcggccctcgtcttcctcctcttcttcttctgtaaagtgccaagtgccaactgcattctggcttacttggaacaccactccttgattccttcccattcccacagtctcatcttgcatagtgctagaacttatccatttgcttgctactgctcttgcccagcatgagcaaacggncgatgatgacnacgccggncggcggagaagacngtgagccatccagcggcgctcgcggagccggtgcgcccgcgccgtctaaagcggtcggtaccggccgctacgcaagactgcagagcgccggcaccgggaccagtggcgccgacgggaccnggcccagacgtcatgtgacctaatatggaagggccgtttttgaaggggcggagcagccgcaaacgatggacggttaacgggggccggggaaactgcccccgccccagaacgggaacgcaaagcccccaggccgacctaacacgccctggtgtcccagaagaagacgaagagccgggggatttgatgaacacaaccaacgggttg

SEQ ID NO: 21445 - DNA, 680 bp, Zea mays
  misc_feature: Ceres CLONE 1390582-F
  misc_feature (215)..(215): n is a, c, t, g, unknown, or other
  misc_feature (338)..(338): n is a, c, t, g, unknown, or other
  misc_feature (339)..(339): n is a, c, t, g, unknown, or other
aaagctggagctccccgcggtggcggccgctctagaatagtggatcccccgggctgcaggaattcgcacgagaccattacctagaacatcctaatcgaaaagacgcccatgaggggcctgatctaatgtagcgttaggaagaaagcctactgttccatctctttcttggagtacgagggcacgaaggcctaaccccctcgcccccaccagattcngggaattcgcgcctcatccgatcgtcaccggccgccgaagcgcaagaaacagcggccgggttaggactctggaggggatacgcgctcggcggattcaggaagggaggatattttctgggattnnctgtctgatggggagaggatctcggattaactactgcgtattcactggatggtggcaatggggtcagaaaaggggagctctatccttctccgactaaggtccaaggcaaaaaaaaaagacctgggtctgaaaaggcaattacattaaaagggggaaggggcaagggccctggaaggttcttccccctggaggatttcgggaaaaagtttttccctttgtggctggggaaaaaaaaaaaaaaatgggggtcttttttccaaaggggggaataaaaatttgccctgccccgggggcccctttggaaaaaaaatgggcctccaaaaacggggggtattttgttt

SEQ ID NO: 21446 - DNA, 646 bp, Zea mays
  misc_feature: Ceres CLONE 1390588-F
  misc_feature: Encodes the peptide sequence at SEQ ID NO. 21447
  misc_feature (573)..(573): n is a, c, t, g, unknown, or other
  misc_feature (574)..(574): n is a, c, t, g, unknown, or other
  misc_feature (590)..(590): n is a, c, t, g, unknown, or other
  misc_feature (637)..(637): n is a, c, t, g, unknown, or other
aaagctggagctccccgcggtggcggccgctctagaactagtggatcccccgggctgcaggaattcgcacgagaccattacctagaacatcctaatcaaaagaggctcttctcctcctcgcctcctctccctagcctccacgacgcaagggagagtgacgtaaagcgacgcggcgcgagcgaggagggccaaggggaagaggggaagcaccgcaccaggacccttgttcgccgccgccgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtatacaaggtgaagcttgtcgggcctggaggtgaagagcacgagtttgatgctccagacgacgcctacatccttgacgcagccgagactggcactctctcgagtcgattcctagcagctagccggtgactcnnatcttagcgtgctacnatgggcgcagctgctagtggcctgctcctcctgctctgctcagcttnctgctcctg

SEQ ID NO: 21447 - protein, 98 aa, Zea mays
  misc_feature: Ceres CLONE 1390588-F
MSTSTFATSCTLLGNVRTTQASQTAVKSPSSLSFFSQVTKVPSLKTSKKLDVSAMAVYKVKLVGPGGEEHEFDAPDDAYILDAAETGTLSSRFLAASR

SEQ ID NO: 21448 - DNA, 719 bp, Zea mays
  misc_feature: Ceres CLONE 1390588-R
  misc_feature (17)..(17): n is a, c, t, g, unknown, or other
  misc_feature (20)..(20): n is a, c, t, g, unknown, or other
  misc_feature (23)..(23): n is a, c, t, g, unknown, or other
  misc_feature (48)..(48): n is a, c, t, g, unknown, or other
  misc_feature (53)..(53): n is a, c, t, g, unknown, or other
ttgttgtgttcgtgggnggnggncttactctcctcttttttatttaantccgnttccgaatgggtacgggccccccctcgaggtcgacggtatcgataagcttttttttttttttttttaataaaccataaacaagcattgatgttcacggtcccaaaaggtgcaatccccacaaacatctcccatcaccatgtggccagattcgggggttgctgctagtacagcgtaacaacacaataagttgcacgacaccactcccctgcagccctacaataatcagccttgcaggtttttgttttgcttaacccattgctacaatcactggtgcagaaaataaacagctcaatcctatggtaataataagagaaggaaatgcctaagcgggtgctaataataagcaacctcggaatggcgggagcctcttctttactacaccgaagaaggtttctccttctctcttgctcacacccacactcgtcgatggagtagtagtagctagaactgggcgccctcgaaggtctggccgaactgccagcccgccggagcgacgccgttgctggtgacagtgcggccgtcgctggcggtgacctgaaaagacaagctctggctgtcaagaagcgagttgctccgccagttctggccccagttgcgggacatgggctgccacccgggtgttggagcccttgatggaaactgactgcacgtccccggcgccggcg

SEQ ID NO: 21449 - DNA, 684 bp, Zea mays
  misc_feature: Ceres CLONE 1390589-F
  misc_feature: Encodes the peptide sequence at SEQ ID NO. 21450
  misc_feature (265)..(265): n is a, c, t, g, unknown, or other
  misc_feature (320)..(320): n is a, c, t, g, unknown, or other
  misc_feature (366)..(366): n is a, c, t, g, unknown, or other
  misc_feature (370)..(370): n is a, c, t, g, unknown, or other
  misc_feature (396)..(396): n is a, c, t, g, unknown, or other
aaagctggagctccccgcggtggcggccgctctagaactagtggatcccccgggctgcaggaattcgcacgagaccattacctagaacatcctaatcgaaaaatccgccggcgagatggcgttgtacctgctgttcgagtcggcctccggctacggcctattccatgcgtacggtatcgatgagatcgggcagagcgttgaggccgtgcgctcctccgtgctggacctcgaccgcttcggcaaggccgtcaagctcactgccttncatcctttctcctctgccgtcgacgcgctcaaccagtggcacgctatctctgaanggatcatgaccgatgagttgaggagcttcctggagctgacctgccngagnctagggagggggaagaaggcaatacnggcctcggcggtgtcgagcccagggtcgcctccaattctccgaagtcaccggaatcccctgcaaaagaaacggagtcgcccggagttggttccgggggggccgcctccattttgacgggtttataaggggtttaaggattttgggttggggaaaggcccaatttgggccgggggttaattacgggggggtttagggggaggttcagggggatccgggtttaaaaaaggggggaccaaaaaatttttcgggtgggaacactgtggaggggctcccttcttctccggggg

SEQ ID NO: 21450 - protein, 131 aa, Zea mays
  misc_feature: Ceres CLONE 1390589-F
  misc_feature (3)..(69): Pfam Name: NOP5NT Pfam Description: NOP5NT (NUC127) domain
  misc_feature (50)..(50): Xaa is any aa, unknown, or other
  misc_feature (69)..(69): Xaa is any aa, unknown, or other
  misc_feature (84)..(84): Xaa is any aa, unknown, or other
  misc_feature (85)..(85): Xaa is any aa, unknown, or other
  misc_feature (94)..(94): Xaa is any aa, unknown, or other
MALYLLFESASGYGLFHAYGIDEIGQSVEAVRSSVLDLDRFGKAVKLTAXHPFSSAVDALNQWHAISEXIMTDELRSFLELTCXXLGRGKKAIXASAVSSPGSPPILRSHRNPLQKKRSRPELVPGGPPPF

SEQ ID NO: 21451 - DNA, 660 bp, Zea mays
  misc_feature: Ceres CLONE 1390594-F
  misc_feature: Encodes the peptide sequence at SEQ ID NO. 21452
  misc_feature (292)..(292): n is a, c, t, g, unknown, or other
  misc_feature (304)..(304): n is a, c, t, g, unknown, or other
  misc_feature (363)..(363): n is a, c, t, g, unknown, or other
  misc_feature (374)..(374): n is a, c, t, g, unknown, or other
  misc_feature (432)..(432): n is a, c, t, g, unknown, or other
  misc_feature (503)..(503): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcgaaaaataggacgaactaccgatgcaagctgcgatcgatcagtcaccgcatctccggttccgcgcaggcatggacgacaagtcctgctacgtggccaccggcctctccctggcggccatcctcctcgtcctccaccgcctcgtggtccgtgctggcggcaaggggaacgccgccgcgcggcggctgcctcctagnccctccgccgtnccgttccctcggcacctccacctgctagcatcggagtgccctctccactcgtcgctggnccgcctcgcgncgcgccacggccccgtgctctcgctgcgcctggctcccgcgccgccgtggtggtgtcntcgcccgagtggcgcgaggcgtgcttccggagcacgacgtggcgttcgccaaccgccaatttggactgcgnaggggctggcctccttcggcgncgcggcgctggccgtgtctaagtacgggccctactgcgcaccctccgggggcgtgggcggcgtggggctctctccacggaaccgggtggggtggcatgggccccgccattctcggccgaggggcgcgcatggttg

SEQ ID NO: 21452 - protein, 164 aa, Zea mays
  misc_feature: Ceres CLONE 1390594-F
  misc_feature (42)..(42): Xaa is any aa, unknown, or other
  misc_feature (66)..(66): Xaa is any aa, unknown, or other
  misc_feature (70)..(70): Xaa is any aa, unknown, or other
  misc_feature (89)..(89): Xaa is any aa, unknown, or other
  misc_feature (113)..(113): Xaa is any aa, unknown, or other
  misc_feature (120)..(120): Xaa is any aa, unknown, or other
MDDKSCYVATGLSLAAILLVLHRLVVRAGGKGNAAARRLPPXPSAVPFPRHLHLLASECPLHSSLXRLAXRHGPVLSLRLAPAPPWWCXRPSGARRASGARRGVRQPPIWTAXGLASFGXAALAVSKYGPYCAPSGGVGGVGLSPRNRVGWHGPRHSRPRGAHG

SEQ ID NO: 21453 - DNA, 649 bp, Zea mays
  misc_feature: Ceres CLONE 1390597-F
  misc_feature: Encodes the peptide sequence at SEQ ID NO. 21454
  misc_feature (599)..(599): n is a, c, t, g, unknown, or other
aagctggagctccccgcggtggcggccgctctagaactagtggatcccccgggctgcaggaattcgcacgagaccattacctagaacatcctaatcgaaaactccctccctcctccattggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatgggttgcacttgctatcaggccaaggcctggtgtctgggattacattcgggtgaatgtaagtgagctggctgtggaggagctgagtgtttctgagtacttggcattcaaggaacagctggtggatggacaatccaacagcactttgtgcttgagcttgattttgagcccttcatggccctctttcctcgtcttncatgtcgaagtcatcggaaatggagtgcattccttaaacgacactgtcgt

SEQ ID NO: 21454 - protein, 160 aa, Zea mays
  misc_feature: Ceres CLONE 1390597-F
  misc_feature: SWISSPROT Homolog: EC 2.4.1.13 Sucrose synthase
  misc_feature (144)..(144): Xaa is any aa, unknown, or other
MAAKLTRLHSLRERLGATFSSHPNELIALFSRYVHQGKGMLQRHQLLAEFDALFDSDKEKYAPFEDILRAAQEAIVLPPWVALAIRPRPGVWDYIRVNVSELAVEELSVSEYLAFKEQLVDGQSNSTLCLSLILSPSWPSFLVXHVEVIGNGVHSLNDTV

SEQ ID NO: 21455 - DNA, 661 bp, Zea mays
  misc_feature: Ceres CLONE 1390599-F
  misc_feature: Encodes the peptide sequence at SEQ ID NO. 21456
  misc_feature (418)..(418): n is a, c, t, g, unknown, or other
  misc_feature (439)..(439): n is a, c, t, g, unknown, or other
  misc_feature (440)..(440): n is a, c, t, g, unknown, or other
  misc_feature (561)..(561): n is a, c, t, g, unknown, or other
aaagctggagctccccgcggtggcggccgctctagaactagtggatcccccgggctgcaggaattcgcacgagaccattacctagaacatcctaatcgaaaaaaccaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcgatctggagaaatttctaagtcgtcgtcgtcgtcgtcgttcggttcggagcgaatctgnagcgacgatggctggaggcgnncggatctcttggtctgcagtcctgcttcacctcgatggatgatgtctctgcgctgataattattggatcaatttccgatattattagtagatctatgagatatgccggctggaagaggcgnagtaagctgcagcatgtaaaagtctgcgtgcgtcgacagcaaaaaagagaaaaaaagatgtgacatcctaagaggaggctttgccatgatgggtgcgctc

SEQ ID NO: 21456 - protein, 74 aa, Zea mays
  misc_feature: Ceres CLONE 1390599-F
  misc_feature (54)..(54): Xaa is any aa, unknown, or other
  misc_feature (61)..(61): Xaa is any aa, unknown, or other
MLCRLRSDCWIRHLTGLNRARTGRKQQTRVGSCIDLEKFLSRRRRRRSVRSESXATMAGGXRISWSAVLLHLDG

SEQ ID NO: 21457 - DNA, 663 bp, Zea mays
  misc_feature: Ceres CLONE 1390602-F
  misc_feature: Encodes the peptide sequence at SEQ ID NO. 21458
  misc_feature (466)..(466): n is a, c, t, g, unknown, or other
  misc_feature (467)..(467): n is a, c, t, g, unknown, or other
  misc_feature (514)..(514): n is a, c, t, g, unknown, or other
  misc_feature (571)..(571): n is a, c, t, g, unknown, or other
  misc_feature (588)..(588): n is a, c, t, g, unknown, or other
  misc_feature (608)..(608): n is a, c, t, g, unknown, or other
  misc_feature (610)..(610): n is a, c, t, g, unknown, or other
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaagatccctgtaacccaccacatccagtggcagtgctgccggctcgcttcatcaattttagaatggtaacagagcctatcagctctgttcccccagtagacacctaaactttgccacatagccaataacggatcggatcgccttcgtacttttcctacttgctatctccagcgctaggctatcagctagcactagcagcgccgtcactgttcgaagagatcagcgcagcgaactcgcagccgagagatcgatcgaggccggccggggccgagatgggcagcgtcggcgtcggttgcggctcgccggacgaggagcagcagaccgagggcagtggccctctgccgccgccggctgtctgcgtcacgnngtccaccggctacgtcggctcctggctcgtccgcacgctgctgcggngaggctaccgcgtccacgcccaccgcagggacacaggcaaggccttgcagtgcttcnccgtcgtggaaagaggnagggaccgctcagtgtaaangncccccaaaaagggggnaaaaaaaaaaaaactttccacccccgccgtcccgggg

SEQ ID NO: 21458 - protein, 77 aa, Zea mays
  misc_feature: Ceres CLONE 1390602-F
  misc_feature: SWISSPROT Homolog: EC 1.1.1.219 Dihydrokaempferol 4-reductase
  misc_feature (32)..(32): Xaa is any aa, unknown, or other
  misc_feature (48)..(48): Xaa is any aa, unknown, or other
  misc_feature (67)..(67): Xaa is any aa, unknown, or other
MGSVGVGCGSPDEEQQTEGSGPLPPPAVCVTXSTGYVGSWLVRTLLRXGYRVHAHRRDTGKALQCFXVVERGRDRSV

SEQ ID NO: 21459 - DNA, 617 bp, Zea mays
  misc_feature: Ceres CLONE 1390604-F
  misc_feature: Encodes the peptide sequence at SEQ ID NO. 21460
  misc_feature (351)..(351): n is a, c, t, g, unknown, or other
  misc_feature (352)..(352): n is a, c, t, g, unknown, or other
  misc_feature (362)..(362): n is a, c, t, g, unknown, or other
  misc_feature (386)..(386): n is a, c, t, g, unknown, or other
aaagctggagctccccgcggtggcggccgctctagaactagtggatcccccgggctgcaggaattcgcacgagaccattacctagaacatcctaatcgaaaaagcaggagaagagagacgacacagcagctttttgggtttccccttccctttccccgcgcggtgatcgcagggttctccgcgagcgaggcagagcactgcgcgtcctccgtgacttcctggtgatcgctgggggttctggacgttggtgtttcatttggttggttggtgggtggcagcagccgtggcgagatggacctgatgatgccggtgacggtgaaggagagtggcccgccggaaaggaggagaagnnagagacgtgnacgcggacgcggacgctccgcggncgatggaggggctgcacgaggtcgggccaccgccgttcctgaccaagacgttcgacctggtggccgacccggccaccgacgaggtcatctcctggggccgcgccggcaacagtttcgtggtctgggatccccacgtgttcggcgccgtgctgctccccaggttctttaagcaccacaacttctccagctttgtgcgccagctgaacacctaactagatggacccagacagg

SEQ ID NO: 21460 - protein, 69 aa, Zea mays
  misc_feature: Ceres CLONE 1390604-F
  misc_feature (10)..(70): Pfam Name: HSF_DNA-bind Pfam Description: HSF-type DNA-binding
  misc_feature: The sequence is a functional homolog of SEQ ID NO 192 in the 10/412,699 US patent application
MEGLHEVGPPPFLTKTFDLVADPATDEVISWGRAGNSFVVWDPHVFGAVLLPRFFKHHNFSSFVRQLNT

SEQ ID NO: 21461 - DNA, 683 bp, Zea mays
  misc_feature: Ceres CLONE 1390608-F
  misc_feature: Encodes the peptide sequence at SEQ ID NO. 21462
  misc_feature (596)..(596): n is a, c, t, g, unknown, or other
aaagctggagctccccgcggtggcggccgctctattactagtggatcccccgggctgcaggaattcgcacgagaccattacctagaacatcctaatcgaaaaactactagtgatcagaccagtgagctagcgactgtaccatgcagcagctgtaggagagcctggtggtaggtaggataggagtagcgccagccgccaagtgcgcgtccgggctggctgcttcgacgagcaggagggagccgcaccgccgggctcccgcaatgtcgcctcctccgcccccgccgctgctgcgcaacgagctgtcgcgcaggacggcggtgctgggcctgcgcctgtgggtgctggtgggcatcgccgtcggggccgccttcgtgctgctcctcgtgctcatctccctccacctcgccgcggcgcggcggaggccgcccccgaagggcgtcgaggacgggcacgcgcccgcgccggcgggggggccccccgctgtccccgtcccccctccccccccgtgccccaagaacatccccgagcgcggccgttcaccgtcgggctcgctccccgcacctatcctctaacaccgggcccccgcgtttcccttnaaggaaccgtctcccgtccatacggccccaggcctcaccggcgacattcccgtgggcgacccacgggcccacctaaccgccgccccc

SEQ ID NO: 21462 - protein, 103 aa, Zea mays
  misc_feature: Ceres CLONE 1390608-F
MSPPPPPPLLRNELSRRTAVLGLRLWVLVGIAVGAAFVLLLVLISLHLAAARRRPPPKGVEDGHAPAPAGGPPAVPVPPPPPCPKNIPERGRSPSGSLPAPIL

SEQ ID NO: 21463 - DNA, 599 bp, Zea mays
  misc_feature: Ceres CLONE 1390611-F
aagctggagctccccgcggtggcggccgctctagaactagtggatcccccgggctgcaggaattcgcacgagaccattacctagaacatcctaatcgaaaaatgcgtaatcgtctttcggaattgaatctctccatgtcatggcgctctgagcaagtacagctgcagtcagtgagagaaatgtaggcaccacaaatcagtccagcaaatccctgctcgtgctctaccaaaaaatccagtctttttccagcccaaatccgcctcttccgctgctgccataaagtccggactttacgaggctttcacgacgtgcgagatttctgttatcgatctccacgaacccgatagcctgccataaagtctgcacagacgcttcgcattgctttcacccaagatccatcccaactctgcaccccagaaagctagtacgatctcggggggacatgaagccgctgcagtgctccagcagaagcaacgccgcggcaatggtgccggggcggggaagcgcctttgacggcggctgtcccttgccaagtaacaaaaggaaggttctgggcccagtaacttctaacgcccgcaggcgccaggattcggaagggg

SEQ ID NO: 21464 - DNA, 632 bp, Zea mays
  misc_feature: Ceres CLONE 1390614-F
  misc_feature: Translation starting site: 181
  misc_feature: Pfam Name: Nop52 Pfam Description: Nucleolar protein,Nop52
  misc_feature (533)..(533): n is a, c, t, g, unknown, or other
  misc_feature (536)..(536): n is a, c, t, g, unknown, or other
  misc_feature (580)..(580): n is a, c, t, g, unknown, or other
aaagctggagctccccgcggtggcggccgctctagaactagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggccgccgcagacgcgtccgccgagaccgccgccatcgcgcggcgcctggcctcctgcaacaccggcacccgggagcgcgcgctccgctacctcctctccgaatttctgccggcctccgcgccgcgcctctccgccaccgacctcctcaagctctggaagggcatcttcttctgcttctggcacgccgacaagccgctctaccagagctccgtcgcctcgcctccgccgtctccgtcccgccgtcccccgccgatggtgccgccttcctcgccgcctacctcaccacgctccgccgcgagtgggcccacatcgacgtccaccgcctcgacaagttctacctcctcaaccgncgnttcctccaccacgccttcctgcttctccatgctaactccttcgnccccgacgtcacctcccaggtcgtgtccctcctgtcagacaagccctgctcc

SEQ ID NO: 21465 - DNA, 641 bp, Zea mays
  misc_feature: Ceres CLONE 1390615-F
  misc_feature: Encodes the peptide sequence at SEQ ID NO. 21466
  misc_feature (641)..(641): n is a, c, t, g, unknown, or other
aaagctggagctccccgcggtggcggccgctctagaactagtggatcccccgggctgcaggaattcgcacgagaccattacctagaacatcctaaaaaaatctactccaggcgaactgtcgcatccgccgccgcggccaccgcggcctcgccctcgccggcaggagggcacggccgccgccctttgcgctacgccgtcctcggcgccggctttgcgggtctctccgtcgcgtggcacctcctcaaggtcaccctccacttcccctcttccttctctcccggtgtactgtgacaagaaaaatcggctgaatcgacactggcgcgatttcaatgtcagcatagcccgagggattcccgcgtgtcagtggacatctacgacgagaacggggtcggcggaggcgcgtcgggcgtctcgggtggacttctccatccctactcgcctaaagtgaagcttctctggaggggtgctgagttctggaaagaaagcatggatctccttcgcagcgccgagcaagcaaatggaacctcggtatcaaatacaactagtcaagatgataaccttatctggagaagggggattgtacgaccgcctacaactgagaaagctgcagccataattgctggaggtactgctggattgan

SEQ ID NO: 21466 - protein, 51 aa, Zea mays
  misc_feature: Ceres CLONE 1390615-F
MDLLRSAEQANGTSVSNTTSQDDNLIWRRGIVRPPTTEKAAAIIAGGTAGL

SEQ ID NO: 21467 - DNA, 652 bp, Zea mays
  misc_feature: Ceres CLONE 1390617-F
  misc_feature: Encodes the peptide sequence at SEQ ID NO. 21468
  misc_feature (449)..(449): n is a, c, t, g, unknown, or other
  misc_feature (466)..(466): n is a, c, t, g, unknown, or other
  misc_feature (489)..(489): n is a, c, t, g, unknown, or other
  misc_feature (521)..(521): n is a, c, t, g, unknown, or other
  misc_feature (562)..(562): n is a, c, t, g, unknown, or other
  misc_feature (587)..(587): n is a, c, t, g, unknown, or other
aaagctggagctccccgcggtggcggccgctctataactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgcccccggcgccggcgccgccgccgcgccggctctcgtcgccgctaccccgtcgcgcgccgtcgtccccgtcgccgtccgcctcctcgcgcgccaagcctcggaagccctcggcctctcccgcggccttccccagcgacgccgacgactcgctcgacaacccggatctggggcccttcctcctcaagcaggcgcgcgacgccntggtgtcaagcgagggnggtgggcgccgcgcgggcactcnaattccccgagcgcgccgccatggcgctccancgacgcggccgagggcgccgaagctcaagcttgccatgagngctcaagttagccggccgccacccncttgcgggcttccggccggcccgcttgaccccattccccggtcctcgaaccgccacactcactaa

SEQ ID NO: 21468 - protein, 144 aa, Zea mays
  misc_feature: Ceres CLONE 1390617-F
  misc_feature (78)..(78): Xaa is any aa, unknown, or other
  misc_feature (91)..(91): Xaa is any aa, unknown, or other
  misc_feature (102)..(102): Xaa is any aa, unknown, or other
  misc_feature (115)..(115): Xaa is any aa, unknown, or other
  misc_feature (124)..(124): Xaa is any aa, unknown, or other
MPGLAASDNSPPAPAPPPRRLSSPLPRRAPSSPSPSASSRAKPRKPSASPAAFPSDADDSLDNPDLGPFLLKQARDAXVSSEGGGRRAGTXIPRARRHGAPXTRPRAPKLKLAMXAQVSRPPPXCGLPAGPLDPIPRSSNRHTH

SEQ ID NO: 21469 - DNA, 638 bp, Zea mays
  misc_feature: Ceres CLONE 1390618-F
  misc_feature (571)..(571): n is a, c, t, g, unknown, or other
  misc_feature (587)..(587): n is a, c, t, g, unknown, or other
aaagctggagctccccgcggtggcggccgctctagaactagtggatcccccgggctgcaggaattcgcacgagaccattacctagaacatcctaatcgaaaaatcgatcgtccttcctgtcgtttcgttttctcgccggcagggcactgggtacgccgccgccgcctcaacgccaccacgctgccgccgcgccagttcgtcaccgcgagacacaagacacgtgcctcgcttccctcgggccggttggccgtggccggccgtcgctgttctgttcctatttcttggcaactccgcccgtttcacctccggaggaccgacagcgacggcgccagtagatagatgcactactgacgccactggccacctcgagttcgagtgccaagggacgccacgagaccaaccgtgaggacaggacaacggtcgcctttgcccgcggatccgcggatttcgtcttcttgggtgccatggatccagtcgccggcacggcggagcatcggggccccgttggaagtgcgcgcccgcgcgcccggcagacaaatcctcgcgggcgaggcacgccgtcgtccacggnttccgcccgccgtcgnccgctgccatcgatctctacaccaactcctccctcctcttcccgcccgagg

SEQ ID NO: 21470 - DNA, 649 bp, Zea mays
  misc_feature: Ceres CLONE 1390629-F
  misc_feature: Encodes the peptide sequence at SEQ ID NO. 21471
  misc_feature (141)..(141): n is a, c, t, g, unknown, or other
  misc_feature (649)..(649): n is a, c, t, g, unknown, or other
aagctggagctcaccgcggtggcggccgctctataactagtggatcccccgggctgcaggaattcgcacgagaccattacctagaacatcctaatcgaaaagacgactctgcgcgcttccatcccccccccaaccagcggngacagaaacaaacgctcgctcgctcgttcgttgtccgttcattgtcttcgccggcgccgagggaccctgagagggcaggcgggcgagatggcgggcggcggcgttgaggacgtgtacggcgaggaccgcgctaccgaggagcagctgatcacgccgtgggccttctccgtcgcaagcggctacaccctgctgcgcgacccgcggcacaacaagggcctggccttctcggaggcggagcgcgacgcgcactacctccggggcctgctgccgccggcgctggcgtcgcaggagctgcaggagaagaagctcatgcagaccctgcgccggtacgagcagccgctgcaccgctacatcgccatgatggacctgcaggagcggaacgagaggctcttctacaagctcctcatcgaaaacggcgaaggagctggttcccgtcgtctaaacgcccaaccgtcgggggaggcatgccagaagtacgggaagaatttacggccgtcccgcaggggtn

SEQ ID NO: 21471 - protein, 140 aa, Zea mays
  misc_feature: Ceres CLONE 1390629-F
  misc_feature: SWISSPROT Homolog: EC 1.1.1.40 Malate dehydrogenase (oxaloacetate-decarboxylating) (NADP(+))
MAGGGVEDVYGEDRATEEQLITPWAFSVASGYTLLRDPRHNKGLAFSEAERDAHYLRGLLPPALASQELQEKKLMQTLRRYEQPLHRYIAMMDLQERNERLFYKLLIENGEGAGSRRLNAQPSGEACQKYGKNLRPSRRG

SEQ ID NO: 21472 - DNA, 527 bp, Zea mays
  misc_feature: Ceres CLONE 1390630-F
  misc_feature: Encodes the peptide sequence at SEQ ID NO. 21473
  misc_feature (128)..(128): n is a, c, t, g, unknown, or other
  misc_feature (139)..(139): n is a, c, t, g, unknown, or other
  misc_feature (162)..(162): n is a, c, t, g, unknown, or other
  misc_feature (170)..(170): n is a, c, t, g, unknown, or other
  misc_feature (178)..(178): n is a, c, t, g, unknown, or other
  misc_feature (185)..(185): n is a, c, t, g, unknown, or other
  misc_feature (186)..(186): n is a, c, t, g, unknown, or other
  misc_feature (365)..(365): n is a, c, t, g, unknown, or other
  misc_feature (414)..(414): n is a, c, t, g, unknown, or other
aaagctggagctccccgcggtggcggccgctctagaactagtggatcccccgggctgcaggaattcgcacgagaccattacctagaacatcctaatcgaaaacgaaaaattcgaaagatccctccagngaaagattttntcttccctcctccgacgccccangcccaccnaacacacntctatannaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggcaaaaggggaaaggccgcttcggcggncatgggaggtctgctccccttgagctgccctctggctccatgggctggncttacttggcgagaccctcagctttactcccaggacccagcttcttctcgcttcaaacagagaggtaggcgagatcttcagacgaccttctgggttgcccggggggatgctgg

SEQ ID NO: 21473 - protein, 72 aa, Zea mays
  misc_feature: Ceres CLONE 1390630-F
  misc_feature (51)..(51): Xaa is any aa, unknown, or other
MAFFLALVCILILLAIASYVQYTRWQKGKGRFGGHGRSAPLELPSGSMGWXYLARPSALLPGPSFFSLQTER

SEQ ID NO: 21474 - DNA, 636 bp, Zea mays
  misc_feature: Ceres CLONE 1390636-F
  misc_feature: Encodes the peptide sequence at SEQ ID NO. 21475
agagctggagctccccgcggtggcggccgctctagaactagtggatcccccgggctgcaggaattcgcacgagaccattacctagaacatactaatcgaaaaatccgttgatcccatcggcttccccttcctcttcctcgatccccttcctcccccgatcccatccaattccacttccacaccccgggcctcgccgccgacgccgacgccgacgccgccggccatgtccaagtacggcaccattcccacctcctcctccgcgggcggagggcccgtgcccctcggcggcgcctccccgctcgatttcatctcccgcgccaaggctcggggcgcctcggcgctggcgacgcgccggccctggcgcgagctcgtggacgtccacgccgtcggcctgcccccgagcctcggcgacgcgtacctccgcgtgcgcgccaacctcgcccacttcgccatgaactacgccatcgtcgtcctagtcgtcgtcttcctctccctcctctgggaccccgtctccctcatcgtcttcctcgtctgcatgctcgcctgggtcgtcctctacttctccgcggagagcccctcgtcctcttccggcgcggccgcgccgaaggctacgtcctccgcggggtcgccggcgtc

SEQ ID NO: 21475 - protein, 137 aa, Zea mays
  misc_feature: Ceres CLONE 1390636-F
  misc_feature (35)..(134): Pfam Name: PRA1 Pfam Description: PRA1 family protein
MSKYGTIPTSSSAGGGPVPLGGASPLDFISRAKARGASALATRRPWRELVDVHAVGLPPSLGDAYLRVRANLAHFAMNYAIVVLVVVFLSLLWDPVSLIVFLVCMLAWVVLYFSAESPSSSSGAAAPKATSSAGSPA

SEQ ID NO: 21476 - DNA, 583 bp, Zea mays
  misc_feature: Ceres CLONE 1390645-F
  misc_feature (203)..(203): n is a, c, t, g, unknown, or other
  misc_feature (222)..(222): n is a, c, t, g, unknown, or other
  misc_feature (232)..(232): n is a, c, t, g, unknown, or other
  misc_feature (278)..(278): n is a, c, t, g, unknown, or other
  misc_feature (312)..(312): n is a, c, t, g, unknown, or other
  misc_feature (318)..(318): n is a, c, t, g, unknown, or other
  misc_feature (390)..(390): n is a, c, t, g, unknown, or other
  misc_feature (555)..(555): n is a, c, t, g, unknown, or other
agagctggagctccccgcggtggcggccgctctagaactagtggatcccccgggctgcaggaattcgcacgagaccattacctagaacatcctaatcaaaaaactctcgctttcttctgtctcgcctcgccctcgcctttgttgatcttttcctttctcgcgttcccctcgccttcctcttcctcccccacacccaccggtcngcgcccccgtcgccccggnctccctcgtncagagacgagggggtccgcgccgttccgaacgcacaccgcaaccgnatcacatcaccggctgctccccacgtccatccgncctccntcgatcgggctccccggatcgctggaacctccggggggggttccgaactcatttcctccatggattgggatnggaaagggggggtggttcccggccaaccttcaaaaggtaaacaaacgccaaaattttgggacttggttggggggaacccggggaaaaacccaattttcggggaagggtaaattttccgtgtcaaagggaggggcaaaggggaaaaatttcccgaggtttacaggncccggggggggccaaaaaaggggggggg

SEQ ID NO: 21477 - DNA, 634 bp, Zea mays
  misc_feature: Ceres CLONE 1390653-F
  misc_feature: Encodes the peptide sequence at SEQ ID NO. 21478
  misc_feature (248)..(248): n is a, c, t, g, unknown, or other
  misc_feature (634)..(634): n is a, c, t, g, unknown, or other
aaagctggagctccccgcggtggcggccgctctagtactagtggatcccccgggctgcaggaattcgcacgagaccattacctagaacatcctaatcaaaaaacacgcacaccgcgacccagtccagagccagtacgtgcgaagcagcacgcacgctgctggtccgcgtacgcgagacgacggtcaggtcggccggtgcttttcagtttggaataatgacggcgacgacgacgactgccgccggtggnggcaaggtgcagccgcgcggcctgcccgcggagatgtccctgctgctgctcctggtgttggcagcggggctgggcggtggcgccgaggcgcagcagacgtgcgcggggcagctgcgcgggctggccccctgcttgcgctacagcgtgccacccttgccggggcaggttccgccggcgcccgggccggagtgctgctccgcgctgggggccgtgtccagagactgcgcctgcggaacgttcagcatcatcaacagcctgccggccaagtgcgggctcccgccagtcagctgccagtaatgagctgatgatagccagtgcgatgcactgaggcaaaggcaagggatccaaccacgctgaataataaatgccaccggcgtcgagtcgan

SEQ ID NO: 21478 - protein, 109 aa, Zea mays
  misc_feature: Ceres CLONE 1390653-F
  misc_feature (45)..(108): Pfam Name: Tryp_alpha_amyl Pfam Description: Protease inhibitor/seed storage/LTP family
MTATTTTAAGGGKVQPRGLPAEMSLLLLLVLAAGLGGGAEAQQTCAGQLRGLAPCLRYSVPPLPGQVPPAPGPECCSALGAVSRDCACGTFSIINSLPAKCGLPPVSCQ

SEQ ID NO: 21479 - DNA, 608 bp, Zea mays
  misc_feature: Ceres CLONE 1390660-F
  misc_feature: Encodes the peptide sequence at SEQ ID NO. 21480
agagctggagctccccgcggtggcggccgctctagaactagtggatcccccgggctgcaggaattcgcacgagaccattacctagaacatcctaatcgaaaaaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacggaggtggccacggacctgcagatcctcgtggataactgcctctaccatctccacaaggtaattagctcaaggatcgtcagagatcgtgcccaccctttggcctttattcaggaatttgaatctttagttaggatcgttccatacagtgggatcccgtctaggctttgttcggttttcacggattggagacccagaataattcctagccggattacttctctaatttatataaattttgatgagttggaacgaaaccgggtttattccaatagaaacgaacggccccct

SEQ ID NO: 21480 - protein, 121 aa, Zea mays
  misc_feature: Ceres CLONE 1390660-F
MKFMRLGTRPDTFFTAADSVRSVCTEVATDLQILVDNCLYHLHKVISSRIVRDRAHPLAFIQEFESLVRIVPYSGIPSRLCSVFTDWRPRIIPSRITSLIYINFDELERNRVYSNRNERPP

SEQ ID NO: 21481 - DNA, 681 bp, Zea mays
  misc_feature: Ceres CLONE 1390669-F
  misc_feature (413)..(413): n is a, c, t, g, unknown, or other
  misc_feature (414)..(414): n is a, c, t, g, unknown, or other
  misc_feature (425)..(425): n is a, c, t, g, unknown, or other
  misc_feature (438)..(438): n is a, c, t, g, unknown, or other
  misc_feature (484)..(484): n is a, c, t, g, unknown, or other
aaagctggagctccccgcggtggcggccgctctagaactagtggatcccccgggctgcaggaattcgcacgagaccattacctagaacatcctaatcgaaaaatttccattcctcgctcaccaagccaacagccaaatccaattcgccgacgactctctttattcctcccgctcgccgccgccgccaccgcctgagggcaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaacccccgccgcacttnngctcttgattngatttcattcggntcgttcggtgcccctccccgtctggatctgttgcgcgagagcgcgncagcgcgcgagattcgcccccctctctcctctaggaagcaggaagcagccgaccgttcgctgaccgcgccgccaatggccgtccggtgccaatgaccttctgaggggaaacccgcggaaggcccccccgggggcccaaaccccctgggggtctggggagggaacctccccagaaggccggcccttgtgttctttccc

SEQ ID NO: 21482 - DNA, 715 bp, Zea mays
  misc_feature: Ceres CLONE 1390670-F
  misc_feature: Encodes the peptide sequence at SEQ ID NO. 21483
  misc_feature (384)..(384): n is a, c, t, g, unknown, or other
  misc_feature (401)..(401): n is a, c, t, g, unknown, or other
tggcggccgctctagaactagtggatcccccgggctgcaggaattcgcacgagaccattacctagaacatcctaatcgaaaaatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaagtccgtcggcacgggcagccggttcagtttcacagcaactgacgggaaggataagatcaaggcgatgcttcccaccaacttncgggtcggaggtccgcntctggcaacctgaagaacctcggcctcatccgcatcatcgactacacttgcaacgtcgtcaaaggcaaagatgacaaagtcttggttgtcatcaaatgcgagcttgtgtgccaagcgcttgacgccgagatcaacggcgaggccaaaaaagaggagcctccaattgggctgaagcctaaggacgaatggatgggcgtgaatccccactcgctatgaagcccacgcaggaggtgaagtctgcgtcccagatcgtgaatggacagggcgaaaaactgctcctgcaaagccccttctatgaaaaggaggtccatcca

SEQ ID NO: 21483 - protein, 74 aa, Zea mays
  misc_feature: Ceres CLONE 1390670-F
  misc_feature (65)..(65): Xaa is any aa, unknown, or other
  misc_feature (71)..(71): Xaa is any aa, unknown, or other
MDAAKLVTPVAVSHILAHPSAGSDGAVTDLVVQVLDLKSVGTGSRFSFTATDGKDKIKAMLPTNXRVGGPXLAT

SEQ ID NO: 21484 - DNA, 667 bp, Zea mays
  misc_feature: Ceres CLONE 1390673-F
  misc_feature: Translation starting site: 149
tccccgcggtggcggccgctctagaactagtggatcccccgggctgcaggaattcgcacgagaccattacctagaacatcctaatcgaaaaactcatctgatgccgcaacacaaggctgaatttttgttcggtctagccgacccgacgatggcgtccagcgacgggaaaccactgccaaccccggcctctgtgggcggcggcggaggcatctgcattgcggcgccgggggaggcgatgacggaagcgccgaccgcggtggactggtgatgggggccgacgctgtcctcgctccccgagcgtcacgcgaactcggacctgtggacgttctgcgctggacgctgccgatctgaagcgcttgttggtcaagcatccttacgccttatgactcaaccaacacttcgatgagtgtgccgactatgactccgaggtagaccaggcgcgacacctcgtggtggtgtaccttgctgcctactctcatttcgagtagctgctgtcgttccagcaagtgttgtgatagaactctgctgcttatttgcaatcaggactaccattcagccagctagctgcggcctacccccagcagtttcttccattccaccagctggcagcattgaactctgctggttatttacaacagcaacagctaccaccattcaggcagctagg

SEQ ID NO: 21485 - DNA, 775 bp, Zea mays
  misc_feature: Ceres CLONE 1390676-F
  misc_feature: Encodes the peptide sequence at SEQ ID NO. 21486
  misc_feature (1)..(1): n is a, c, t, g, unknown, or other
  misc_feature (2)..(2): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
nntttcccctctctcttccctccctcctttttttttnnnnaggaacaaagcacagctggagctccaccgcggtggcggccgctctccaatagtggatcccccgggctgcatgaattcgcacgagaccattacctagaacatcctaatcgaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcgtgcgtggaggcggcggcggcggcgggtacggtggtggccgtgcaggcggtggctacggcggtggcgggccgcctggaaggcggcggcggtatacggcgggtggcgggcggcctaacgtgggtgggcggcgcaccgtcctaccccgggggagacggcggaggtactaacggggaatgacaaaaacagtgagaggcgcggcttattcggatgtcttcccacacgcccatacctcgctcgcgctacaaagaaaaaagaaaa

SEQ ID NO: 21486 - protein, 143 aa, Zea mays
  misc_feature: Ceres CLONE 1390676-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGVRGGGGGGGYGGGRAGGGYGGGGPPGRRRRYTAGGGRPNVGGRRTVLPRGRRRRY

SEQ ID NO: 21487 - DNA, 789 bp, Zea mays
  misc_feature: Ceres CLONE 1390677-F
  misc_feature (280)..(280): n is a, c, t, g, unknown, or other
  misc_feature (789)..(789): n is a, c, t, g, unknown, or other
ccccgcggtggcggccgctctataactagtggatcccccgggctgcaggaattcgcacgagaccattacctagaacatcctaatcaaaaaactacaatactgctgcgcgctagcggtagcgctcgcactcgcaccacgccaccgctgctgcctgctcctcacagtcctccccgcgctcgcattgcgattcgcgacctagcgcgagggtaccgggggggtggtgcgcgcgcgtgctcggtgatccgggaagcgccgcgagatggccggggggttgaggcgncggtgccccgccgaaatacgacgacttcacgtcgaaccccgtcaaggaccacctccctggggatctcctactgcatcccccagcctccccccgtgggccggaagcggttttttctggggttcacacacaaaacgggccaccgcctgggtaacccccggtgactctcaccaatcgcccccacgtcccccacccggggcgacgcatcgattggaggtccaatgttctcggtatcacaacccctattggcctgcaccatcccatccctatacccaaccccccccttgcaacttttatttcactggcacctctgggacccgctgcttcccctcacaatcccacatcaccacacccaactcgcatatcatcaccctgatactactacaataccatcatctcgcgtcctacatactcaccgcactccacgcccccttcacactaatccgactccgaccctccaacacctacaggataacatactcacatcgtacattacgcagcagatacaaccn

SEQ ID NO: 21488 - DNA, 738 bp, Zea mays
  misc_feature: Ceres CLONE 1390681-F
  misc_feature: Encodes the peptide sequence at SEQ ID NO. 21489
  misc_feature (738)..(738): n is a, c, t, g, unknown, or other
tccccgcggtggcggccgctctacaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggggttccccggagacgatccgcgacccgcgcgggttccccgtgaatttctacccccccgagggaaactgtgtactggttgggatcaaacttcctcgttttcttcatccgggaacgcattcagttccccaaaagtgatccattccgttctaaccccctccgcgctcaccagttcatccacaccgcactttccacccgcccaccagtctcttccctcttacagccttctccctcttcgtttcataccgn

SEQ ID NO: 21489 - protein, 154 aa, Zea mays
  misc_feature: Ceres CLONE 1390681-F
  misc_feature (18)..(154): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFPVNFYPPEGNCVLVGIKLPRFLHPGTHSVPQK

SEQ ID NO: 21490 - DNA, 719 bp, Zea mays
  misc_feature: Ceres CLONE 1390683-F
acccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgagcgacctcccgggagaactacgaccccatcttcaacaatgcggaggagcgccgcacctcccccgtgatacacccgggaggacgccattcacgaactgtctcctttgtccctctcccccgcccgcgtacctgaccataccacagcgcccaccaccctctgcctcaagcatccctcaccttctcccccccttctccccctcccaccccgcccctttgtctgtacctacgggacccattacccaccccactctatcattctcacatcacgtcccgcataatcacccctctccctctatctcttttcttgctcccaccccaatcttc

SEQ ID NO: 21491 - DNA, 743 bp, Zea mays
  misc_feature: Ceres CLONE 1390685-F
  misc_feature: Encodes the peptide sequence at SEQ ID NO. 21492
  misc_feature (312)..(312): n is a, c, t, g, unknown, or other
  misc_feature (330)..(330): n is a, c, t, g, unknown, or other
  misc_feature (331)..(331): n is a, c, t, g, unknown, or other
  misc_feature (348)..(348): n is a, c, t, g, unknown, or other
  misc_feature (380)..(380): n is a, c, t, g, unknown, or other
tccccgcggtggcggccgctctagaactagtggatcccccgggctgcaggaattcgcacgagaccattacctagaacatcctaatcgaaaacaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccaggatctgcgcgatctccggtgaggtgccggacgagccgntggtgtcgaagaagtcgnngcttctcttcgagcggncgctcatcgagcgctacattgaggaccatggncagtgccccatcaccaaggatgagcttactatgaatgatatcggggccggcaataacaacaaggggcgggaagccaggccctttgaaggtgcaagaatccaagactccctgggatttttcaaaaggagggggaggcccaggggcttcaattttgggttgggggcgcgtcctcacccgcgaggaaaaaatttttgtggtggcctccacacggggggcgctgctggggtatataaaccgcggttaaaaaaaaaaaaagaggggtaaacccttttttgccccccgtggaaaaaaaattcccccctttgtgggggaggccccctctccagtgtttgttccccgggaaaaaaaacagtgtgaaaattt

SEQ ID NO: 21492 - protein, 77 aa, Zea mays
  misc_feature: Ceres CLONE 1390685-F
MNDIGAGNNNKGREARPFEGARIQDSLGFFKRRGRPRGFNFGLGARPHPRGKNFCGGLHTGGAAGVYKPRLKKKKEG

SEQ ID NO: 21493 - DNA, 880 bp, Zea mays
  misc_feature: Ceres CLONE 1390692-F
  misc_feature: Encodes the peptide sequence at SEQ ID NO. 21494
  misc_feature (28)..(28): n is a, c, t, g, unknown, or other
  misc_feature (29)..(29): n is a, c, t, g, unknown, or other
  misc_feature (37)..(37): n is a, c, t, g, unknown, or other
  misc_feature (38)..(38): n is a, c, t, g, unknown, or other
  misc_feature (47)..(47): n is a, c, t, g, unknown, or other
tttttttttttttttttcttctacccgnncccccccnnccccacagnagaaccaaactggagctccccgcggtggcggccgctctccaatagtggatcccccgggctgcaggaactcgcacgagaccattacctagaacatcctaatcaaaaaaaaccttgcccctgctcctcacgccgccgccgccgccgccgccgccgtcgccgccaccacatccgtagcgcccagccgccggagaagaggagggagccagcaccagccaccatgggtcgcgtccgcaccaagaccgtgaagaagacctccaggcaggtgatcgagaagtactactcccgcatgaccctcgacttccacaccaacaagaaggtgctggaagaggcctcgatcctcccctcgaaacgcctccgtaacaaggttgcccggcttcaccaccccaccttgaggcgcccggatccagggggggcccaaagccccgggtcattctcccctctaagcttggaaggaagggaggaaccggggaaaccccccaccaagggaaactttcgtcccccggagaaaaaaaccaagcgcgttccgaagggactacaaaaaaagaaactcgccgttgttgaacaaagacgtgaaaccccaggtggaaaaaaggggcccccggggccaaatttgggggatgtggcgcgcaaaatccacacacgggaggaaaaaaagccgcacccgagggtgggggatcgtccaccgcccggcccccaccccaccacagcggcgctcccccgaacacggcaggagcgagctcccccgccacgagcgacctatactgcgtatgttccacgcctcgcgataatagagaggggtggggggcgcgcgcgtggctcccccacgcgcttgg

SEQ ID NO: 21494 - protein, 205 aa, Zea mays
  misc_feature: Ceres CLONE 1390692-F
  misc_feature (1)..(117): Pfam Name: Ribosomal_S17e Pfam Description: Ribosomal S17
MGRVRTKTVKKTSRQVIEKYYSRMTLDFHTNKKVLEEASILPSKRLRNKVARLHHPTLRRPDPGGAQSPGSFSPLSLEGREEPGKPPTKGNFRPPEKKTKRVPKGLQKKKLAVVEQRRETPGGKKGPPGPNLGDVARKIHTREEKKPHPRVGDRPPPGPHPTTAALPRTRQERAPPPRATYTAYVPRLAIIERGGGRARGSPTRL

SEQ ID NO: 21495 - DNA, 734 bp, Zea mays
  misc_feature: Ceres CLONE 1390693-F
  misc_feature (734)..(734): n is a, c, t, g, unknown, or other
tccccgcggtggcggccgctctattactagtggatcccccgggctgcaggaattcgcacgagaccattacctagaacatcctaatcgaaaatctctatgacacgtgccccttcccccctcttaagctaagggacccttgggcaggccggcatcttctccaatctccaccctctgcccctctcgatttcttcttcccatctcccgatccatcgcaacccaaaccctactccaggcagatctccgtctccgccgacgctgccggagtgagcacagcatcagatccgctgtgatggcgttccgccgcatcctatccaccgcggtgcgacgctggtaggccccgccgagcccgattagccagacatcttcttcctggtgctcgaccccatggttgatgagcgtaccccccccaccgcaacgcagaaagttcgaaaactccgtcacgcgtctgtgagaccggtatccggcaatagccccccccctccgggaaccaggatactccgccttcaccacgccctcgcccagcagtcaagcttcgacactatcaacacaggtcagcgctgtcactttatcatcccctcaagaagaaatcagcttacccgcaaacccaatataccaatcctcctcaccccccctgcacgacctactcacaatctccccacgccccctcgtcttctccttccctggcccctccaccactcctctcccgcgacccacatccacccccactccccatn

SEQ ID NO: 21496 - DNA, 703 bp, Zea mays
  misc_feature: Ceres CLONE 1390700-F
  misc_feature: Encodes the peptide sequence at SEQ ID NO. 21497
caccgcggtggcggccgctctatactagtggatcccccgggctgcaggaattcgcacgagaccattacctagaacatcctaatcgaaatacgatcagtcgcgtgtctaggtttcctctctcaccatagcgcccgctctgtcgcccttcgttcacctgctccttcctctcgtccctgcctgccagggagaggggaagtcataggcacggagtgacggacagtataagcgcgtgagaccattgaagttgtccctgtcgttccctgtcctcgcgaacccgcacatgcgaagaatgaaagagaagacgagcgtcctcatgatgaggatgtaactctcaaacacgcatcggggggagaaacagcacttcttcgtccgggtgccacaatagttgatctttctggcatcaccgcacctgctccagagtatcagccacctcctactgcctctgctcaaccaatgagtggaaccagagtttccgttggtggtggagacaacaacgttgttcacaaacgcgaggacgttgggaagactatggttgccaagggttcagcggataggtaaagaacccggtcggccaccgcccaccttcttccacccaaccctccgctttgtattaacagacgttgggaaacagtgggtccatcctatcatagcagtcaagggatgacctatgatattatctatacccgcaaacgccacgcgctcg

SEQ ID NO: 21497 - protein, 34 aa, Zea mays
  misc_feature: Ceres CLONE 1390700-F
MSGTRVSVGGGDNNVVHKREDVGKTMVAKGSADR

SEQ ID NO: 21498 - DNA, 818 bp, Zea mays
  misc_feature: Ceres CLONE 1390705-F
  misc_feature: Encodes the peptide sequence at SEQ ID NO. 21499
acccgcggtggcggccgctcaatactaacggatcccccgggctgcaggaattcccacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgcccccggcgccggcgccgccgacgcgccggctctcgtcgccgctaccccgtcgcgcgacggcgtccccgacgccgtccatccccgccggagtcaagccgctccagaccgcgccacctcttgtggatcctcccccccccccgacgaccaaaaccctccgtcacacctggacccccgcaccccctctcgcacacgaactcccccgacttacgccccccccctccggtgaccgcccacctgtcctctacatcgcccacctccataacccctgaccagcatcctactcgccccctatcaccccatctacttgcctctcctctcccacctccaccgcctccctttactcctgcctccccaccgcgtttcaacgtatttatcgtctcctccccattccgccgcccccaccgcagcacacaccacaaatctattttgccactcgccccccacacccctccactccataccgaccctctaattaccccacatcctctccatcaccgacacccatcccacacgcatataactacctcgccacgcgaatactacgacttctccccccccctatgccccctcacaccccaccccg

SEQ ID NO: 21499 - protein, 99 aa, Zea mays
  misc_feature: Ceres CLONE 1390705-F
MPGLAASDNSPPAPAPPTRRLSSPLPRRATASPTPSIPAGVKPLQTAPPLVDPPPPPTTKTLRHTWTPAPPLAHELPRLTPPPSGDRPPVLYIAHLHNP

SEQ ID NO: 21500 - DNA, 707 bp, Zea mays
  misc_feature: Ceres CLONE 1390707-F
  misc_feature: Encodes the peptide sequence at SEQ ID NO. 21501
gctcttaactagtggatcccccgggctgcaggaattcgcacgagaccattacctagaacatcctaaaaaaaatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacgaggtgatggcccagaagagcaagatatacttcgccatggagtacgtccggggcggcgagctcttcgcccggggcgcccgggggcggcttaaggaggacgccgcgagaaggcacttccacaggtcggctgggagaaaagttaagcaaaaccaaagaatctacagcgcaccaagcccggcgactcgctcatgagacgaatgaacatcacg

SEQ ID NO: 21501 - protein, 139 aa, Zea mays
  misc_feature: Ceres CLONE 1390707-F
  misc_feature (12)..(140): Pfam Name: Pkinase Pfam Description: Protein kinase domain
  misc_feature: SWISSPROT Homolog: EC 2.7.11.1 Non-specific serine/threonine protein kinase
MEKKPTILMNRYELGRTLGQGTFAKVYHGRNLASGESVAIKVIDKEKVMRVGMIDQIKREISVMRLVRHPNVVQLHEVMAQKSKIYFAMEYVRGGELFARGARGRLKEDAARRHFHRSAGRKVKQNQRIYSAPSPATRS

SEQ ID NO: 21502 - DNA, 729 bp, Zea mays
  misc_feature: Ceres CLONE 1390708-F
  misc_feature: Encodes the peptide sequence at SEQ ID NO. 21503
  misc_feature (426)..(426): n is a, c, t, g, unknown, or other
aagctggagctcaccgcggtggcggccgctctattctagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggctcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggnacttcttctcgtcgcgcgaccgcaagtacccgaatggctccaggtctaaccggccggccggtacaggtaactgtaacagacacaaatccagacacacccctacctttccccccaccacgtgtcattaattactgctgccccatccacacacttcctcaaatccaccccacaccattaaaaatccactcataccactgactctacctccccttccacagaccttctcacccatctactttcagatatactcccaccccctacccactactctcacatgatatactagcatctcattttatttcc

SEQ ID NO: 21503 - protein, 107 aa, Zea mays
  misc_feature: Ceres CLONE 1390708-F
  misc_feature (9)..(99): Pfam Name: NAM Pfam Description: No apical meristem (NAM) protein
  misc_feature: The sequence is a functional homolog of SEQ ID NO 108 in the 10/666,642 US patent application
  misc_feature: The sequence is a functional homolog of SEQ ID NO 332 in the 10/412,699 US patent application
  misc_feature (66)..(66): Xaa is any aa, unknown, or other
MDCGGSLQLPPGFRFHPTDDELVMYYLLRKCGGLPLAAPVIAEVDLYKFDPWQLPEKAFGGEKEWXFFSSRDRKYPNGSRSNRPAGTGNCNRHKSRHTPTFPPTTCH

SEQ ID NO: 21504 - DNA, 744 bp, Zea mays
  misc_feature: Ceres CLONE 1390712-F
  misc_feature (373)..(373): n is a, c, t, g, unknown, or other
  misc_feature (414)..(414): n is a, c, t, g, unknown, or other
  misc_feature (431)..(431): n is a, c, t, g, unknown, or other
  misc_feature (476)..(476): n is a, c, t, g, unknown, or other
  misc_feature (484)..(484): n is a, c, t, g, unknown, or other
  misc_feature (555)..(555): n is a, c, t, g, unknown, or other
  misc_feature (556)..(556): n is a, c, t, g, unknown, or other
  misc_feature (559)..(559): n is a, c, t, g, unknown, or other
  misc_feature (567)..(567): n is a, c, t, g, unknown, or other
  misc_feature (592)..(592): n is a, c, t, g, unknown, or other
aaagctggagctcaccgcggtggcggccgctctataactagtggatcccccgggctgcaggaattcgcacgagaccattacctagaacatcctaatcgaaaagtccgccaccggagctcacttcgtcggccttccctcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgctntcggcggcgggccgctgtttgctgcgctgtcctacatccgnttcaagtgtggtgtttngcgttcttaggtttcaagaattggctttttggttgcgttcttggncgagacgnaagggactagggcgcggacaaagaatcagcatgattccgaagcgcggtcagtttcgactccggcgacgtgnnggnggcgcggnggccccgcaaatgctgctctttcgncggcggaagcagcgcccaaagcaacggctttcttccgaggtgttccgatggcggtccctggccatggacgacgcgaagcgcgggggcaagcgtcccttcttcacaaaaacgaagaattcctgggaggagaaatactatcttgagcaggcgcc

SEQ ID NO: 21505 - DNA, 733 bp, Zea mays
  misc_feature: Ceres CLONE 1390714-F
  misc_feature: Encodes the peptide sequence at SEQ ID NO. 21506
  misc_feature (299)..(299): n is a, c, t, g, unknown, or other
  misc_feature (631)..(631): n is a, c, t, g, unknown, or other
  misc_feature (662)..(662): n is a, c, t, g, unknown, or other
ggagctccccgcggtggcggccgctctagaactagtggatcccccgggctgcaggaattcgcacgagaccattacctagaacatcctaatcaaaaatcggatccatggtctcttttctcagccctctcaggctcacacaccacaccagagcagcgcagccgagcatgcactcatcacatcagctcctcgtctccgagctttcctattcctgccttgataattggccaattgttcgatctccttctttactaccccctttgctttcgttgctgctactactactgttccatctcctaggntttcgttgttgtccctgcaggccgccactgagtgatttgttagcagataagatttagatctcccagataaaaaaaagaggttgagaggagagctagcactaggcactagcaatcctgctgtgaggtgaatatggatccagtcgcagcatccatacacggtcatcatcttcctccaccgttcaacacccgggacttccatcaccatctccagcaacagcagcagcagctcaagaaccgaggacgaccacggcagcggcgcgcgaaggccgtgatgctcctcggagatgtcgcagccgctggccacctccatgacgtggcgtccggagcgtggntggcgctgtccctcgtgatgatgatgggcgncttcggcttgttcttgggcttagctctttctggcccgggcacccggagctcgggcacacgggtgcgcgggg

SEQ ID NO: 21506 - protein, 101 aa, Zea mays
  misc_feature: Ceres CLONE 1390714-F
  misc_feature (68)..(68): Xaa is any aa, unknown, or other
  misc_feature (78)..(78): Xaa is any aa, unknown, or other
MDPVAASIHGHHLPPPFNTRDFHHHLQQQQQQLKNRGRPRQRRAKAVMLLGDVAAAGHLHDVASGAWXALSLVMMMGXFGLFLGLALSGPGTRSSGTRVRG

SEQ ID NO: 21507 - DNA, 670 bp, Zea mays
  misc_feature: Ceres CLONE 1390715-F
  misc_feature: Encodes the peptide sequence at SEQ ID NO. 21508
aaagctggagctccccgcggtggcggccgctctacaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgcgccgcaccgtcgcag

SEQ ID NO: 21508 - protein, 108 aa, Zea mays; identical to SEQ ID NO: 16131
  misc_feature: Ceres CLONE 1390715-F

SEQ ID NO: 21509 - DNA, 735 bp, Zea mays
  misc_feature: Ceres CLONE 1390718-F
  misc_feature: Encodes the peptide sequence at SEQ ID NO. 21510
  misc_feature (445)..(445): n is a, c, t, g, unknown, or other
  misc_feature (658)..(658): n is a, c, t, g, unknown, or other
aaagtggagctccccgcggtggcggccgctctagaactagtggatcccccgggctgcaggaattcgcacgagaccattacctagaacatcctaatcgaaaaattaattaacaaagagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccgccgccggacgtccgcgccgcccacctctccttcgcctctgacgcccatgccctccgccgcttncgtcgccggcgtccagggcgagtccccccgccgacgtcgaccgcatcctcgccatgctctccgggggccacagccatggaatcgcccgcctcgtcacaagggtcgccggcggcatccacgccccacgctcgaagacttcttcgccttcctcttctcccccgacctcaacccacccatcgcgcaccaggttcaccaggacatggtcagcgccgntctctcaactaatttcgtgttcacccgggaataattcctacctcactgggaaacagctcaatagggactcccgtgac

SEQ ID NO: 21510 - protein, 118 aa, Zea mays
  misc_feature: Ceres CLONE 1390718-F
  misc_feature (44)..(44): Xaa is any aa, unknown, or other
MGSYAYKYCMCFTRKFRSPDAQPPPDVRAAHLSFASDAHALRRXRRRRPGRVPPPTSTASSPCSPGATAMESPASSQGSPAASTPHARRLLRLPLLPRPQPTHRAPGSPGHGQRRSLN

SEQ ID NO: 21511 - DNA, 737 bp, Zea mays
  misc_feature: Ceres CLONE 1390720-F
  misc_feature: Translation starting site: 256
  misc_feature: Pfam Name: eRF1_1 Pfam Description: eRF1 domain 1
  misc_feature (395)..(395): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (729)..(729): n is a, c, t, g, unknown, or other
  misc_feature (730)..(730): n is a, c, t, g, unknown, or other
  misc_feature (737)..(737): n is a, c, t, g, unknown, or other
cgctcttaactagtggatcccccgggctgcaggaattcgcacgagaccattacctagaacatcctaatcaaaactccattccccactgcatgcgcgctctgtcactgtcagtctcactctcgctcgctaccttggcgacgactggttgaccgccgctgccgctctagagcaggtgcccactgcccaggtcttcttctggtccttcgccggcgacaagcacaaccagggtgattcaagtactctgctttcaccaatatgtctgacggtcaggaaactgacaagaacattgagatttggaagatcaagaagttgatcaaggcattggaatctgctagaggcaatgccaccagcatgatctctctgattatgccaccacgtgaccaaattcccccgcngtgaccaagatgttgggtgatgaatatggaactgcttcaaaaattaagaagaaagtcaacccggcaatctgttttagcagcccatcacctcagctcaagaggaggctgaaagttgttaaacaaggttccccccaaagggactttgttccctaccctggaacaattttttactcgagaaagggcaaggaaaaaaaaaccccccttattgttttttggccctctccagcccaataaggggtcccggacccttgggaaaaaaaccccccctggaactttaaaacctgaagagcggtcctttggagactccctgcgnnnnnnnnnnnnnncannnngnnccccccn

SEQ ID NO: 21512 - DNA, 588 bp, Zea mays
  misc_feature: Ceres CLONE 1390721-F
  misc_feature: Encodes the peptide sequence at SEQ ID NO. 21513
  misc_feature (271)..(271): n is a, c, t, g, unknown, or other
  misc_feature (361)..(361): n is a, c, t, g, unknown, or other
  misc_feature (380)..(380): n is a, c, t, g, unknown, or other
tcaccgcggtggcggccgctctataactagtggatcccccgggctgcaggaattcgcacgagaccattacctagaacatcctaatcgaaaaatccacagctcgcatccgatttccaatttcaaatccttcgatcgcgcagcgccgcccgccctctcgcagctctctccgatggcccgcacgaagcagacggcgaggaagtcaactggcggcaaggcgccgcggaagcagctgggcaccaaggcggcgcgcaagtcggctcccgccaccggncgcgtgaagaaagcgcacaggttcccgcccggcaccgtcgctctccgcgagatccgcaagtaccagaagagcacggagctgctcatccgnaagctggccttccagcggntggtgcgggaaatcgcgcaagacttccagaacggacttcgggtccaatccccccttgtcccccccctttgaaaaggccccccaggggaaatctggggggttcccttaggggaaaacaaccttttgggctttcccgccaaaagggtcccccttttggcccaggaattcccttttccggcgcccaataggggggaaagaggccctatttg

SEQ ID NO: 21513 - protein, 93 aa, Zea mays
  misc_feature: Ceres CLONE 1390721-F
  misc_feature (71)..(71): Xaa is any aa, unknown, or other
MARTKQTARKSTGGKAPRKQLGTKAARKSAPATGRVKKAHRFPPGTVALREIRKYQKSTELLIRKLAFQRXVREIAQDFQNGLRVQSPLVPPL

SEQ ID NO: 21514 - DNA, 705 bp, Zea mays
  misc_feature: Ceres CLONE 1390723-F
  misc_feature: Translation starting site: 227
  misc_feature: SWISSPROT Homolog: EC 1.2.1.3 Aldehyde dehydrogenase (NAD(+))
tcaccgcggtggcggccgctctataactagtggatcccccgggctgcaggaattcgcacgagaccattacctgaacatcctaatcgaaaaataatttcgtcttcttccctctcccaccggtggcctcgcctcgcctatccgatctgccacctcgccgactcgcacgttcctttcaccaactccccagtgcctctccgcgacgcgatccagatccagggtgtgcagcatgtcccggtggaaggaaggagtcgagatggaacaagaaaacctaaacatcttcatgtactacagcagtgtatcagcggaggacgcaccactggatatttcgaatatcgacgggcgcaatagaattcccgaatggctcgcatgcgagttgcagatgtcacctctcgctgcgtcctggcgagtgaagctgacggagaaccagccgctgccccctctgtgctgcgcaggacagtgcctgcagatgatatgcacaggctgttgccacgtgtccttcatagggtcagcactgacagatgagtagaggagcccatcacgccgtcagtccatgtgaactacacaaagctcctcattaatgctaactttgttgattccgcatccggaaagacattcccgactctggacctgcgaacaggggcagggccttgctcatgtggctaacgaagcaccaaaagacattaaccccgcaatagctggctctcc

SEQ ID NO: 21515 - DNA, 653 bp, Zea mays
  misc_feature: Ceres CLONE 1390725-F
  misc_feature: Encodes the peptide sequence at SEQ ID NO. 21516
gctctagaactagtggatcccccgggctgcaggaattcgcacgagaccattacctagaacatcctaatcgaaaaactgctctctctccatctccttctccctctctcccagtccgtggcgggagcttgccaattgtcagatcgcagttcagttcgcttacacggtttgcatgcccccctcgtgtctgggctgtctgcagttgtgcgtgcagcggcgtcggagagatggcgtcggaggccaaggacgtgggcatcctcgccatggacatctacttcccgcccagctgcgtgctccaggaagagttggaaacacatgatggtgtgagcaaagggaagtacaccattgggcttgggcaggaaaatatggcattttgcactgaagttgaggatgttatttcgatgagcttgacagttgtgaagtccctcctgaaaaattataacattgacccaaagtgcattggacgtttggaagttggcagtgaaacagtaatagacaagagcaagtctataaagacatggctgatgcagatattccaggaatctgggcatactgataattgaaggaagggactcctccaatgcggggttatgggggaaacaccttgcttgtttaaattggggaaaacggggggaaaacaaccttcggggaggggg

SEQ ID NO: 21516 - protein, 111 aa, Zea mays
  misc_feature: Ceres CLONE 1390725-F
  misc_feature (4)..(112): Pfam Name: HMG_CoA_synt_N Pfam Description: Hydroxymethylglutaryl-coenzyme A synthase N terminal
  misc_feature: SWISSPROT Homolog: EC 2.3.3.10 Hydroxymethylglutaryl-CoA synthase
MASEAKDVGILAMDIYFPPSCVLQEELETHDGVSKGKYTIGLGQENMAFCTEVEDVISMSLTVVKSLLKNYNIDPKCIGRLEVGSETVIDKSKSIKTWLMQIFQESGHTDN

SEQ ID NO: 21517 - DNA, 714 bp, Zea mays
  misc_feature: Ceres CLONE 1390732-F
  misc_feature: Encodes the peptide sequence at SEQ ID NO. 21518
cgtggatcccccgggctgcaggaattcgcacgagaaccttacccaaaacatcctaaacgaaaaacggcccgacgattccagaccctttgcgttccatatccccctcacggtctcggaatcgtgactcacaccgacgcacgaataaggctttgggttccgtgacgacacaagcgacggagaccgcgaacccctccccctcccctcccctccggtgcctgccttcagccgcctctcgccgaggtgccagaactgaacggccccatcccaccggcccacatcggtgctctagagatttgagcaccaaagatggtgttgcccgcgaagcaccatcggcgcccgccccctgagagctgtgattgcatcaaggaacatctcaatgaggatgctctgctcctcgtctcccgccacatgaactggctcccgaggctgattgctatcctgtcatgtgagtgcaagcggtttgacgacgcagacaagcaagctgcagtgaataggatttagactaggacgctatacaaagctaaagttcgaccgttcctctgtctgtccgtgcatctctatacctagcacctcggatatgcacttaatccctccataaaccattattaaatataatacctcgcaacctactccgatgaattatgttattagttacccccataactcacttacactatatatttaacactcgtctcactctcactaccttacctt

SEQ ID NO: 21518 - protein, 64 aa, Zea mays
  misc_feature: Ceres CLONE 1390732-F
MVLPAKHHRRPPPESCDCIKEHLNEDALLLVSRHMNWLPRLIAILSCECKRFDDADKQAAVNRI

SEQ ID NO: 21519 - DNA, 705 bp, Zea mays
  misc_feature: Ceres CLONE 1390733-F
  misc_feature: Encodes the peptide sequence at SEQ ID NO. 21520
  misc_feature (431)..(431): n is a, c, t, g, unknown, or other
gctctagaactagtggatcccccgggctgcaggaattcgcacgagaccattacctagaacatcctaatcgaaaaaggcatgcttgcccgctgacgcagctgaagcgaggcgacccgcagccgccatggatccggcgttcgaggaactcgagcgccgcagccgctatctcagctcgctcatccgcctcactaagcttagcgccgtcccggctccttctcagccggagcccgagcccggggtgacgcaaccgactccggagccggagccggagtccgcggtggagaagcgcggggaggccaaggcggagccagtggtcgatgaggaggagaagcgggaggccaaacaggccggggacgggaaggggaaagagatcaaggggaaggacgacgggggtcccaaggaggacaacagaaggaaggtgtcggtgcggntgcgcgccgccgacatgcctctgccgctgcaccgccgcgcggtccggctcgcctacgaagccatcgccgccatgccgcgcctcgacagcaagcgcctcgccctcgcgctcaagaaggaatttgatacggcatatggtcctgcttggcattgcattggtggaacaaagtttggttcctatgcccctcactccctgagagggttctgtgacttccctggtgaccaggactaaattcttccctccaaaccagctgtgaccccctaatcccgcccggg

SEQ ID NO: 21520 - protein, 178 aa, Zea mays
  misc_feature: Ceres CLONE 1390733-F
  misc_feature (94)..(177): Pfam Name: Dynein_light Pfam Description: Dynein light chain type 1
  misc_feature (103)..(103): Xaa is any aa, unknown, or other
MDPAFEELERRSRYLSSLIRLTKLSAVPAPSQPEPEPGVTQPTPEPEPESAVEKRGEAKAEPVVDEEEKREAKQAGDGKGKEIKGKDDGGPKEDNRRKVSVRXRAADMPLPLHRRAVRLAYEAIAAMPRLDSKRLALALKKEFDTAYGPAWHCIGGTKFGSYAPHSLRGFCDFPGDQD

SEQ ID NO: 21521 - DNA, 724 bp, Zea mays
  misc_feature: Ceres CLONE 1390736-F
  misc_feature: Encodes the peptide sequence at SEQ ID NO. 21522
  misc_feature (579)..(579): n is a, c, t, g, unknown, or other
  misc_feature (601)..(601): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (713)..(713): n is a, c, t, g, unknown, or other
gctctatactagtggatcccccgggctgcaggaattcgcacgagaccattacctagaacatcctaatcgaaaaaaaatagcaatttttccccctgggagcccgagacgcagcgcgaggtgcggccccgtcccctcgccaccggaggagcaggacgacgaggtggcgtcggcgcgaggtagtcgcgcgcctggaagagcggcggcatcggagtcgcaggcggaggcgaggaagtgaggggagagccctatagccaccgccgcggggcgtcgtgctcgctgcacgcactcccaccattttgtcccaactcgaagctcagactcgtgctgtcgtgctgtgcacgacccctcccctagcatcccaagctcctaactgagaaaacaggagatgggaagagacggggaacagactaggcgccggagccgcaagagatcccgcgacgcctccccctcctcgtcggattccgattccttcgactccccatcctctccgagcagtagccctgagcgacggagccgcagcagtaaagcggaatagatcatcctcatcgcaccgccacagccgcagaaaagcgacgcggntcgcggagatcccgcgacgagnaccgccggcggcggtaataagacggggccaggagagaagcgcacccgcgggggggtattggtgnnnaggtcctccgactcccaatccgtcggaggaggataaagccggaggnaagccccgtat

SEQ ID NO: 21522 - protein, 49 aa, Zea mays
  misc_feature: Ceres CLONE 1390736-F
MGRDGEQTRRRSRKRSRDASPSSSDSDSFDSPSSPSSSPERRSRSSKAE

SEQ ID NO: 21523 - DNA, 725 bp, Zea mays
  misc_feature: Ceres CLONE 1390738-F
  misc_feature: Encodes the peptide sequence at SEQ ID NO. 21524
tttttccttctttctttcttttcccgcgtccggcgcccccgccgagttgggaaaaagtggaggtgcacgggggggggggcgctctagaatagtggatcccccgggctgcaggaattcgcacgagaccattacctagaacatcctaatcgaaaagagtttcctattttcctctcctcccccacagcagctcggcgaaaaccctagtaagcaaaccaccggagcagcggcgcttgcgcgagcggagccatggcggacgacgattacaacgaaattgacatggggtatgaggatgagcccccagaaccggagattgaggaaggagctgaagaagagcctgagaacaatgaagatgcccctgatgacgtcataggtggtgagggtgaagataaggaacaggaaaagaccaagcgtgaacgcaaaacaacaaaatacatgacgaagtacgaacgtgcgcgcatcctgggtacacgagccttgcagataagcatgaatgctccagttatggttgaacttgagggagaaactgaccctcttgagattgcaatgaaggagctgagagcgcgcaagatacccttcacgatcagacggtacttacctgatggaagctatgaagactgggggagtagaccgagctcattggtggaggacctcctggaaaaacgccccggttgggggcgggactggaaaagggatctaactttggcggtgggaaaggggctatgggg

SEQ ID NO: 21524 - protein, 159 aa, Zea mays
  misc_feature: Ceres CLONE 1390738-F
  misc_feature (61)..(114): Pfam Name: RNA_pol_Rpb6 Pfam Description: RNA polymerase Rpb6
  misc_feature: SWISSPROT Homolog: EC 2.7.7.6 DNA-directed RNA polymerase
MADDDYNEIDMGYEDEPPEPEIEEGAEEEPENNEDAPDDVIGGEGEDKEQEKTKRERKTTKYMTKYERARILGTRALQISMNAPVMVELEGETDPLEIAMKELRARKIPFTIRRYLPDGSYEDWGSRPSSLVEDLLEKRPGWGRDWKRDLTLAVGKGLW

SEQ ID NO: 21525 - DNA, 696 bp, Zea mays
  misc_feature: Ceres CLONE 1390740-F
  misc_feature: Encodes the peptide sequence at SEQ ID NO. 21526
gctctagaactagtggatcccccgggctgcaggaattcgcacgagaccattacctagaacatcctaatcgaaaaaacccaacccaaccgcgctttttgtcacctctcacctggaaagggaagacaagtcgagattcgagaaggcaaatcgaattcgccatgggcatggctgctccgcgcgcgccgctgcctctcccccaactgctgctcctcctcgttgctgcgctcctcgccgccgctcccctccctagggcggccggggcggacgagttcgacgtccgccgccacctctccaccgtcaccaggtatgatgtggccagggagtccagtagtgtcatctccatgccgtcaatcccagacgggtgccgtgtcattcacctcaatctagtggcaagacatgggactcgtgctcctaccaagaagcgcatcaaggagctggatagattggcagttcgactggaagcccttctgaaagaggcaaatcaggtccttgatagtgattctctgaagaaaattccatcctggattaaaggctgggaatcacgctggaagggtaggactaaaggtggggagctgattagtgaaggggaagaggagctgtacaatttaactaccagaatgagggagaggtttcaagaactatttgatgacaaatatcaccctgatgtatattcaaaaaagcaacccagttcctcca

SEQ ID NO: 21526 - protein, 179 aa, Zea mays
  misc_feature: Ceres CLONE 1390740-F
MGMAAPRAPLPLPQLLLLLVAALLAAAPLPRAAGADEFDVRRHLSTVTRYDVARESSSVISMPSIPDGCRVIHLNLVARHGTRAPTKKRIKELDRLAVRLEALLKEANQVLDSDSLKKIPSWIKGWESRWKGRTKGGELISEGEEELYNLTTRMRERFQELFDDKYHPDVYSKKQPSSS

SEQ ID NO: 21527 - DNA, 703 bp, Zea mays
  misc_feature: Ceres CLONE 1390741-F
  misc_feature: Encodes the peptide sequence at SEQ ID NO. 21528
gctctagaactagtggatcccccgggctgcaggaattcgcacgagaccattacctagaacatcctaatcgaaaaacgctactggatacttccgatgcctgttccgctgtttctcttctcccgtgtcttctcccgtttacctgccgtgtgcgactactaggaggtccccgtcggcgctacgctcagtttctctgtcccgatgataagcacactcctcaccagcattgggtttattgcttgagcgaggcggtccgcccttcttctacctgaaattctcatcctgcttgcgcggaaaggcgctctcccgcttgatgatgcaagtgcgagttcctgacgccgaaggcgatcgcaaaccgttatcaaggctaaggtcctgcagaagctgcggcgtcactgtcagatgtgtcataagcagtgccgcgacgagaacggcttcaagtgccactgcgatgtcggagtcgcaccagaggaagatgcaggtgatctaatgtgtccccgtccgaggcgtctagggattctcctggtatcctatatgaactgtctcatcctctaccccataacagacctcccactgctacattgacattaacagtcctgatacagtggtcttcgcgatatctgcaccacacgccttttcaacgtgcaacacatacgcccaattcaactatttatctggcaaccatatcctatcttctttgtccccc

SEQ ID NO: 21528 - protein, 60 aa, Zea mays
  misc_feature: Ceres CLONE 1390741-F
MCHKQCRDENGFKCHCDVGVAPEEDAGDLMCPRPRRLGILLVSYMNCLILYPITDLPLLH

SEQ ID NO: 21529 - DNA, 726 bp, Zea mays
  misc_feature: Ceres CLONE 1390745-F
  misc_feature: Encodes the peptide sequence at SEQ ID NO. 21530
  misc_feature (519)..(519): n is a, c, t, g, unknown, or other
  misc_feature (567)..(567): n is a, c, t, g, unknown, or other
cgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggaccaaggagttcatggaagcccttgctgccggcgctgatgtgtccatgattggccagntcgggcgtcggtttctactctgcctacctcgtcgcccgatagagttgncgtgaccaccaagcacaacgatgacgagcagtacgtgtgggagtcccaagcgggcgggtcggtcactgttactcgtgacacgtcaggggagcagcttggcaggggcactaaaatccactggtcccccaggaccattagttgggagaccttgaggacggt

SEQ ID NO: 21530 - protein, 137 aa, Zea mays
  misc_feature: Ceres CLONE 1390745-F
  misc_feature (28)..(133): Pfam Name: HATPase_c Pfam Description: Histidine kinase-, DNA gyrase B-, and HSP90-like ATPase
  misc_feature (122)..(122): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQXGRRFLLCLPRRPIEL

SEQ ID NO: 21531 - DNA, 716 bp, Zea mays
  misc_feature: Ceres CLONE 1390746-F
  misc_feature: Encodes the peptide sequence at SEQ ID NO. 21532
  misc_feature (393)..(393): n is a, c, t, g, unknown, or other
ggagctccccgcggtggcggccgctctataactagtggatcccccgggctgcaggaattcgcacgagaccattacctagaacatcctaatcaaaaaacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtgtngctgcccaaccagcacgtcgcggcggcggcgtcgcgcgcgtcctacgtgatgctgtgagagatgcggaaagtgatgcagtaccacacggtcacgaaaatgcaggtctcggcgaggaaaaacatggggtcatgtatacaatgaaatggacggtggaagttggataagaagttgacgatttgggactcgcagtggaaaagaatagcctcggggatggaggatacggagagtaattattagtgcgaatataaagtggagtggaaaaaaatgtaatcatcacttgtcttatatcaagatcataattattcacatcagtatattaagt

SEQ ID NO: 21532 - protein, 99 aa, Zea mays
  misc_feature: Ceres CLONE 1390746-F
  misc_feature: SWISSPROT Homolog: EC 3.2.1.39 Glucan endo-1,3-beta-D-glucosidase
  misc_feature (81)..(81): Xaa is any aa, unknown, or other
MAPPRPLLAAVFLAAAVLLLLSPAEAGTVGVNYGRVANNLPNPAAVVQLLKQQGVAQVKLYDADPTVLRALANTGIKVVVXLPNQHVAAAASRASYVML

SEQ ID NO: 21533 - DNA, 713 bp, Zea mays
  misc_feature: Ceres CLONE 1390747-F
  misc_feature: Encodes the peptide sequence at SEQ ID NO. 21534
  misc_feature (334)..(334): n is a, c, t, g, unknown, or other
gctctagaactagtggatcccccgggctgcaggaattcgcacgagaccattacctagaacatcctaatcaaaaagacctgcctcgccattccgccgcgccttcgcatcgtccgcgcgcccggcccttctcgttctaccccggtacgactcgacggtggtcgtgggcgccgaaggtgcggctccgaggcgccaggtggttcgtttgctgtttgcgcgatcgccggaggagtctgtgcaagctgtgctggctaagggtttgggggttcggattcagtggaggggctgcggcaggagggagctagagatgtacggaccgccgtcccgaggcggcggnggagctggcactgccggagagcagcctagggtttaccaagtttggcgaggaagcaacgagtttttcttgcaaggccggttcatatttgaacctgatgggagatcattgtttctcaacaaattcctcattcttgagccagggaggctcttttggattttagggaacagaatttttatccatgaccttccttatccttgctgatctccacttaggggaccagcgactggatataactgtatactcttaacctttgccgctccctacctttgtgtaggcatcatggcaacgccccaactaaaaccatatcttcgtgatgtcggcgcagtgttatttaacctgtgtgcttggatgggtccaccacctccctctctaccttcac

SEQ ID NO: 21534 - protein, 76 aa, Zea mays
  misc_feature: Ceres CLONE 1390747-F
MYGPPSRGGGGAGTAGEQPRVYQVWRGSNEFFLQGRFIFEPDGRSLFLNKFLILEPGRLFWILGNRIFIHDLPYPC

SEQ ID NO: 21535 - DNA, 702 bp, Zea mays
  misc_feature: Ceres CLONE 1390749-F
  misc_feature: Encodes the peptide sequence at SEQ ID NO. 21536
  misc_feature (522)..(522): n is a, c, t, g, unknown, or other
tccccgcggtggcggccgctctatcactagtggatcccccgggctgcaggatattcgcacgagaccattacctagaacatcctaatcgaaaaatctctctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttccacctcgaaacagggtatgtggaggtggacgaggacgccggcgcggagctcttctactacttcgtccgggccgagtccggcgccgacgacagcgacaccccgttcgtcctccggatccccggcggccaacgctgctccgccttcagcggcctcgcctacgagataggtcccatcatgttcgtcgtggagccctacaacggcagcttgccgcgcctgcgctacaacccaaactcgtggacaaaggtggcgcatattctttttgtggattcgccagttggggccggnttttccttctccagagatggcacaggctactacgctggaagcgatatcaaccacgctggacttggcgaaacacctcaaccagcggattaacgaacatcctggggaacatgcaaaccctttccacatccaagaggaatactaacgcagacaaatatgagccttcccctggaaaaatgtttt

SEQ ID NO: 21536 - protein, 165 aa, Zea mays
  misc_feature: Ceres CLONE 1390749-F
  misc_feature: SWISSPROT Homolog: EC 2.3.1.92 Sinapoylglucose--malate O-sinapoyltransferase
MTLVRMPCRLCCFLLVVAASAVSGRGRVVTTLPGYEGRLPFHLETGYVEVDEDAGAELFYYFVRAESGADDSDTPFVLRIPGGQRCSAFSGLAYEIGPIMFVVEPYNGSLPRLRYNPNSWTKVAHILFVDSPVGAGFSFSRDGTGYYAGSDINHAGLGETPQPAD

SEQ ID NO: 21537 - DNA, 705 bp, Zea mays
  misc_feature: Ceres CLONE 1390752-F
  misc_feature: Encodes the peptide sequence at SEQ ID NO. 21538
  misc_feature (224)..(224): n is a, c, t, g, unknown, or other
  misc_feature (225)..(225): n is a, c, t, g, unknown, or other
  misc_feature (227)..(227): n is a, c, t, g, unknown, or other
  misc_feature (228)..(228): n is a, c, t, g, unknown, or other
  misc_feature (256)..(256): n is a, c, t, g, unknown, or other
aagctggagctccccgcggtggcggccgctctagtactagtggatcccccgggctgcaggaattcgcacgagaccattacctagaacatcctaatcgaaaaagcctgcctcggtgcgccgccgccacacctccaccatggctgcgaccacgccggccaccgacccgccggatgccttgcttgcagtaacagctgatgctcccactcctgctcgtccacccccgnngnnagctgtagcccgcgccgtcgcccccgtnaagcccgccttctctgcccggctcccgtccgggagcacccaaggaagaggtaaaagccgccgcggcgggggccccctaaagggggaaaaaaaattcaaagggccatttcagggcggaggggaaagagaaaaaaaaacccatttccccccttttttcaaaaagggaaaaagggaaagggggcccccctgaaaaaaaggaaattcttggggggttaaccccggaaaaaaaaaggtttttttccccaaaaaacccctctcttttaaaaagacccccctttttttgggggggaaaattttttgccaaaaaaaaaaaatttggtcccccttaaaaaaaaaaagaaaagactcccccccacaacaaccgcccgggggaggggggggggagctttttcctttaaaaaaaaaaaaatcctcttttggaaaaaaaaaaatttcccccccgggcggcgg

SEQ ID NO: 21538 - protein, 102 aa, Zea mays
  misc_feature: Ceres CLONE 1390752-F
  misc_feature (30)..(30): Xaa is any aa, unknown, or other
  misc_feature (31)..(31): Xaa is any aa, unknown, or other
MAATTPATDPPDALLAVTADAPTPARPPPXXAVARAVAPVKPAFSARLPSGSTQGRGKSRRGGGPLKGEKKFKGPFQGGGEREKKTHFPPFFKKGKRERGPP

SEQ ID NO: 21539 - DNA, 672 bp, Zea mays
  misc_feature: Ceres CLONE 1390755-F
  misc_feature: Encodes the peptide sequence at SEQ ID NO. 21540
  misc_feature (321)..(321): n is a, c, t, g, unknown, or other
gctcaagaactagtggatcccccgggctgcaggaattcgcacgagaccattacctagaacatcctaatcgaaaaccgccacgccacctcccctcccctcccgccgtgcgccccgatccctcgccgccccacgccggcctcatctcgccgaggactggatcgccggggggacatcctgggtgtccttcacacacatgcggcgttaggtgatgacgagcttgcctgagaggggagaatcacctgcgccgccactcgattctctgcgccaggactctgccgtgaccgtcctagcggctgccgccgttgcctcttcctccgctgnctccgatcgcaaggaagacagcggctccgggcagcccaaggcctccatcctgtccggcgtcttctctcccccttttgccatattcgagcggcaggagcagggctcctcgtcgccggcgtgcgacgccagggcgaaaaagtcgtcctcaggggtcctatggtttatccggaatcctgaagaaggttcgtggggcagccggctccatgtgggcgactttctggggtggggggaagggtctttgacctccagtggacggtggggttcccttggtaaatggcttaaaagggggcgccctgaaaaaaaaagggagtcttggcggaattcgcgaagtcccgacaggggggccatggc

SEQ ID NO: 21540 - protein, 154 aa, Zea mays
  misc_feature: Ceres CLONE 1390755-F
  misc_feature (38)..(38): Xaa is any aa, unknown, or other
MTSLPERGESPAPPLDSLRQDSAVTVLAAAAVASSSAXSDRKEDSGSGQPKASILSGVFSPPFAIFERQEQGSSSPACDARAKKSSSGVLWFIRNPEEGSWGSRLHVGDFLGWGEGSLTSSGRWGSLGKWLKRGRPEKKRESWRNSRSPDRGAM

SEQ ID NO: 21541 - DNA, 675 bp, Zea mays
  misc_feature: Ceres CLONE 1390756-F
  misc_feature: Encodes the peptide sequence at SEQ ID NO. 21542
  misc_feature (382)..(382): n is a, c, t, g, unknown, or other
  misc_feature (397)..(397): n is a, c, t, g, unknown, or other
  misc_feature (468)..(468): n is a, c, t, g, unknown, or other
tggagctccccgcggtggcggccgctctagaactagtggatcccccgggctgcaggaattcgcacgagaccattacctagaacatcctaatcgaaaaaaaacccaatccatccaaacccatttccctcgctcccatcccgtcccgccccttgtctcttccgcttccccccgaccccgcgcgccgcggaccagcagccatgtcgtgctcccacctctccaccgcctggtcctcctcggcgctcgccagcagcgcctccaccacccgacggcgctcccccccgcgctcgggtctcctggtgcggtgttccctccgtgagctccgcacccgcatcgactccgtcaggaacacgcagaagatcacgggagccatgaagctggtggnccgccgccaggtccngcgcgcgcaagaggccgtcgtctcctctcgcccttttctcggagcgctggtggaggtgctctaacacatgnaccaggagatcccgacggaggaaattgaactggccttcaaccgaacccgcccgttcagaaggtggccttccggggccctgacggggaagggggccctctggggaagctcacaaacaaggggtcaaaaagggggaaacccccttcgagggctcaaggaattgggcccccaaaacccgtccccccgggggggaaaaaaaggcccccccc

SEQ ID NO: 21542 - protein, 87 aa, Zea mays
  misc_feature: Ceres CLONE 1390756-F
  misc_feature: SWISSPROT Homolog: EC 3.6.3.14 H(+)-transporting two-sector ATPase
  misc_feature (62)..(62): Xaa is any aa, unknown, or other
  misc_feature (67)..(67): Xaa is any aa, unknown, or other
MSCSHLSTAWSSSALASSASTTRRRSPPRSGLLVRCSLRELRTRIDSVRNTQKITGAMKLVXRRQVXRAQEAVVSSRPFLGALVEVL

SEQ ID NO: 21543 - DNA, 679 bp, Zea mays
  misc_feature: Ceres CLONE 1390760-F
  misc_feature: Encodes the peptide sequence at SEQ ID NO. 21544
  misc_feature (459)..(459): n is a, c, t, g, unknown, or other
  misc_feature (538)..(538): n is a, c, t, g, unknown, or other
  misc_feature (544)..(544): n is a, c, t, g, unknown, or other
  misc_feature (566)..(566): n is a, c, t, g, unknown, or other
  misc_feature (601)..(601): n is a, c, t, g, unknown, or other
tggagctccccgcggtggcggccgctctagaactagtggatcccccgggctgcaggaattcgcacgagaccattacctagaacatcctaatcaaaaaaaagcgatgcgcagctccgtaaccacttcgtcctcacttctcagtccaccttcccaccgcaaccacttcaccacctcctcacagtcccagcaatggagctagtagcgtggctcgtcatcgtgtcctcagtatccctcgctgggctcctgccagtggtctcggcgtcgacgacgacaccgcagcagcaatgtggcggcaataatgtcggacctgccggagtgagagcaggctactggtcgccgtcctcgaaccgctactccgcggtcggcagcatcgacgcgtccctgtacacgcacctctactacagcgcgttgaccatcgacgagacgagctgcgcggtcgcgccgccctcgccgaacggncgaaagcgcctcgctgctcgccgcttcttctgaacgcggtcaagtccgcgagccagtccacaggaaccgtgcctgtccngttggnacggacgaggtacaggggtgancgtagccgaacgcgacttctccaggaatgggggcnggacccggcccctcccggggcggtggtccatcaactcccacccgggaactggacccggcaccaaggtttttctgaggg

SEQ ID NO: 21544 - protein, 100 aa, Zea mays
  misc_feature: Ceres CLONE 1390760-F
MELVAWLVIVSSVSLAGLLPVVSASTTTPQQQCGGNNVGPAGVRAGYWSPSSNRYSAVGSIDASLYTHLYYSALTIDETSCAVAPPSPNGRKRLAARRFF

SEQ ID NO: 21545 - DNA, 664 bp, Zea mays
  misc_feature: Ceres CLONE 1390763-F
  misc_feature: Encodes the peptide sequence at SEQ ID NO. 21546
tccccgcggtggcggccgctctacaactagtggatcccccgggctgcaggaattcgcacgagaccattacctagaacatcctaatcgaaaagtccgtctctcgttctctccttcctatcggctccacacctccacgcaactggaagcttcgctgcaatctgccctactcctcttccgccgcctccaacaccgcagacgcagctgccgcgggcgggagcttggacgtgctacgctgctctcatctcgtttccgcgcaggaattgttctcaatggcccgcgtgtatgttggcaacttggattcacgggtgacttctggggaactcgaagatgagttccgcgtgtttggagttctgcgaagtgtttggattgcacgtaaaccacctggctttgcatttattgattttgacgacaggagggatgcggaggatgctattcgtgatctagatggtaagaatggatggagagttgaactatctcgtaattccagtggtcgtggtggtcgtgatcggtatggtggatctgagtcgaagtgctatgaatggggggagactgtgcactttgcacgtgaatgtcgcctgcgcattggctctggaggctaagcagtgaaaaaaggccgcagccgcagccccagtcgcaattcacagccgcagcaggaagaaggagc

SEQ ID NO: 21546 - protein, 109 aa, Zea mays
  misc_feature: Ceres CLONE 1390763-F
  misc_feature (4)..(70): Pfam Name: RRM_1 Pfam Description: RNA recognition motif. (a.k.a. RRM, RBD, or RNP domain)
MARVYVGNLDSRVTSGELEDEFRVFGVLRSVWIARKPPGFAFIDFDDRRDAEDAIRDLDGKNGWRVELSRNSSGRGGRDRYGGSESKCYEWGETVHFARECRLRIGSGG

SEQ ID NO: 21547 - DNA, 644 bp, Zea mays
  misc_feature: Ceres CLONE 1390764-F
  misc_feature: Encodes the peptide sequence at SEQ ID NO. 21548
cgctcttaactagtggatcccccgggctgcaggaattcgcacgagaccattacctagaacatcctaatcaaaaaagcgcccgcaaaaccctagccccgcccgccccaaaccctaggcggctacggtctccgatcccggggtcacgtcctaatggcatcttcgccggacttgttccccaacgttaccttctccgacgtctccgaagccgcagcagggcctgcggccgagggggccaccgccgcgttcggtctcggcgccgccactggagccccgcgcctcagcctcgtgaaggccgaggcggagcccacggtcgagatcgaccttgccgacgcgcaggtatttaagttgggaccgacggagtggctgtgtgtgtgcgacgagtcgaaggctaaggatggcgtggaagagaagtcattttcaagagcaattaaggttgttcttaggacagaagctgagagcaaagccttctcttttagctttcaacgatggcaacaccaagttattagtgggaaaagtggtgagcggctgaagaatggatcaataattgcttcaaaaaacaaatcgatacaaaaattgaggcatcatcagcaaagatggatttccactactaagggcagttattacatcaagaaaacatgttacag

SEQ ID NO: 21548 - protein, 164 aa, Zea mays
  misc_feature: Ceres CLONE 1390764-F
MASSPDLFPNVTFSDVSEAAAGPAAEGATAAFGLGAATGAPRLSLVKAEAEPTVEIDLADAQVFKLGPTEWLCVCDESKAKDGVEEKSFSRAIKVVLRTEAESKAFSFSFQRWQHQVISGKSGERLKNGSIIASKNKSIQKLRHHQQRWISTTKGSYYIKKTCY

SEQ ID NO: 21549 - DNA, 636 bp, Zea mays
  misc_feature: Ceres CLONE 1390767-F
  misc_feature: Encodes the peptide sequence at SEQ ID NO. 21550
  misc_feature (408)..(408): n is a, c, t, g, unknown, or other
gctctagaactagtggatcccccgggctgcaggaattcgcacgagaccattacctagaacatcctaatcgaaaaatctcctcgcgagcaccgctggcctcgcttaacggcctgatctcccagccgccgcttccgcctcgcgtcccaccggtctccatctacatgcagccgcgctcgccaccgccgtcggaggcgcctgcgccctccgacgccatcatgatgcccggcgtgggcggcgtggagccggccgtcacgttgggccaggtgccgcgctggagcgaccccgaccagcgcatcttcctcgcctccacgtccgaagaggcgtccgcggaggacgacggatccggaacgacctctgcgtctggcttcatctctttctccgacccgctcacggtcgacgacggcgccngtcgagggtggccacgcccgggggtgcctcgcgcttccacgtcgaccaggagatcaactctaggatctatctctggcgtggccagccctgaaacctcagggccgacgcagtcgtcaattctaccaacgagaagcttggacgaggcgcacagtaagcccggggttgcatgctgctgccgggtcagggctcgaggaggagggcgccaccttgggaggttgcgaaatggcg

SEQ ID NO: 21550 - protein, 158 aa, Zea mays
  misc_feature: Ceres CLONE 1390767-F
  misc_feature (83)..(83): Xaa is any aa, unknown, or other
MQPRSPPPSEAPAPSDAIMMPGVGGVEPAVTLGQVPRWSDPDQRIFLASTSEEASAEDDGSGTTSASGFISFSDPLTVDDGAXRGWPRPGVPRASTSTRRSTLGSISGVASPETSGPTQSSILPTRSLDEAHSKPGVACCCRVRARGGGRHLGRLRNG

SEQ ID NO: 21551 - DNA, 661 bp, Zea mays
  misc_feature: Ceres CLONE 1390769-F
  misc_feature (489)..(489): n is a, c, t, g, unknown, or other
  misc_feature (509)..(509): n is a, c, t, g, unknown, or other
  misc_feature (572)..(572): n is a, c, t, g, unknown, or other
  misc_feature (605)..(605): n is a, c, t, g, unknown, or other
  misc_feature (617)..(617): n is a, c, t, g, unknown, or other
tccccgcggtggcggccgctctagaactagtggatcccccgggctgcaggaattcgcacgagaccattacctagaacatcctaatcgaaaaatctcccacgcgcaccgccacaacacgccgcgcggcaaagaaacaacgccagaaagcgatcggatcggatccggatcggcagcagtcagtgcagtgcatccagagcggcagagccccgtcgtcccgtggccgccaggtcgatcgcccagcggccggccggccggccagtccaggccttcccgcgcggggagttttccttttcttaattttccttcccctggcgtgccgccccaccacgtagcgagcaactcctccccgcgctcaccgctcactccacctccaggctccagctactactaatacccgggcggtgcgaacctttgcctttagcctttagctagtacaccgaacgcgccaagtcccggaggcggaggcggtgatctttgttcgtttcctcngctctcctctcctcccctcntctttcattccctgtcccgtggacggcaatggcgggcaccgcgcggcttcttcctgccgcggnggcggcgctgctgctgtgtcctgcatcgcgggnccggcgcgcggncgcccaacgtgacgtacgaccaccgcgcgttggccatcgacggg

SEQ ID NO: 21552 - DNA, 743 bp, Zea mays
  misc_feature: Ceres CLONE 1390770-F
  misc_feature: Encodes the peptide sequence at SEQ ID NO. 21553
  misc_feature (10)..(10): n is a, c, t, g, unknown, or other
  misc_feature (11)..(11): n is a, c, t, g, unknown, or other
ttcccccccnntctcccccccctaatccccccccccagccccagatagaaactggaactccccgcggtggcggacgctctttcatagtggatcccccgggctgcaggaattcgcacgagaccattacctagaacatcctaatcaaaaaatacccacaaccaccaccaccagcagcagctgaggatgggcgacgcggccatcgccgccgtgcatttgcatgagtctgaggaggagcacatcttccggagccggttcccgcccgtggccgtaccagacgacgtcaccgtgccggagttcgtgctggcggacgccgaggcctacgcggacaagacggcgctcgtggaggccgcgccgggtggccggtcctacacctacggcgagctggtccgggacgtggcgcggttcgccagggcgctgcggtccatcggcgtccgcaggggccacgtcgtggtggtcgcgctcccgaacctggcggtgtaccccgtggtgagcctcgggatcatgtccgccggagcggccttctccggcgtgaaccccgcgcgccgtcgccgccgagacaaagaagcagggggaggactcccgaggccaggctcgaggtcgccgacgcggttgacctacgacaaggggaaggacgccggccgcgccgggagataggaatcggaagacacggaggcgcattaccccgggcagtaatatgactgggtaacgagcccccactaatataggctaaaacccccactccc

SEQ ID NO: 21553 - protein, 156 aa, Zea mays
  misc_feature: Ceres CLONE 1390770-F
  misc_feature: SWISSPROT Homolog: EC 6.2.1.1 Acetate--CoA ligase
MGDAAIAAVHLHESEEEHIFRSRFPPVAVPDDVTVPEFVLADAEAYADKTALVEAAPGGRSYTYGELVRDVARFARALRSIGVRRGHVVVVALPNLAVYPVVSLGIMSAGAAFSGVNPARRRRRDKEAGGGLPRPGSRSPTRLTYDKGKDAGRAGR

SEQ ID NO: 21554 - DNA, 766 bp, Zea mays
  misc_feature: Ceres CLONE 1390775-F
  misc_feature: Encodes the peptide sequence at SEQ ID NO. 21555
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
nnnnnnnnnnnnnnnnnccccccagcggcccgcacccaagtcctcccacaaaagtgtagctccccgcggtggcggccgctctattactagtggatcccccgggctgcaggaattcgcacgagaccattacctagaacatcctaatcaaaaaaaaacccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggccttcaactcatttaagaacaactacatcctcgtttactccctcatgatgtctggggactggctgcaggggccctacgtgtactacctctacagccagtacggcttcgacaaggccgaacattggccgcctcttcatcgccggcttcggttcctccatgctcttcggcaccatcgtcggaatccctcgcggataagcaggggcgaaaaagggggtgggtcaagtactgcatcacctaactcctcagctggcatccacaaggactctcccccagaacaaagttcttatgaatggggcgtgcccttggtgggaatggccaattccgctgctcttcttcagggtttggaacccgggggttcgggggcagaacaccaacaagaaaaggggtttggatccaccaaaggggtgggccaataaacaattctcccaagggactataattttctttgggccaacgcggccta

SEQ ID NO: 21555 - protein, 171 aa, Zea mays
  misc_feature: Ceres CLONE 1390775-F
MEVFYYLVFGALAAIVAALELAKSGKDRVATSPAFNSFKNNYILVYSLMMSGDWLQGPYVYYLYSQYGFDKAEHWPPLHRRLRFLHALRHHRRNPSRISRGEKGGGSSTASPNSSAGIHKDSPPEQSSYEWGVPLVGMANSAALLQGLEPGGSGAEHQQEKGFGSTKGVGQ

SEQ ID NO: 21556 - DNA, 656 bp, Zea mays
  misc_feature: Ceres CLONE 1390776-F
  misc_feature: Encodes the peptide sequence at SEQ ID NO. 21557
  misc_feature (506)..(506): n is a, c, t, g, unknown, or other
tccccgcggtggcggccgctctataactagtggatcccccgggctgcaggaattcgcacgagaccattacctagaacatcctaatcgaaaaaggtcgacgcatcttcgcctccgctcaacgctcgcccacgcccgccgcccccccaccgatccacgagaaaccttctcgcctccgcgggacgattcgccagggagagcaaaggtagcagaggcgccatggacgctgccaagtcggtgacgccgggcgccgtgtcctacatcctggcgcacccgtctacgggctccaatggcgccgtgtcggatctcgtcgttcaggtcctcgatctcaagtccatcggcatgggcaagccggttcagtttcacggcaaccgatgggaacgacaaaatcaaggcgatgctccccacttactttggcgtcggaggtccactccggcaatctgaaggaatttcggtctcatccgcatcctcgactacactttgcactccgtcaaaggcacgctgacaangtcctgattgtcgtcaaatgcgagactgtgtgcgaagcgctcgacgccgagatcaacggcgaggccaagaaagaggatcctccattgtgctgaagcctaaagacgaggctcagtcggggctgaggaaacaattctccccactcgtgagaa

SEQ ID NO: 21557 - protein, 74 aa, Zea mays
  misc_feature: Ceres CLONE 1390776-F
MDAAKSVTPGAVSYILAHPSTGSNGAVSDLVVQVLDLKSIGMGKPVQFHGNRWERQNQGDAPHLLWRRRSTPAI

SEQ ID NO: 21558 - DNA, 651 bp, Zea mays
  misc_feature: Ceres CLONE 1390781-F
ccccgcggtggcggccgctctagaactagtggatcccccgggctgcaggaattcgcacgagaccattacctagaacatcctaatcgaaaaactcacaagtgatgatgcgatgcaagacgagggatccgcgcgtctcgctctcacccctcctcggcgcctccccgactcacagcgtaaagcccctgttccttcctccccgactcgcccctcatggcgaggaggcgctgctgatgcctcgcggcgtcggatcggacgcggcggccacgacacctagccgcttgcggtggcgctcgcctacgcgcccaatccgccgacgctgctcctcggatcccccgagagattcaggccccgtctcgcctcgtcctgcctagtgcctaggtgaggctctggcctccaaaggtgcgtgggtgggatctgctgcctcggtttgcgttattcccaagtgccctgcccatactccaacagcggtccagtcgacttccccaagtgctcgacccctacaaggagcgcgcgtgcgtcacctcaccccctgcatgcgctggcgctaaccctatctagaagacggagcgccgggccagcggctacgcgggcaaagagaggacaagagcgtgcaaaaagagaaggccggtgtcaagcggcggttatagggga

SEQ ID NO: 21559 - DNA, 670 bp, Zea mays
  misc_feature: Ceres CLONE 1390783-F
  misc_feature: Translation starting site: 182
  misc_feature: SWISSPROT Homolog: EC 1.2.1.8 Betaine-aldehyde dehydrogenase
  misc_feature (344)..(344): n is a, c, t, g, unknown, or other
  misc_feature (352)..(352): n is a, c, t, g, unknown, or other
  misc_feature (353)..(353): n is a, c, t, g, unknown, or other
  misc_feature (376)..(376): n is a, c, t, g, unknown, or other
  misc_feature (436)..(436): n is a, c, t, g, unknown, or other
  misc_feature (465)..(465): n is a, c, t, g, unknown, or other
  misc_feature (495)..(495): n is a, c, t, g, unknown, or other
  misc_feature (516)..(516): n is a, c, t, g, unknown, or other
  misc_feature (523)..(523): n is a, c, t, g, unknown, or other
  misc_feature (536)..(536): n is a, c, t, g, unknown, or other
tccccgcggtggcggccgctctagaactagtggatcccccgggctgcaggaattcgcacgagaccattacctagaacatcctaatcgaaagaggccactgtctagttgccgactctcctcgcaggccgcaatctcgcagacacgcaccgtcgcggtatccgtatcgccagagtcctcacggatggcctcgccagcgatggtcccgctgcggcagctcttcgtcgacggcgagtggcgcccgcccgcgcagggccgccgcctccccgtcgtcaaccccaccaccgaggctcacatcggcgagatccctgcgggcacagcggaggacgtggacgccgcggtggcgncggcgcgnncggcgctcaagaggaaccgtggncgcgactgggcgcgcgcccccgggggccgtcccgggcaagtacctccgcgctatcgccgncaaggtgattgagaggaaacctgagctgnctaagctagaggcacttgattgtgggaagncttatgatgaagcagcatggnacatggnatgatgtgctggntgctttgagtactttgcggatcaggcagaagccttggataaaaggcaaattccccagtttctcttccatggaaacttttaaatgtctctccgagagagctattggggggaaattgggttgataactcttggaaa

SEQ ID NO: 21560 - DNA, 928 bp, Zea mays
  misc_feature: Ceres CLONE 1390784-F
  misc_feature: Encodes the peptide sequence at SEQ ID NO. 21561
  misc_feature (928)..(928): n is a, c, t, g, unknown, or other
ggtgatgtttggggtgaggaaaaacacacaacagcagggggggccccccccggaaagtcgggagttcccgcagaagcgggccgctttacaactagaggatcccccgggactgaaggaattcgcacgagaccattacctagaacatcctaatcgaaaattccaagctctcttcattggctcatagctagctagttcgcctcccaaaaacacctgccctcgtgcgtggcaggagcacgggcacgatgatcagcacagcgcacagccggcagcagcaccatgccttcgagaagagccctggcaacagccacatgaagagcatcgacaggaagctgcagcaggccatgaagccaggcggccagcaagtacatggagaggatctaccctctaggcatggaaaagggagaagctaccggcctccacaattggtcgccgctcctcggtgggcgaaaaaaatttccaaacgaactccttccaatacaaagagagcttcccacattcccaggttgtgggaagggcccaaaggggggcccggcttgtgctccataactggcgggccgccctctttcactcccacaaggggggggggcgaaaggcgagggggggggccctcccctggacaataaggatcccgggggttctggcgtcctgtgggcgacaacgaggtccaggtgggtcccacatctgacctcccaaaaaggggggcgggggggagaggaactctgtgaatcaactcccaactgtagaccccccacggagaccccccgcgccggctcgcgacaacagcgagtatctcccaccaaacaaagaagggaaaacagcgacgcgatagcgcccgctctcccaccaccaaccaagcggcttggtgggccccacgcttctgttgaatgatcacctaatcacgctgttgtgtgatgtcgagcacaacagn

SEQ ID NO: 21561 - protein, 59 aa, Zea mays
  misc_feature: Ceres CLONE 1390784-F
MERIYPLGMEKGEATGLHNWSPLLGGRKKFPNELLPIQRELPTFPGCGKGPKGGPACAP

SEQ ID NO: 21562 - DNA, 668 bp, Zea mays
  misc_feature: Ceres CLONE 1390790-F
  misc_feature: Encodes the peptide sequence at SEQ ID NO. 21563
  misc_feature (383)..(383): n is a, c, t, g, unknown, or other
  misc_feature (449)..(449): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (597)..(597): n is a, c, t, g, unknown, or other
ggagctccccgcggtggcggccgctctagaactagtggatcccccgggctgcaggaattcgcacgagaccattacctagaacatcctaatcaaaaaataccccgtctcggttctcaaacaccgccgccgccgttctcccgacatctccccgtccaggtcgttgggtcagcccctatccttcaccttcacgacttcacctgcttctccactgcgcgccccgcccccggccccgtcgtgcgccctgctcagatccatcgcacggggcttgccgcaccactgcgccaagcaaaaggtgggcggccagcggcgcgtgcgcagatcatgcactgttgtcttatgaagattggtaaggggagaaagaagatgaggaataaacagcgaanatcatctgccctcggttctgatgcaggatgtggatcttctttatcttgtattgtatggagcttggnggggtttggnnnctgtctgcttccttttccttaaacatcaagcagacagtggtcagacccatggtttatttcagtcctcttcatgcgaccagaaaattagaggacatcgagggaggatcatttcccgctttggcacctcctcacaggntgattcctcgtgcagggaaaaaggaggggacctcgtaaaccaccaagggttatagatgatattcttggagg

SEQ ID NO: 21563 - protein, 53 aa, Zea mays
  misc_feature: Ceres CLONE 1390790-F
  misc_feature (21)..(21): Xaa is any aa, unknown, or other
  misc_feature (43)..(43): Xaa is any aa, unknown, or other
  misc_feature (47)..(47): Xaa is any aa, unknown, or other
MHCCLMKIGKGRKKMRNKQRXSSALGSDAGCGSSLSCIVWSLXGFGXCLLPFP

SEQ ID NO: 21564 - DNA, 628 bp, Zea mays
  misc_feature: Ceres CLONE 1390791-F
  misc_feature: Encodes the peptide sequence at SEQ ID NO. 21565
gctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggggttccccggagacgatccgcgacccgcgcggggtttcgccgtgaagttctacacccgcggagggcaactggggacctgctgggcaacaactttccccgtccttcttcatccgccgaggggatcagggttcccccgacggtgatcccacgcgt

SEQ ID NO: 21565 - protein, 124 aa, Zea mays
  misc_feature: Ceres CLONE 1390791-F
  misc_feature (18)..(125): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGVSP

SEQ ID NO: 21566 - DNA, 684 bp, Zea mays
  misc_feature: Ceres CLONE 1390792-F
  misc_feature: Encodes the peptide sequence at SEQ ID NO. 21567
  misc_feature (684)..(684): n is a, c, t, g, unknown, or other
ggagctccccgcggtggcggccgctctagaactagtggatcccccgggctgcaggaattcgcacgagaccattacctagaacatcctaatcgaaaaaacaaacaaccctaatccgtgaccgtggacacgccgtaagctccatcgcgcgaatagattggggggattcaatagaggctacgcggggattggtcgcgctcgagatctcagcaccctcgcgcctgaaatctttctattgttgtcgtggctcaggtgatgagatcttggggagcgcgactcgctcggtcctgagatgctgccgcgctacgggcggcggtggccgcagcgtccatctctcctcccacaaggacctcctcctcggtcgctgcggccggagcttcctcttcgggaacacgtggtttctcctctccacttacccggagcgcctcctgcacaccacggaccgtcgcgctccctccgcttgcgtcgccgccatcaaccgggtcccctgcgtgcggccgcactgcacgggtcagggcctgctgcacagaggcccaattgtcatggatgcctgcggctatgatcctaagcggaattgagctgggggctgccaagcgccaggcacccggaaaagggcccatctgggggaaaaccccgcctctcggaatagcagccaatgggttccctgggaccagggcttccccgccn

SEQ ID NO: 21567 - protein, 43 aa, Zea mays
  misc_feature: Ceres CLONE 1390792-F
MILSGIELGAAKRQAPGKGPIWGKTPPLGIAANGFPGTRASPP

SEQ ID NO: 21568 - DNA, 670 bp, Zea mays
  misc_feature: Ceres CLONE 1390793-F
  misc_feature (474)..(474): n is a, c, t, g, unknown, or other
  misc_feature (547)..(547): n is a, c, t, g, unknown, or other
  misc_feature (580)..(580): n is a, c, t, g, unknown, or other
  misc_feature (581)..(581): n is a, c, t, g, unknown, or other
tccccgcggtggcggccgctctataactagtggatcccccgggctgcaggaattcgcacgagaccattacctagaacatcctaatcgaaaaaatgtctacttgtctaccgtcgctgcgctagccctcctccctgcttcttgcttttgcctgagcctgcagcctgctgcaagcttttgctttggtttaggtgcttcttttccacccctttactgttccccccacttttgcttgctttgtcacgcacacgaaaagctcctgcctttaccttatctccgcacccgtagtgggatttggtgggagctgcgctgctcgcccctcgcgtttctttgctcaattgggggtcacggtcacggcccgcgggtgctgcgcgtgctcgtgggcgggcggaattcggggttcttgcgcggtcccggtcccctcggcgatttgcgacgctctctgcagatcttcgcgtaactccgggagcgcgccgnagatgaaactgcgggcgcccgacagctggccgccgggggtcggggccgtcgtgcttcctcaaactgaactggnaccagtctatgggcgccgaccagctcgacccgnngttaaagttcgatgtcttcttccccggggtcaaatcgacgccgccggccgggttaaggacggccgcgttttccaggggatctctccgaa

SEQ ID NO: 21569 - DNA, 683 bp, Zea mays
  misc_feature: Ceres CLONE 1390795-F
  misc_feature: Encodes the peptide sequence at SEQ ID NO. 21570
gctctataactagtggatcccccgggctgcaggaattcgcacgagaccattacctagaacatcctaatcgaaaagtgtcgtcttcctctccgccgcttctcctgtccaccctcgactgcttgcgcgtgacctgagccgccgccgcctacatccgctcatccccgcgcccgcctcaaccacgccgccaccgaccacgtataatcctgcctccccttcgcgcggtttcgaggctcgtttcctttgggatcgttcgtctgccccgaccgcgtggggcgcttcttcttcgggatctcgctggaccgagcggcccagggctagggattcaggcccatggcgtgccggcgcgtcctcacccaagattgcaaaggcatccgaccagcaaaagcaatctacaatgaactagttgcttcctcccctttggggtgtcttcgaagtgacatcccttcaggtgccaggataaaacttttacaagagaggaccccagccaggttacattgggaacccttggccgcccgggtccgaaacttaaaaacccccaaggggaacttcctctggttaaaagaaatttacagaaagggccccaaaggggggtcataaaaaatatttgaaaggcccaccctccttaacattccaaaccccggaaacacttttcggaagaatggaaaaagcctcttggaaagggg

SEQ ID NO: 21570 - protein, 88 aa, Zea mays
  misc_feature: Ceres CLONE 1390795-F
MACRRVLTQDCKGIRPAKAIYNELVASSPLGCLRSDIPSGARIKLLQERTPARLHWEPLAARVRNLKTPKGNFLWLKEIYRKGPKGGS

SEQ ID NO: 21571 - DNA, 652 bp, Zea mays
  misc_feature: Ceres CLONE 1390796-F
  misc_feature: Encodes the peptide sequence at SEQ ID NO. 21572
cttgaacaggtggatcccccgggctgcaggaattcgcacgagaccattacctagaacatcctaatcgaaaaagcaaatcactacacacaccttgtctctaatcagatatcaaagaagtagccattaagttaacgatggcttccgccgacctcgcagaggccatcgagcccagcaggaagaagaagagcaacgtcaagtatgcctccatctgcgccatcctcgcctccatggcctccgtcatccttggctacgatattggggtgatgagcggagcggccatgtacatcaagaaggacctgaagatcacggacgtgcagctggagatcctgatagagatcctcagcctctactcgctcatcgggtccttcgcgggcgcgcggacgtccgacaggatcggccgccgcctgactgtcgtcttcgccgccgtcatcttcttcgcgggcgcgctgctcatggttttcgcggcaactactccatgctcatggtgggccgcttcgtggccggagttggcgtggcctacgggggcatggatcgcgcccgtgtacccggacgagatctcggccgggggggtcccgggggtttcctccccggcctttcccggaaggggttcattaacgggcggaatcccggtctcggctacctggaccaaact

SEQ ID NO: 21572 - protein, 172 aa, Zea mays
  misc_feature: Ceres CLONE 1390796-F
MASADLAEAIEPSRKKKSNVKYASICAILASMASVILGYDIGVMSGAAMYIKKDLKITDVQLEILIEILSLYSLIGSFAGARTSDRIGRRLTVVFAAVIFFAGALLMVFAATTPCSWWAASWPELAWPTGAWIAPVYPDEISAGGVPGVSSPAFPGRGSLTGGIPVSATWTK

SEQ ID NO: 21573 - DNA, 677 bp, Zea mays
  misc_feature: Ceres CLONE 1390797-F
  misc_feature: Encodes the peptide sequence at SEQ ID NO. 21574
  misc_feature (444)..(444): n is a, c, t, g, unknown, or other
aaagctggagctccccgcggtggcggccgctctagaactagtggatcccccgggctgcaggaattcgcacgagaccattacctagaacatcctaatcgaaaaactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgcggaaggaggtcttcctcgtcgagaccatggacaacgcctccagctccagggagtccatggcgcacctcaaggncgtctacttcctccgaccctccgctaaacacgtccagaagctccgcaggcacctcgccatggcgcgcttcgccgagtaccacctattctttctcagtatattgaaggtcccgcagattcaaatacttgctgactcggatgaacagggagttgtgcagcaaggtcaggaagtctatggctgatttttggtgccatgacccataccatttcactctcaacatacaaaataaaccg

SEQ ID NO: 21574 - protein, 128 aa, Zea mays
  misc_feature: Ceres CLONE 1390797-F
  misc_feature (69)..(69): Xaa is any aa, unknown, or other
MVLITLVRDYIDRMLHDIPGMKVLVLDPQTVGMVSVVYSQSDLLRKEVFLVETMDNASSSRESMAHLKXVYFLRPSAKHVQKLRRHLAMARFAEYHLFFLSILKVPQIQILADSDEQGVVQQGQEVYG

SEQ ID NO: 21575 - DNA, 726 bp, Zea mays
  misc_feature: Ceres CLONE 1390799-F
  misc_feature: Encodes the peptide sequence at SEQ ID NO. 21576
  misc_feature (298)..(298): n is a, c, t, g, unknown, or other
tcaccgcggtggcggccgctcttcacactagtggatcccccgggctgcaggaattcgcacgagaccattacctagaacatcctaatcaaaaccctccactcgcctccaaatcttctctctcctttcctcctctcgtctcaccgcatcacctctccctccggcgcgcgcgtccgggtacagcgctagagtcactcaccaccatgcaggcggcggcggcggcgaatggcgcgggcgacgtgcagaagcctcagcagcaaccgctggtggcgggggcgccgcccccaccgccgccgggggncgtggtgccgccccattgggtcgccatgccgttcgcaccgcctccccggggccgcggccatgctgatgaagccgcaccatatggcgcctccgccgccgcaagtcccgcccaatcacttcctggcgtttcaacgccgtcgcgccggccccggtaaaaatccgccgcccagcaagcgccgcaaatggatccccccggagaccgttccgccccgcgcaactgggacaaacaagtgcccggcggcccgcgacgcacctctattctattggaacgccacgacaaccccccgtgggcctccacggcgtgcccccaccatctaccaatgtgtgtttaaacgcatcacccactctccctcccgctccccccccctctcccgcccgcgcccccccctcacccaaactcacctcccatccccccttccgcagtgctcc

SEQ ID NO: 21576 - protein, 83 aa, Zea mays
  misc_feature: Ceres CLONE 1390799-F
  misc_feature (33)..(33): Xaa is any aa, unknown, or other
MQAAAAANGAGDVQKPQQQPLVAGAPPPPPPGXVVPPHWVAMPFAPPPRGRGHADEAAPYGASAAASPAQSLPGVSTPSRRPR

SEQ ID NO: 21577 - DNA, 663 bp, Zea mays
  misc_feature: Ceres CLONE 1390801-F
  misc_feature: Encodes the peptide sequence at SEQ ID NO. 21578
  misc_feature (395)..(395): n is a, c, t, g, unknown, or other
  misc_feature (428)..(428): n is a, c, t, g, unknown, or other
  misc_feature (502)..(502): n is a, c, t, g, unknown, or other
aaagctggagctccccgcggtggcggccgctctataactagtggatcccccgggctgcaggaattcgcacgagaccattacctagaacatcctaatcgaaaaatcccaagaagagccgccctacctattccttctcccagccgtcgagctgcccaacccagagcaccagcagccctcaccttcttcctctcggccggtccttcaaacgagcccgctcgtcttggagccgccgccggtctcgttctggacgaacgttcaagtagattgcatttgtggatgctctaatggagtcgaaaggtggcaagaagtctagtagtagtagtagtaatttcatgtacgaagctccccttggctacaagatcgaggacgttcgcccagccggaggaatcaagaangtccagactgctgcttattccaactgcgtccgncagccatcctgatatcgcctcacatgcaattcgcggtagagtaggattttaattcagttttcctcttgtggcgntagttttccgttgggtctggctgccttcctctgcctctgagattccaactggtcttgccatctctccttttccctctcatcctctctttctgcaacacgtcatccaggggcgatgtcctcaagagattctgggggctcttccccggctccctattggcttg

SEQ ID NO: 21578 - protein, 51 aa, Zea mays
  misc_feature: Ceres CLONE 1390801-F
  misc_feature (1)..(51): Pfam Name: AdoMetDC_leader Pfam Description: S-adenosyl-l-methionine decarboxylase leader peptide
  misc_feature (37)..(37): Xaa is any aa, unknown, or other
MESKGGKKSSSSSSNFMYEAPLGYKIEDVRPAGGIKXVQTAAYSNCVRQPS

SEQ ID NO: 21579 - DNA, 679 bp, Zea mays
  misc_feature: Ceres CLONE 1390807-F
  misc_feature: Translation starting site: 265
  misc_feature (351)..(351): n is a, c, t, g, unknown, or other
  misc_feature (402)..(402): n is a, c, t, g, unknown, or other
  misc_feature (409)..(409): n is a, c, t, g, unknown, or other
aaagctggagctccccgcggtggcggccgctctatcaactagtggatcccccgggctgcaggaattcgcacgagaccattacctagaacatcctaatcgaaaaataaataccactcctgcgattccaccttgcagttggaccggccgttgttgctttgcttcttcgcaaaaaaaaaacaaaaaaacaaaataggcctgtcttgctccgatcaggcgtgttcttaggcttcgctgcccctaccgcgtcttcgccgggatcggtccatggccggcgccgagcgcgcggaggcggtcgcgctggaacaagggctcctcgatccggaggaatccaaccaagtagtatacactggnagatggatcagccgacttttctggaaatcctgttgtcaaggaaagaacggntagatgnaaggcatgtccattcatattaggtaatgaatgctgtgaacgactgccctactatgccatctccacaaccttgttacttacttgacaaaaaactgcatgctggcaaggcctctgctgctagcagggggactacgtggccgggaacttgatacctaactccacttaatggcagccatcctggctgatgcaaacgtggggaaggccactggccaaccgccacattttccacaggaaaactccaacgggggaggaccctgcctgactccttcac

SEQ ID NO: 21580 - DNA, 670 bp, Zea mays
  misc_feature: Ceres CLONE 1390809-F
  misc_feature: Encodes the peptide sequence at SEQ ID NO. 21581
  misc_feature (268)..(268): n is a, c, t, g, unknown, or other
  misc_feature (349)..(349): n is a, c, t, g, unknown, or other
  misc_feature (471)..(471): n is a, c, t, g, unknown, or other
  misc_feature (645)..(645): n is a, c, t, g, unknown, or other
  misc_feature (670)..(670): n is a, c, t, g, unknown, or other
aaagctggagctccccgcggtggcggccgctctataactagtggatcccccgggctgcaggaattcgcacgagaccattacctagaacatcctaatcaaaaaaaattccccaaatcgacctgggctggacccagccgcgccccgtctgcctcctgcttctctctccgcttccgcttcctgcgcctccaggctccacttctccgctcggcagtctgcactggaaggacagcatgtcggcctcggcgtcgtcaccggcggcggcggcggncgatgagaagcaggaggcggcgcccgtcaggcgctgcaagggcgtcaacgacctcgacaaggtcgttctccgcgaggtccngggcagctccgcagaggtgtacttgtatggtgggcatgtgacatcatggaaagatgagcatggagatgaattactttttgttagcaataaggctattttcaagcctccaaagctatacgtgnaggaatacaatatgctttccgcagttctccaactttgggaatctggaaccacatgtatttgcaaggaataggacatgaagtgttgatgatgatcctccgccatttccagtgccaaccctcatagcgcttatattgacttgatccctcaactactgaagatgatttgaaatctgncctcatagtttgataccggctgagn

SEQ ID NO: 21581 - protein, 103 aa, Zea mays
  misc_feature: Ceres CLONE 1390809-F
  misc_feature (13)..(13): Xaa is any aa, unknown, or other
  misc_feature (40)..(40): Xaa is any aa, unknown, or other
  misc_feature (81)..(81): Xaa is any aa, unknown, or other
MSASASSPAAAAXDEKQEAAPVRRCKGVNDLDKVVLREVXGSSAEVYLYGGHVTSWKDEHGDELLFVSNKAIFKPPKLYVXEYNMLSAVLQLWESGTTCICKE

SEQ ID NO: 21582 - DNA, 670 bp, Zea mays
  misc_feature: Ceres CLONE 1390810-F
  misc_feature: Translation starting site: 241
  misc_feature: Pfam Name: Kelch_1 Pfam Description: Kelch motif
  misc_feature (538)..(538): n is a, c, t, g, unknown, or other
tcaccgcggtggcggccgctcttcaatagtggatcccccgggctgcaggaattcgcacgagaccattacctagaacatcctaatcaaaaattccctccctagcccagccagggaaccagtctcagtgaatcccgcgcccggatcaatctcgcccaaggaagcagctcttcacgacttgcttccagatccatccatccatccatccgaggttgggccgtgggggtgtcggtgcggtgggaaatggggaaggggatcagcggcgacgcccgcctcgcctcggcgccttacgaccagtgggtgctgctgagccccgccgggggctcgccgcgcccgcccgcgcgctacaagcatgctgcccaagtggttcaagacaagctgtacgttgtcggagggagtcgcaacggccgttctctatcggacgtccaggtttttgattttaagacatcctcttggtcagcgttaagccctgctagaggctcaaaacatcccaaccatgaaaatgatgccacagggtggatcgttcccagcattagcaggncacaggatggtcaagtggaaaaactatctcctgcccgtagctgggagcacaaggtcgtcatcatcattaaataagggttcagtttggcttatggatgggcaagcgaatagctgggctggctgatgaaaataa

SEQ ID NO: 21583 - DNA, 674 bp, Zea mays
  misc_feature: Ceres CLONE 1390812-F
caccgcggtggcggccgctctatcactagtggatcccccgggctgcaggaattcgcacgagaccattacctagaacatcctaatcaaaagactgtttgttttctaagctcgttcgccccctctcttctctccgtccaacgacggcgcgattcagatccaggcatacaggccatccttccgccgccgcggactgcgcttaatcttccttctccagcagccgggcgttcccgtcgtcctcgatcctcccctggactggatcgcaacgggagatccagccggacctgcggtggtcccttccttttctccaatagcataatgagctcgccaggggagaggtgattcgtcagggtggtatcaagttctaatctatggggcctgaatgacaataaagaaggcactggcccgggaaagaagaaggttcctctccgcttccggtaacgggtaacggcctggcctccgcctcctggtggtccgaccgaaaagtgaagaaaaacccgtaaagggctccgccgggaaccagtaccggttaagccaccggaaaaaccgagaaagggtgaccacctgcccctccgccaaggaacagctctctgggaaaaagggctcccctttggccgggcttccgagggacgggtaaaggggcccccagagggggcgccccccccccaaaaagggag

SEQ ID NO: 21584 - DNA, 663 bp, Zea mays
  misc_feature: Ceres CLONE 1390813-F
  misc_feature: Encodes the peptide sequence at SEQ ID NO. 21585
  misc_feature (552)..(552): n is a, c, t, g, unknown, or other
cgctctatactagtggatcccccgggctgcaggaattcgcacgagaccattacctagaacatcctaatcgaaaaatagagatagagatagacagctagcttcatcagtaggatgggcagcgacgaggaagcggcgctgctggtgccggcggtggaggagggttgccccgggtgcgtgatggagcggcggaaggcgagcagcaacggcaggatcccctacagggagctgttcttcgtcgccgccacctccctcgcctcagctttaccgatcacgtgcctcttccccttcttgtatttcatggtaagggacttccgcgtcgctgaaacagaggaagacatcggattctatgctggttttcttgctgcgtcgtacatggtgggcagaggcttctcttccatcttctggggcgtcatcgcagaccgcgttggacggaagcctgtcatcacgttttcgatactggtccgtggtcgtattcagcggcgctgtttggcttgagcacgacgtactgggatggcgatcgccacgaggctcgtgctgggcgctctcaacggnctgctcgcccggataaaggcgtactggcgttgaaagtttgccagaaccagcaccagggcgcttggactctcgcttgtgaacacggcatggggctctgggtcctcattggtt

SEQ ID NO: 21585 - protein, 127 aa, Zea mays
  misc_feature: Ceres CLONE 1390813-F
MGSDEEAALLVPAVEEGCPGCVMERRKASSNGRIPYRELFFVAATSLASALPITCLFPFLYFMVRDFRVAETEEDIGFYAGFLAASYMVGRGFSSIFWGVIADRVGRKPVITFSILVRGRIQRRCLA

SEQ ID NO: 21586 - DNA, 819 bp, Zea mays
  misc_feature: Ceres CLONE 1390821-F
  misc_feature: Encodes the peptide sequence at SEQ ID NO. 21587
  misc_feature (12)..(12): n is a, c, t, g, unknown, or other
  misc_feature (17)..(17): n is a, c, t, g, unknown, or other
  misc_feature (19)..(19): n is a, c, t, g, unknown, or other
taacatttccantaatnantacaaattttttttttttgcttgctctccaaaaatggtgctccccgcggaggcggccgctcttcaactagtggatcccccgggctgcagttattcgcacgagaccattacctagaacatcctaatcgaaaaatcgagtcatcgttcagagacagaggctggtcgatcgtcggtgactgatggcgatggcggcggcgcaattggaggcggaggaggagctgcggctgcaactggaggcggtggcggcggtgtacggagacgacgtccgcgtgctccgcgacctcccaccgcacctcttcgtccacgtgcggccccgcaccgccgacgacacctcgcagcaggtgtgtctcatctcgccgcaccccacccctcgtgcttccatccctgccattgcgcgccaagaggtcgggggttagacgactccgattgatcaatccggccgattggacgggtccgctgctcctgcccggtagctattatccggtagcaactggggtggggagagttgccccccttttctccggaacagaaccccctacctcgtggaataacaagctggtatggtaccccctctcaccccaagccttaacgccatcaagcccaaatcacacttaaaacagcctgacccaacgcacctccttatggtggttgcggccccaacgttaccgattatgtacccaggtaccccctaacacacaccaatctcccgcccccgcatcgatcgccacctctcccccgcctgcacctccagtacgtggagacacactgagcgaaaaacacacacagacataaaataaaaat

SEQ ID NO: 21587 - protein, 78 aa, Zea mays
  misc_feature: Ceres CLONE 1390821-F
MAMAAAQLEAEEELRLQLEAVAAVYGDDVRVLRDLPPHLFVHVRPRTADDTSQQVCLISPHPTPRASIPAIARQEVGG

SEQ ID NO: 21588 - DNA, 516 bp, Zea mays
  misc_feature: Ceres CLONE 1390824-F
  misc_feature (185)..(185): n is a, c, t, g, unknown, or other
  misc_feature (196)..(196): n is a, c, t, g, unknown, or other
  misc_feature (299)..(299): n is a, c, t, g, unknown, or other
ccccgcggtggcggccgctctacaactagtggatcccccgggctgcaggaattcgcacgagaccattacctagaacatcctaatcgaaaacctccccatcgcgtctgtccgctacccctccccgaccagatcgctacgagacgccgcgcgatccgacccaggccgacgccgacgacccctctcgnccgccggcggncatgggcgtacgggcgacccgcgtcaccaccttcgaggactcgagatgagaggagtacgctatgtccgcaggtctcctgacctgtggtgtgctgatggatggntgtgctgcatgtatgaactggtcgggtcggaatgatacctcttggggaaaataccggctgggggggttccgctaaaatccagtttatggggaaacccggggacggtgggtaaaggcccccggttggaaaaaaaaaaaccccctttccattgaaaatggggcccgggaaattttgggaaaatttttttgggggggtccccccgccccccccaaaaacc

SEQ ID NO: 21589 - DNA, 579 bp, Zea mays
  misc_feature: Ceres CLONE 1390827-F
  misc_feature: Encodes the peptide sequence at SEQ ID NO. 21590
  misc_feature (92)..(92): n is a, c, t, g, unknown, or other
  misc_feature (242)..(242): n is a, c, t, g, unknown, or other
tcattactagtggatcccccgggctgcaggaattcgcacgagaccattacctagatcatcctaatcgaaaaaaaaaaaaccgtaatagcaanaaacgactccacacggtccacggcgtcttctccggcgaaccttcgcgagccctcggctcccctctaccaccgctgccgcgaccccgcctccagagcatcctcgggtagcgctctggcttcccgtgccgccggacgtcctgcaggaggcgncggcctccgtggcatgttgatgaggggcgccgctgccctccctcgccgatcgtcgcggccctcggagccggggtcctcctcctccccggctcccgcccctggggcctccctcaggcggggctcctggccctgggggcctcccttcgaccccttccgatggtcgaatacggacccgccatcacgggcctgaggctgaaccccccgacaaaaatcgggctttttggggccaaccggcctcggcggattttccagagaaaaaggggaaaagcgcccgggaaaggctttgtcccaaaaaagattaaaaaacccccccccgggaatcggaaaattagaaaaa

SEQ ID NO: 21590 - protein, 58 aa, Zea mays
  misc_feature: Ceres CLONE 1390827-F
MLMRGAAALPRRSSRPSEPGSSSSPAPAPGASLRRGSWPWGPPFDPFRWSNTDPPSRA

SEQ ID NO: 21591 - DNA, 759 bp, Zea mays
  misc_feature: Ceres CLONE 1390830-F
  misc_feature: Translation starting site: 188
tggagctccccgcggtggcggccgctctagtactagtggatcccccgggctgcaggaattcgcacgagaccattacctagaacatcctaatcgaaaactctgtctctctagggtttttgattttagccgccgccgctgctcatctcacatccctcgagaagacgcctgctactcgccgatcgatacgatggccgtcttctccgacctccacaccgccgacggcctcaaggtccctcgaggctccacctcgccggcaaaacctatgtgtctggtgacgccattagtaaggatgacattaaggccttcgccgcggtgccgtcgaaacctggcggtgagtttcctaatgccgcccgcttggtacgagaccgtctcctgcgggtggaggcttcaagattccctggtaagggctgttgggggtaaatcctgccttgcgggaatcagctcccggcgggaggctgctcctggcggaatgaggcgtgaaggatagatgaatgaccctttgatcctttttttggtgagtgaaacctggagggggaacaaaaaggggcgcctggatgaaccggggcccgccgcctgccaaagggcccccttctaaaaaaaaaaaagaaaggggggtaaaatcccccccccccccttatggggttggccaaacccctgggggcccgtagggaaccgggtcttgagaaaaaagctgggaggaggggttcgtccccgggggaggcccagaatgggggggtctccgctcttctggggagaccc

SEQ ID NO: 21592 - DNA, 841 bp, Zea mays
  misc_feature: Ceres CLONE 1390834-F
gaaaaaacacccccgaagcgcgcaacccccacgccccccccgccccaaaggtgggagtccccgcgggggaggccgctctccaatactgcatcgcccgggctgcaggaattcgcacgagaccattacctagaacatcctaatcgaaaagccgccaccgtcaccgtggcccgccgccatataagtaaaccctcgcctcgtcctcctcccaggctcgccaccctccgcctccgacacatggcccacccgcacctcgtgctcccctccccgaagtccctcctccccgccgccgcaactccatcgcgccgcgccgtcgccatccgcgcggcgctctccacacttttgtctccggccaaggcggcagttggagcagaggccgttgccatcctatccgcgcgggcaaagatcggggtacagccggggaaaaccccgcgcgcgaaaggtccacctccttccgccagacaacaacgcagatcacccccaaccaaggacaagagctctggggcgcccacactacccccacatccaccactggatatagataactcatctgtcatactcctcggtggtctttctcctcccctccgctctcttcagacttttggcggctcggcatccttttacgctctctatctcaacaccccaccccgcccagcatacacgacacgcggtgcccacccctcgatcataggaacccacccatcacaaatagcacatcaccccactaaccccgcacgtggctaatcggcatccacccttccctctcctatctccatctctcagctcgcccctccacacctacccccccctgccaccgtcccgactacagtgagacaaccccaaa

SEQ ID NO: 21593 - DNA, 651 bp, Zea mays
  misc_feature: Ceres CLONE 1390836-F
  misc_feature: Encodes the peptide sequence at SEQ ID NO. 21594
  misc_feature (338)..(338): n is a, c, t, g, unknown, or other
  misc_feature (434)..(434): n is a, c, t, g, unknown, or other
  misc_feature (435)..(435): n is a, c, t, g, unknown, or other
  misc_feature (524)..(524): n is a, c, t, g, unknown, or other
  misc_feature (525)..(525): n is a, c, t, g, unknown, or other
tccccgcggtggcggccgctctatcacagtggatcccccgggctgcaggaattcgcacgagaccattacctagaacatcctaatgaaaagaatcgggtcagatcgggccatcggggaagcgagggagctcacgcggcgccatggacgaggaggagcacgaggtttacggccaggaaatcccggaggacggcgacatggacggcgctgacgttgatatggctgcctccggggatgacgcggcgaagctgcaggagctcgacgagatgaagcgcaggctgaaggagatgtaggaggaagccgccgccctccgcgatatgcaggccaaggtcgccaaggangatcggcgagatcgagcccacaaatcacgggacggcatggcagccttgccccgctctccccacagcgcccgcctgccccttttccttgcgtgactnnttgagatggatttgcgaatccatggatcccccgaaatcggcggtctgcccaaatccgccgcgatccccggccccgcggaggcttccttnnctatggcgacgaatccccgcgtccatcctcgaatcacgcccttttcatcccgtggctggtaaaagggaggggatctgcgcggagatcttcttatcccgccacgaacgcatccattgatcaaaatcc

SEQ ID NO: 21594 - protein, 49 aa, Zea mays
  misc_feature: Ceres CLONE 1390836-F
MDEEEHEVYGQEIPEDGDMDGADVDMAASGDDAAKLQELDEMKRRLKEM

SEQ ID NO: 21595 - DNA, 714 bp, Zea mays
  misc_feature: Ceres CLONE 1390837-F
  misc_feature: Encodes the peptide sequence at SEQ ID NO. 21596
aaagctggagctccccgcggtggcggccgctctatatctagtggatcccccgggctgcaggaattcgcacgagaccattacctagaacatcctaatcgaaaaatacctcctcaaggcacgttcaccacagtcctctctttccccggcaccaccaccaccacccaggctaacaggactggaccgagtgttgaacaacactgcagtgagtgacggcaggcatggtgagccgtgaaaatttgcacctggtgctggacccggcgtctctgggcgcgccttgggccgacccgtccgccgcagagatcccgccgcagctcctcgccgcgctgggagagtacctctcctccgcccgcggcgacgtcaagacggaggcggacgacgagttcatgatgcacgagttcaaggtgcggcggtgcgcgcgcgcgcggaaccacgactggacggggtgcccctacgcgcacccgggggaagcccgcgcggggcggcacccgccgccgcgtggtctacctggtggaggcgtgaccggaattcgggagccgcccggtccccggcggcgcgtggccccgaggagacccccgccccgttcggggacggaacctttaaggttgtggatcccccggtcccggttaccggacgccccccctgccgtgggggaacatccttgcccccgcccccttatgtttttttttcgaacggccgcgggccaagctcccaccc

SEQ ID NO: 21596 - protein, 165 aa, Zea mays
  misc_feature: Ceres CLONE 1390837-F
MVSRENLHLVLDPASLGAPWADPSAAEIPPQLLAALGEYLSSARGDVKTEADDEFMMHEFKVRRCARARNHDWTGCPYAHPGEARAGRHPPPRGLPGGGVTGIREPPGPRRRVAPRRPPPRSGTEPLRLWIPRSRLPDAPPAVGEHPCPRPLMFFFRTAAGQAPT

SEQ ID NO: 21597 - DNA, 702 bp, Zea mays
  misc_feature: Ceres CLONE 1390838-F
  misc_feature: Translation starting site: 327
  misc_feature (438)..(438): n is a, c, t, g, unknown, or other
  misc_feature (583)..(583): n is a, c, t, g, unknown, or other
ggagctccccgcggtggcggccgctctagaactagtggatcccccgggctgcaggaattcgcacgagaccattacctagaacatcctatcgaaaaagccacgcgcccacgcgccccaagttcacgccggacctgctcctctccgacggcggcatcggcttcgtgctccgctacttccccaaggcgttcaagccccgcgcccgcccaggccacgaggtggacgaccgacctcgccaacctcatcaagctctacgcggactggcactcccgcctgatcccctactactccttcgaacagttcgtgcgcaaagtcgagaaatcgggacgatggtgggcctctctgaaggggagaaacacttcatccgcggcggcattgcacaagaccttcgcactgatggacgtaggcggctgcagttccggtccctctccgtcaaaccgnagtcattcacagggcgatggctcagcgcgtgttaggtgggggccactgaaataatcgctagtgtcagggctgattaagaaaacaaagcattcttcccctgacaaagaaaagttgccatttttggcgacggaaatcaaccggtgancccctgtttgaggaaaaggctctaaaaaatggcggctgacctccctgttccctggaaaaaagtttggtggggggaaaaagggggctgggggggaaatggactgccaccccaaagggggg

SEQ ID NO: 21598 - DNA, 750 bp, Zea mays
  misc_feature: Ceres CLONE 1390845-F
  misc_feature: Encodes the peptide sequence at SEQ ID NO. 21599
  misc_feature (367)..(367): n is a, c, t, g, unknown, or other
  misc_feature (370)..(370): n is a, c, t, g, unknown, or other
  misc_feature (389)..(389): n is a, c, t, g, unknown, or other
cgctctataactagtggatcccccgggctgcaggaattcgcacgagaccattacctagaacatcctaatcgaaaaacaacaccagaatccgcgaatcacagacgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtggtccaccgtgtacagcacgctgatgccgtgcctgggcgtcgtccagatgggcgggggcatgcccgccccagcgtgctgcggnggnatccgcagcctgctggagnaggccaaaaacacccccgacgcgcgaccatttgggggttgcctcaagaacggccgcaacggggccagggggaagggggaccaaaataagccggggccccccggtttccccaaaaggggggggggcccccctggcgaaaaaaatcccccccacgtttagggggaaccctttaaattaaaggggcgcccctggcgccccccggcaaaaaaaatctcttctgggcaaaaaaaaaaaaaagggggcgcccgggttttttaaaaaaaaagggggggggcgcccccccaaaatttggggggggaaaacccccccccccccccaaaaaaattgtttttggggggttgttgcccccgaaaaaaaaaaag

SEQ ID NO: 21599 - protein, 118 aa, Zea mays
  misc_feature: Ceres CLONE 1390845-F
  misc_feature (67)..(67): Xaa is any aa, unknown, or other
MAAPKLATLALAVLLAATVVAPPAAVRAAMSWSTVYSTLMPCLGVVQMGGGMPAPACCGGIRSLLEXAKNTPDARPFGGCLKNGRNGARGKGDQNKPGPPGFPKRGGGPPGEKNPPHV

SEQ ID NO: 21600 - DNA, 745 bp, Zea mays
  misc_feature: Ceres CLONE 1390847-R
  misc_feature (1)..(1): n is a, c, t, g, unknown, or other
ncaattgggtaccgggccccccctcgaggtcgacggtatcgatattttttttttttttttttgtgtgaactaagagtctgttgttgttttctgtcttcactttaggcgcgttcgaaccctccacaatatgggaacctggaatggatagaagaaactgagaattgaggttaacaagcaccactctacaggcatctctacatctgccgcactataccgccgcaaagatgaaaatggagaagctctgctgcttctccaagagagccccagaaatgcgccttggagcaggatccatcttctctagctctccttctctaacgcttgctgtcgctggagaaaacaagccttgctgacaaacctccccttgacccgaggccggtagtaccgactctgcctgttggatgggaggggagtgcatggcttctgcttgcgctgcatcttcagaatgttgccttccctgataacagcgccggtaccattctttgggaagagatcattgtcttcatgtttaactaccacatgagcaggggacaatggcaagtcaggcccattgccatcagcaaacgcagagcctctgccacaccacgccttgagcaccccatcagtattcaagctaagccccaatcctgtctcaggcagtgccaaagctccatcgtcgtcgccattggcaggctcaggactcccctcctcgtatattgtccccagtgacttcttcttagtcttcttcctgactgtcaccttcgacatt

SEQ ID NO: 21601 - DNA, 671 bp, Zea mays
  misc_feature: Ceres CLONE 1390847-F
  misc_feature (316)..(316): n is a, c, t, g, unknown, or other
  misc_feature (357)..(357): n is a, c, t, g, unknown, or other
  misc_feature (435)..(435): n is a, c, t, g, unknown, or other
  misc_feature (525)..(525): n is a, c, t, g, unknown, or other
  misc_feature (556)..(556): n is a, c, t, g, unknown, or other
  misc_feature (597)..(597): n is a, c, t, g, unknown, or other
ggagctcaccgcggtggcggccgctctataactagtggatcccccgggctgcaggaattcgcacgagaccattacctagaacatcataatcgaaaaaaacaagaatcctcatgagttctagaagtgaagtccgatctctggctgaggtgtccgtttcctcccgttgctggatccgctgactgaccgatcggaagagccgccatggcgtcgtcgtgcatcccggccgacgccatccgtctgccggacctggagatgttcaagggcgcgccgccggcgcactccgcgtcgtccctccacgatctcggaggcgtccagngcgtctgcagtctcgtcgacgaccacctcgtcatcggtggncgtcgctgtcgctcaagcgaccgctgacgctgtggaagctctacaaccagacgtacatcgacgccgtcgtgctgatcncgtcatgtccacctccgactcccggtctgcctgcgttcaaggcccccaccgcttgcccccagatcgccaaggaaaaggtggggccacaanccggccggacacccaacacccagcggagggnccccagcccgcggacggcaacggccgcccccccggcggggngccccgcccggaggcacaaggaagccgacccccccccggccgaaaggaggaaaaaggcccccccaaagcgcccg

SEQ ID NO: 21602 - DNA, 683 bp, Zea mays
  misc_feature: Ceres CLONE 1390848-F
  misc_feature: Encodes the peptide sequence at SEQ ID NO. 21603
  misc_feature (610)..(610): n is a, c, t, g, unknown, or other
aagctggagctccccgcggtggcggccgctctataatagtggatcccccgggctgcaggaattcgcacgagaccattacctagaacatcctaatcgaaaaaaaaaaaaagttggtccgctcccaccctccgtccgaccgtcctcgacctcccgtcccgccgcctcccacagtcgcaaccctagtcccacccgccgtcctcccgccctcccgcttcccattttcagtcgccgagccgcgtacagcgcacgcactgcacgcgcatcggcacttccagcgacgcgtcgtgagctcctcccttcgacccttcctgtggcgcgtcgtaagctctgtgcaggcgacggcggcgcgctaccagtgacggggggatacggcggcatcgtccccctcggcccctcctccatcccggtgcggcggcgccagcctacagggcaggagtaccaccaagcgagcgcgatggtgagctccgcactgaggcgctgtctcccctgccatgcctctctctgtcatgccttccctccccatccgctgctggccgctgccggcgttcttccgcggtcattccaggtcccgggggatggtgagactatggacgaattcgaaagaacgggntggttttgggggcaagggacacagaaaaagggaccactcttacaagaagtttcgataggggctgaataacccc

SEQ ID NO: 21603 - protein, 74 aa, Zea mays
  misc_feature: Ceres CLONE 1390848-F
MVSSALRRCLPCHASLCHAFPPHPLLAAAGVLPRSFQVPGDGETMDEFERTGWFWGQGTQKKGPLLQEVSIGAE

SEQ ID NO: 21604 - DNA, 700 bp, Zea mays
  misc_feature: Ceres CLONE 1390850-F
  misc_feature: Encodes the peptide sequence at SEQ ID NO. 21605
  misc_feature (398)..(398): n is a, c, t, g, unknown, or other
  misc_feature (403)..(403): n is a, c, t, g, unknown, or other
  misc_feature (404)..(404): n is a, c, t, g, unknown, or other
  misc_feature (407)..(407): n is a, c, t, g, unknown, or other
  misc_feature (409)..(409): n is a, c, t, g, unknown, or other
  misc_feature (439)..(439): n is a, c, t, g, unknown, or other
  misc_feature (441)..(441): n is a, c, t, g, unknown, or other
  misc_feature (459)..(459): n is a, c, t, g, unknown, or other
gctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctgggcgtgtcgaccgccgaggcgaggaaacatcagaccacgacgacggaaaagaaggacgacgcggtggtgcagccgcaaaactttccgccttttcgacgnctcgnnggngncgcgtccccggggttcggcggcctcccggngnagcattcctgggagaagnatccccggttcagcatgcccgggaggggaagcaccctacggggttcatttgcccggaggggaaaatgccccttttcggggggggtccccgggtttcagggtttcgggggatggccggggtccccacggcggttccgtccccagagcgccccaaacccttgaaagccaaaaggggggtaaaaaggggggcttcttgtaatggaaaaaccccccccttttggggggggggggcgggggtcccc

SEQ ID NO: 21605 - protein, 124 aa, Zea mays
  misc_feature: Ceres CLONE 1390850-F
  misc_feature (53)..(53): Xaa is any aa, unknown, or other
  misc_feature (55)..(55): Xaa is any aa, unknown, or other
  misc_feature (65)..(65): Xaa is any aa, unknown, or other
  misc_feature (66)..(66): Xaa is any aa, unknown, or other
  misc_feature (72)..(72): Xaa is any aa, unknown, or other
MARSSKMMVAAALLALALGVSTAEARKHQTTTTEKKDDAVVQPQNFPPFRRLXGXASPGFGGLPXXHSWEKXPRFSMPGRGSTLRGSFARRGKCPFSGGVPGFQGFGGWPGSPRRFRPQSAPNP

SEQ ID NO: 21606 - DNA, 648 bp, Zea mays
  misc_feature: Ceres CLONE 1390861-F
  misc_feature: Translation starting site: 192
  misc_feature: SWISSPROT Homolog: EC 2.7.1.4 Fructokinase
  misc_feature (467)..(467): n is a, c, t, g, unknown, or other
cgctcttaactagtggatcccccgggctgcaggaattcgcacgagaccattacctagaacatcctaatcgaaaaaccgcagccgcagcacaatcgcctcgccttcccttccccaccagcccgtctctctcttctctctgtctctcttctcgtagccgcgtccacctcgcagcagaaaggaagcgcgaccaaatgtcgcctctaggagacggcggagctgctgccgcggcggagtccaacaacctggtggtgtcgttcggcgagatgctgatcgacttcttccccgacgtgtccgtgctgtcgctgcccgagtcgtctggcttcgtcaaggcccccggcgacgcgcccgccaacgtcgcctgcgccatcgacaagctcggaggatcctccgccttcgtcggtcagttctgcgacgactagttcggatgcatgttgacgaacatcctgtagcatactactgtgactcgnacggatgcctgttctacagcacgcgcgtacgaggctggccttcgtgacactcaagtacgacggggagcgcgagttcactgtctacaggaacccgagcgctgacatgctgctgacggacgggaagcttgcactgtgtctggagcgacgcgccagtgtgtacactacggatgcatctcgctaa

SEQ ID NO: 21607 - DNA, 663 bp, Zea mays
  misc_feature: Ceres CLONE 1390869-F
  misc_feature: Translation starting site: 249
  misc_feature (252)..(252): n is a, c, t, g, unknown, or other
  misc_feature (306)..(306): n is a, c, t, g, unknown, or other
  misc_feature (663)..(663): n is a, c, t, g, unknown, or other
tggagctccccgcggtggcggccgctctagaactagtggatcccccgggctgcaggaattcgcacgagaccattacctagaacatcctaatcgaaaaaacttcgacccacacccacggcacggcagtcggcagcagccagcgtcgagcgcagtgccctcttgtctgctgcctcctacctccccgcccgctgccccgcgcccagtctcactcacacactcacacggtccgatcggagggggctgaggagatgnagccagattcggcgacgacgaggctcgcattgctggcgctgcttctcctggcgncgcccgcccgcccggcctcgggggctccggtggaggatggcctgctcagcaatggtgactttgagaggcaccccgcggcggtttcgaagatctgcgtctgttgctgaggggcatcgtcaacccctggttggacaatcaatgggacagccaagtcatttcagcaggcagcaccagggtgggatgatcctggttgttcccaggggaaaccttggtggaaggctagggaatgatgctagcgttggccaggggggggaacccaaaaagggctcggactaaccttgcaatttcggcgttgcccggacattgggacacctgggaggccatataacgtttcccggataaggtggggggggccan

SEQ ID NO: 21608 - DNA, 741 bp, Zea mays
  misc_feature: Ceres CLONE 1390870-R
  misc_feature: SWISSPROT Homolog: EC 2.7.1.4 Fructokinase
  misc_feature (1)..(1): n is a, c, t, g, unknown, or other
ncaattgggtaccgggccccccctcgaggtcgacggtatcgataagcttttttttttttttttttgccccaaggcattcattgaaaactctgcatggaaggcatcacattactcttcccaatcacacgacactagcaatgttcaaaaccccaactgatccaagctaaaaataaagtaaaaataaaggatagcatcccaccacgcatgccaacattttattgatgccccggggcgaaatctccactaaagctaacttaattaaccgaaacaaaccgtctcagcgtagaggcgcagagacggacgctaagactcgatctacctaatgaaccgaaacctaggacgtctaccactaggggcggggcggcaggggacagtgacgtgctggaactgccggcgtgcggccatgatctagttggcctcgcccatgaagtcctgggcggtggctaccgtgggcagcgcccggatggcgcccttcttggtggtgcagatggcgccacacgcgttggagaatttgagagcctctcggagcttctcctcgttgtggaagatggagtcgtcccttggcaacgttgaactagtgagggagccgcacaaaggcttaccccggcgccaagagggtgtccaacagttgtcgaaccttgaaaaccggaacacgcctcccccttgaagtccctttggtgaaagaaccctgccattcctttgccacccctccggagaaacaaccaacaaacctttggagcc

SEQ ID NO: 21609 - DNA, 764 bp, Zea mays
  misc_feature: Ceres CLONE 1390873-F
  misc_feature: Encodes the peptide sequence at SEQ ID NO. 21610
aaagctggagctcaccgcggtggcggccgctctacaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaagagggcggcgcccgatgggtgagcaggtgaagggcatgctccacgacaaggggccgacggcgtcccaggcgctgacgggggcaaccctgttccccctggggggcttggttgttgtggttgacggactggccgctaacggcctccgggggggggttgggccgggccacccccgggtgtctggatttaaaccccggggtggaccccccccgggggttcatgggaaaggcggtggggggccccccccccggggcgggggggggttcggggtcttatcctcgctaaagggcccccaaaaggagggggggaggggttcccacccccccgcgaaaaggggggggagagccccccccgaaggggggaaagcgcggttttccgcggggcacaaaaaccgcgcgagaggggggggtacaataagtgtgggggcccgattctctctccccaaaaaaaaaaaaaaggcacgcccgcaaataacaacgcgcgccttcc

SEQ ID NO: 21610 - protein, 186 aa, Zea mays
  misc_feature: Ceres CLONE 1390873-F
MADRDRSGIYGGAHATYGQQQQQGRGRRPMGEQVKGMLHDKGPTASQALTGATLFPLGGLVVVVDGLAANGLRGGVGPGHPRVSGFKPRGGPPPGVHGKGGGGPPPRGGGGFGVLSSLKGPQKEGGRGSHPPAKRGGRAPPEGGKARFSAGHKNRARGGGTISVGARFSLPKKKKKARPQITTRAF

SEQ ID NO: 21611 - DNA, 725 bp, Zea mays
  misc_feature: Ceres CLONE 1390887-F
  misc_feature: Encodes the peptide sequence at SEQ ID NO. 21612
tctattctagtggatcccccgggctgcaggaattcgcacgagaccattacctagaacatcctaatcgaaaaaagtcaagtcggagcctgcaggtgtcaacaccgcgcgccgggagccggaagaagggtggggggtgagctgtggaccatgagcgcgaccggccgagccccgtgcggcctgccgcgcatcggtctgggaacgggggtgcagggcccgcgtccggacccgtccgcgccgcggtgctgagcgccatccagctcggttaccgccacttcgacacggccgcgcactacgccaccgaggcgcccatcggggagggcgccgcccgaggcgtgcgcacgggttttcgtcgcctcccgggaagacctccttcgtacggtccacggtctggtgcgcccaacccgcaccgggaaaggggtgttcccgggcctcccgccggaaggttcagcaatctccaaattggaataactgtggactttaacatggtggaacttggccccggaaccattaaagggcgggaaggttcaccggcccccttttcccctccgaagaatttccaagccgtttcgaacaggggggccccctggggggaagcccttggaggaggtgccaccggcctgaggccctggccaagggccatcggcggcggggaacttttttccttggaaaaaaattctaaaaccctgttttttcttttgccaccatcccccttcgggggataaata

SEQ ID NO: 21612 - protein, 79 aa, Zea mays
  misc_feature: Ceres CLONE 1390887-F
MVELGPGTIKGREGSPAPFSPPKNFQAVSNRGAPWGEALGGGATGLRPWPRAIGGGELFSLEKNSKTLFFLLPPSPFGG

SEQ ID NO: 21613 - DNA, 816 bp, Zea mays
  misc_feature: Ceres CLONE 1390888-F
  misc_feature: Encodes the peptide sequence at SEQ ID NO. 21614
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (32)..(32): n is a, c, t, g, unknown, or other
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
nnnncccccccnnnnnnnncaccaccnncctnatannggggntttcccnnnnccaaagctggagctccccgcggtggcggccgctctagaatagtggatcccccgggctgcaggaattcgcacgagaccattacctagaacatcctaatcgaaaaaacccggcgaaagccccccaaaccctcgcaccctaaaacagcggcgcacaagatgtccgacgaccccaccaacggcggcgacggtgatcgcgtggaggacgtcgcccgcaccgagggtgaaaccaacctcgtgatgatggcttgtcgaaatccagggatagggacaaggatggagaaaaggccagggacagagatcgtcgccagagaccggggaacagagaatcgaggggagagaacagggaaccggggaataaggggacaggggaaacgggggaatatcggggaaccaaaaaaacaaaggggatcggccccaaaagaggaggcccttccccccccgggggaaaggaagcgggaaaaccagggggaagaccccggccccttggatgggaatcccccaggaaggcgccccggggggattcccttgggaaaaggaaaggaaagggacgaacccggcggaacccaaaaaaagggggggcactggcgggaaggggctgtcccgtcttgccggggtcccatcgggtgtaaaagggggggggaagaagggaaaaagcggaaaagagtcgggggggcgccgccggggtcaacaagggaaaggcgggcggggggatcgccgcccgggggtgtgttgggaggggcgacccaccgcgggcggaggagggag

SEQ ID NO: 21614 - protein, 203 aa, Zea mays
  misc_feature: Ceres CLONE 1390888-F
MSDDPTNGGDGDRVEDVARTEGETNLVMMACRNPGIGTRMEKRPGTEIVARDRGTENRGERTGNRGIRGQGKRGNIGEPKKQRGSAPKEEALPPPGERKRENQGEDPGPLDGNPPGRRPGGIPLGKGKERDEPGGTQKKGGHWREGAVPSCRGPIGCKRGGEEGKKRKRVGGAPPGSTRERRAGGSPPGGVLGGATHRGRRRE

SEQ ID NO: 21615 - DNA, 670 bp, Zea mays
  misc_feature: Ceres CLONE 1390891-F
  misc_feature: Translation starting site: 103
  misc_feature (239)..(239): n is a, c, t, g, unknown, or other
  misc_feature (259)..(259): n is a, c, t, g, unknown, or other
  misc_feature (260)..(260): n is a, c, t, g, unknown, or other
  misc_feature (364)..(364): n is a, c, t, g, unknown, or other
  misc_feature (371)..(371): n is a, c, t, g, unknown, or other
  misc_feature (396)..(396): n is a, c, t, g, unknown, or other
  misc_feature (413)..(413): n is a, c, t, g, unknown, or other
  misc_feature (493)..(493): n is a, c, t, g, unknown, or other
  misc_feature (539)..(539): n is a, c, t, g, unknown, or other
  misc_feature (670)..(670): n is a, c, t, g, unknown, or other
ggagctccccgcggtggcggccgctctagaactagtggatcccccgggctgcaggaattcgcacgagaccattacctagaacatcctaatcgaaaaagccacatggctccaccacctctgttcccgctcccgcctctcctcatcctcctcgtcatcgtgcctctgttccccaccgccgcgccgacggccacgacgctgccgctgtaccgccacctaccgcacgtagccgaggccgtggnatcgcaccaccaccacccgnnttgtccgctggccgccgcgtcgctggcccgcgcgttgcacctcaagcgccgggaccccaaccaccacagccagaaaggatcaggcggccacccgtcagtaccangcaccgncgcgctgtacccgcactcctacggnggctacgccttcacggngtcgctcgggacgccgccgcagccgctccccgtgctgctcgacaccgggagcaccctcaggtggggtgcatgcacctcgnagctacgagtggccgaattgctcctcccatccggctccgggcggtncgggtcttccaccccaagactcctcctcctccccgcctcggggggctgcccaacccctccctgggcagggggtcccattctgccgggaaacttcgccacaaaggggcggcggggccccctggttcccccgn

SEQ ID NO: 21616 - DNA, 698 bp, Zea mays
  misc_feature: Ceres CLONE 1390893-F
  misc_feature: Encodes the peptide sequence at SEQ ID NO. 21617
  misc_feature (316)..(316): n is a, c, t, g, unknown, or other
  misc_feature (341)..(341): n is a, c, t, g, unknown, or other
  misc_feature (375)..(375): n is a, c, t, g, unknown, or other
  misc_feature (401)..(401): n is a, c, t, g, unknown, or other
aaagctggagctccccgcggtggcggccgctctagaactagtggatcccccgggctgcaggaattcgcacgagaccattacctagaacatcctaatcgaaaaactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctcccagcttcttgctggcgtctccgacctccagctccgctacttcggnaacaggcggccccgccgccggaggngctccgctctacctctcccctctcggccggtggncgcgcactctgctcggattggctggngagatgcccaaagcctttgtgatcttaagatgatggtgggcaacacaccctgactaatttgcacagtattcaaaaaggttactatttttggaagggcaagggttgaaggaacaaattctcaggaagggggacttttatgaattttgggaaggagggccagggcgccttttgggtgggggaaaaataatccaaaccctccctaagaccccggggggaaaggggcgcccccctggcccaaaaacatttttgggctttccgcggcccggggataggggcggcccaaaaaaaactccgcgg

SEQ ID NO: 21617 - protein, 106 aa, Zea mays
  misc_feature: Ceres CLONE 1390893-F
  misc_feature (70)..(70): Xaa is any aa, unknown, or other
  misc_feature (81)..(81): Xaa is any aa, unknown, or other
  misc_feature (90)..(90): Xaa is any aa, unknown, or other
MATSPPQNPSSGEPSDASSLAAAALEAPVRVWRSLVARFPPLPDSSQLLAGVSDLQLRYFGNRRPRRRRXSALPLPSRPVXAHSARIGWXDAQSLCDLKMMVGNTP

SEQ ID NO: 21618 - DNA, 683 bp, Zea mays
  misc_feature: Ceres CLONE 1390896-F
  misc_feature: Encodes the peptide sequence at SEQ ID NO. 21619
  misc_feature (683)..(683): n is a, c, t, g, unknown, or other
aagctggagctccccgcggtggcggccgctctagaactagtggatcccccgggctgcaggaattcgcacgagaccattacctagaacatcctaatcgaaaaacacgaggagagactgcggcagcggagtgcagagagcggacgcaacgcaacaccgcccactctctatcactgacgatcgaagcgaggagcgcactgaagccagccgccgatgagtcgcctccctctcgcggcagcaccttgcccgcgtccgtcgatctgcaccctttggcggggggggtcccaggtggctggaccacgccgtcattcccggaggtggctccggaagaaggttcaggttccagcccagcggaagtgcagaattttggggagggcagctggacagcatctggtaactggaactggatagtccatccccctgaacggtgattaattcatcaaaggtgctgagggtcaggggaacagaaataaagccattcgtggagagtttatctaaatgcccaaaggatggacttcccaacccacttaaagctccagagaggtacctcatggatggagatatatctgcaaaagctgcgcatatgctggcccaacctgcagtcttagatttctttgctaaacttacccggagggatctccccagagctaccacaagttcttgaagaagttcagtttctcaaaagn

SEQ ID NO: 21619 - protein, 37 aa, Zea mays
  misc_feature: Ceres CLONE 1390896-F
  misc_feature: SWISSPROT Homolog: EC 1.5.1.12 1-pyrroline-5-carboxylate dehydrogenase
MDGDISAKAAHMLAQPAVLDFFAKLTRRDLPRATTSS

SEQ ID NO: 21620 - DNA, 649 bp, Zea mays
  misc_feature: Ceres CLONE 1390897-F
  misc_feature: Encodes the peptide sequence at SEQ ID NO. 21621
  misc_feature (264)..(264): n is a, c, t, g, unknown, or other
  misc_feature (265)..(265): n is a, c, t, g, unknown, or other
  misc_feature (290)..(290): n is a, c, t, g, unknown, or other
cgctctagaactagtggatcccccgggctgcaggaattcgcacgagaccattacctagaacatcctaatcgaaaaagactccatcgagttggtctttggtcgtgcttcgtgctgacgcttcgcgcgggtccgaggtcaggcggcagcagcacggagtagcaccagggcgaccgcccaggttatcgtcggccgccggcggcgacctgtaccccggcgagaaatgcatctgagcgaacgaggggatcgagggtctgcgattcgcgnntgacggcgggcagggccttcgtcgnagctggcctcagcctcgagctgctccgccgcggtgccggcgaggtccggtccctcgatctccgcgcctcctcctcctgggtccagcagctcctcgacgccggcgtccgaattatccaaggggacatagaaagaaagatggtgtgcgaagggctttccgtgaagtggactgtgtttttcaccttgcttcttattgaatgccagggaaagaaaatggtgcagactggaaaatctgacgaagttaatataaatgggacctgcaatgtaatggacgttttgcatgagaaaagtgtcaaaagttttgtttatttaacaacctaccatggggttttttggggaaaaacctattgtcaaggaaatg

SEQ ID NO: 21621 - protein, 74 aa, Zea mays
  misc_feature: Ceres CLONE 1390897-F
MVCEGLSVKWTVFFTLLLIECQGKKMVQTGKSDEVNINGTCNVMDVLHEKSVKSFVYLTTYHGVFWGKTYCQGN

SEQ ID NO: 21622 - DNA, 691 bp, Zea mays
  misc_feature: Ceres CLONE 1390901-F
  misc_feature: Translation starting site: 167
  misc_feature (371)..(371): n is a, c, t, g, unknown, or other
  misc_feature (419)..(419): n is a, c, t, g, unknown, or other
  misc_feature (515)..(515): n is a, c, t, g, unknown, or other
aagctggagctccccgcggtggcggccgctctagaactagtggatcccccgggctgcaggaattcgcacgagaccattacctagaacatcctaatcgaaaaagaaaaagaagatcaaggaggtttctcacgagtggtcattgatcaacaagcagaagcccatctggatgaggaagccagaagagatcacaaaggaagaatatgctgccttctacaaaagcttgacaaatgactgggaggagcatctggctgtgaagcactcctctgtggagggtcagctggagttcaaggctgttctctttgttcctaagagggccccatttgatctcttcgacacaaggaagaagcaaaacaacatcaagctctatgtgncgcagggtgtttatcatggacaactgtgagggactgatccctgagtgnctgagttttgttaggggtattgttgactctgaggaccctcccctcaatatctcccgtgagactcttcagcagaacaagatcctgaaggtgatccgnaagaaccttgtgaaagaatgtgttgacctcttctttaagatggctgaaaacaaggaggactaccacaagtttttatgaggctttcctcaagaacctccaggctgggaatccatgaagactcccagaacgggggacaagaatgctgagcttccgagaaacacctcccggaaaggggg

SEQ ID NO: 21623 - DNA, 715 bp, Zea mays
  misc_feature: Ceres CLONE 1390902-F
  misc_feature (295)..(295): n is a, c, t, g, unknown, or other
aaactggagctccccgcggtggcggccgctctagaactagtggatcccccgggctgcaggaattcgcacgagaccattacctagaacatcctaatcgaaaaaacccggctgtgctgtctcgtcgccttcctcccctcctgccggctgctgccgccgccagccgctgcaggcacgcttgccctctgctccctgtccatccactcatcattccccgtcatccaccaattcacaacccaaaaccctaaacccatttacctcaacgccaccgccgccgccgcgatgcagtccatggggnccacctctccctcaatcccggggggaggccccgttccccgccgccgcttccggcgcgtccgcgccgcccgcggtctccaacaaagccaaaattcaaaaagaacaggggggggaatcaacgaaccccaagtcggaagggggccccccaaaggcctgggttaacggggggtgggcacacacaaaagaaacaaaaaaaagcagagtcacacaccacccctcccaccaccaacgcaaagcagcgcggaagaccaaaaccgaaaggcaacctagcgatagccccgccaacaaaaaaaaacacaaagccgtcaacctgattctcctattattatcccccaaaccaacaagaaaaacagaaaaaagcaagaaacaaatatacaatcagtaaaacaaaggcgcgtatccaacaacactcaaccacccc

SEQ ID NO: 21624 - DNA, 683 bp, Zea mays
  misc_feature: Ceres CLONE 1390906-F
  misc_feature (95)..(95): n is a, c, t, g, unknown, or other
  misc_feature (215)..(215): n is a, c, t, g, unknown, or other
  misc_feature (224)..(224): n is a, c, t, g, unknown, or other
  misc_feature (405)..(405): n is a, c, t, g, unknown, or other
  misc_feature (406)..(406): n is a, c, t, g, unknown, or other
tggagctccccgcggtggcggccgctctagaactagtggatcccccgggctgcaggaattcgcacgagaccattacctagaactcctaatcgaanaaatccaagtaaggaaatccccgatgatctcctgcgcgtcgcagcgccagccactcgattagtggagtccacccaacaagcacgcgtccctcccccgtccagatcccatccccgcggagncggtcagtncgatcccatctcagtaaccagcccgtcacccgcctttccccgttcgtctcgtcggggcgggatggagggtctcatccagggggttggtcaccgtgggcatccaaccccgggaaggaacccccgagggggaaaaggaccaaggccggccccaaaaaaaaaaaggggcccaaagaaggaaagnnccccccaaaggtcccgttccaaatagaaaacgggggaaggaagaaaacgccaaaaaaatttcgggggccaaggggggcccaagaatctcctccccaaaaaaaaaaggggtggttttcgggaaaggggccggggaaaaaataaaaaggtgggggggggggaacatcccttttggaaaaaggggggtaaccaacactttttaaaaaaaacgccccttttttttaaaacaaaaaaaaacaccaccccccgggcggggagaaaaaaatggggggggggggg

SEQ ID NO: 21625 - DNA, 851 bp, Zea mays
  misc_feature: Ceres CLONE 1390910-F
  misc_feature: Encodes the peptide sequence at SEQ ID NO. 21626
  misc_feature (1)..(1): n is a, c, t, g, unknown, or other
  misc_feature (2)..(2): n is a, c, t, g, unknown, or other
  misc_feature (14)..(14): n is a, c, t, g, unknown, or other
  misc_feature (15)..(15): n is a, c, t, g, unknown, or other
nncccccccccccnntccccccccccccccgcccgttgtggtgccacccaccaagctggagctccaccgcggtggcggccgctctataatagtggatcccccgggctgcaggtaattcgcacgagaccattacctagaacatcctaatcgaaaaactgattccttccgccttgtcagcgcagcgatccagacccacccgagccaacaacccatggccgccgcgacgccgcgtctcctgctcgcggtcgcgggcctcaccctcgccgtcctcgccgccgcggtctcgccgtctctggcggcgggaccgccggtgttgcaggacccggcggagctccggcgcctggaaaagaatccggcctctcgggactggaagggtcggccgtgcagccgccgggctgcccaggaaacccgggagcttgcgccgacgggggaaggtaaagagccggcgggacgtagtgctcaggcttccggggggcgccccatgcgcgtaatgtcctgggcggaccaatcctcctccccacggcagtccggcggcgcgctcgcccgcccgggatggcagcaacaaggggtggcagcccatcatacgcgcgcccacccatggtacaagaccaccccccaaacatggcgaggccggtggggggacggggcgctgttaactggccttgggggtttgctgggcgcggtgatcctctttgggcccccccccccgcgacggcctggggtacctctgcgagggatgatgacaataaagggcgggcgagaagggggggtagcccgcccgcccccgccgcccgcgcctacctgaccccgactccccccccgccccccaacggacggaccggccgcgcggg

SEQ ID NO: 21626 - protein, 76 aa, Zea mays
  misc_feature: Ceres CLONE 1390910-F
MARPVGGRGAVNWPWGFAGRGDPLWAPPPATAWGTSARDDDNKGRARRGGSPPAPAARAYLTPTPPPPPNGRTGRA

SEQ ID NO: 21627 - DNA, 692 bp, Zea mays
  misc_feature: Ceres CLONE 1390911-F
  misc_feature: Encodes the peptide sequence at SEQ ID NO. 21628
  misc_feature (441)..(441): n is a, c, t, g, unknown, or other
  misc_feature (633)..(633): n is a, c, t, g, unknown, or other
ggagctccccgcggtggcggccgctctagaactagtggatcccccgggctgcaggaattcgcacgagaccattacctagaacatcctaatcgaaaaaaaccaaatctcaacgaaacattgccgcctccccctgaccgcgccccactccccagacgccgtcgcctagatccatgagacttcccgatcttcctgcggcccgaggatgtcccagagcgacgtcgactacggttgcggatcttgtggataccctctaaacctttcatcttctaaccgaagcacatctgaagtaggctcatataagaagtctctgaagaaaggactgattttcattcatttctgttgatctcagccgatttactcagggtggacgaagtatcttgctttccctcaccctgggcgtggttacaggccaaaacctaagcttctgtgccgaatatgtgnggcatctattggctacggatacggggagccggctgggttttgggtagtttgatccagcaagttcatctttcctcagtaccatcccagaagtattttaataaagatcccagcactcccaccttcagacaggactcagtaagtgaaatatggaaagagagggaaataggtgtccgcctagagaactccatcagntacctaatctggaggattgcttgcttttccatatttaaacaagctagaaagcgggtcag

SEQ ID NO: 21628 - protein, 46 aa, Zea mays
  misc_feature: Ceres CLONE 1390911-F
MSQSDVDYGCGSCGYPLNLSSSNRSTSEVGSYKKSLKKGLIFIHFC

SEQ ID NO: 21629 - DNA, 640 bp, Zea mays
  misc_feature: Ceres CLONE 1390915-F
  misc_feature: Encodes the peptide sequence at SEQ ID NO. 21630
  misc_feature (226)..(226): n is a, c, t, g, unknown, or other
  misc_feature (305)..(305): n is a, c, t, g, unknown, or other
  misc_feature (414)..(414): n is a, c, t, g, unknown, or other
  misc_feature (415)..(415): n is a, c, t, g, unknown, or other
  misc_feature (434)..(434): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
tccccgcggtggcggccgctctagaactagtggatcccccgggctgcaggaattcgcacgagaccattacctagaacatcctaatcaaaaattttttctgcattcgacgccgccgcaggcccgcagccagctcgagcccaaaggagagaacccaggttggcggcggcgctccgcggcgatggactccccctacgctctccacctcgccatcgccgcgctcgtcggngcctccttcgccgccgcctccgcctactacatgcatcgcaagaccctcgaccagcttctccgtttcgcccgcgaccagnagcgccgccgcaaccgcctcctccccgaagggacgaactggaggacggcgaacgagaccctccgccgcactgggatcatgatcgccgcaccctgcccatcccgccgggnnctccgccgctccacacggncgagagggtaggnnncagtgtttctccagttcgactaaaagagtggacctattgttagacgactacaccccaatcctctgtccccactatcagtgcatttgatagaattgaggatcagatgaggaggagatcttgtcccaaatgccaagatgaacctgcttactggaccccaatggggtattgggatcaatctccagataacggag

SEQ ID NO: 21630 - protein, 88 aa, Zea mays
  misc_feature: Ceres CLONE 1390915-F
  misc_feature (43)..(43): Xaa is any aa, unknown, or other
  misc_feature (79)..(79): Xaa is any aa, unknown, or other
  misc_feature (86)..(86): Xaa is any aa, unknown, or other
MDSPYALHLAIAALVGASFAAASAYYMHRKTLDQLLRFARDQXRRRNRLLPEGTNWRTANETLRRTGIMIAAPCPSRRXLRRSTRXRG

SEQ ID NO: 21631 - DNA, 668 bp, Zea mays
  misc_feature: Ceres CLONE 1390916-F
  misc_feature (435)..(435): n is a, c, t, g, unknown, or other
aagctggagctccccgcggtggcggccgctctataactagtggatcccccgggctgcaggaattcgcacgagaccattacctagaacatcctaatcgaaaaaccatcccggaggtaatcttgcgccgattcggtgccgatttgcgccatccgcgaccggaggctccgccggttcttgtgttcttgcggggcgggggctcaggacaacctggcctctgcttgattggattcggggcgttcggcgcctccagctcgtgatctttcctgccggtttcgtcgaccgctgatcaacctggccggtcggtcccggcgcctcttcacctctgtgctgactgccaccgtcgctttacttatgttctgacaaggattataactagctccgggcatacggctgaccgaatgcttgaattgcgggcttcttgtgttgatgaatcgntacgtgttgcgtctctcgggtccatgtgtgtggaagcacacaggttcctcgtctccggggacggggtcgggtgctcttgttttggaagctcacggaaccgttccaggaaagtactttttgcccttgcggaaatggcgtccagcaccaggaagtggccgagggaaagaaaaacttaacaggcccggctgttgggaaacaacattcctatgtgcgtgaaacaaaattgatcttac

SEQ ID NO: 21632 - DNA, 705 bp, Zea mays
  misc_feature: Ceres CLONE 1390920-F
  misc_feature (304)..(304): n is a, c, t, g, unknown, or other
  misc_feature (307)..(307): n is a, c, t, g, unknown, or other
  misc_feature (320)..(320): n is a, c, t, g, unknown, or other
  misc_feature (371)..(371): n is a, c, t, g, unknown, or other
  misc_feature (537)..(537): n is a, c, t, g, unknown, or other
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaaatcctcagtgctctctctctcctactcctgtgattctcctcttcagctcttctcgcccattccagctccgactgcgccggtgggggaccgcgcaccccagcggcgccaggcgtccacgggatggtggttcttgtggctactgccgctcggtggcccgggggaagcacggctgcccgggcgcgcccgccggctggcgaggggnggnccccccgccgcgnggccggcgggcccggcgcggggggcccccggcccggcttggcccccccccncgcgcgggccgccggggcgggccggcgccgggttcgcgccccgcccggcccgcgtgcgcggccgtgcccccttctcttggccccgcgcggcgggcgcgccgccggttccccgttgcgcgggcgtggggggggtggcccgcgggggcggggggtcggggtggggccnccgggcggcggcgcggcgcccgcctcgcgggggcgggtggcgggggggcgcggggctccctcccgcccctcgctccccctgcgcgccggcgtctctcgcccttcgnctccgggcggccgcgcgcccccgccgcgcgtcgggggcccctccgcgcggctcgggtgggcc

SEQ ID NO: 21633 - DNA, 788 bp, Zea mays
  misc_feature: Ceres CLONE 1390924-F
  misc_feature (51)..(51): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (664)..(664): n is a, c, t, g, unknown, or other
  misc_feature (668)..(668): n is a, c, t, g, unknown, or other
  misc_feature (676)..(676): n is a, c, t, g, unknown, or other
tttttcccccaataacccctgccggcgcgctgggcggaccttttttttttnaaaaactgcggctccccgcggtggcggccgctctagaatagtggatcccccgggctgcaggaattcgcacgagaccattacctagaacatcctaatcgaaaatatacccccgtcccatcgtatacgaatcacagacaaagcacgagcggtggtagctggccagccaccatggctccaccacctctgttcccgctcccgcctctcctcatcctcctcgtcatcgtgcctctgttccccaccgccgcgccgacggccacgacgctgccgctgtaccgccacctaccgcacgtagccgaggccgaggcatcgcaccaccaccccgctgtcccgcctggccgccgcgtcgctggcccgcgcgttgcacctcaggcgccgggaccccaaccaccacagccagaagagatcaggggggccacccgtcaattaccagccacccgccgcggttgtaccccgcacttcctacggggggctaacgctttcaccgggggtcccttcggaaacgccgcccggaaccgttccccccgtgttggttcgaacaccgggcagcccctcagtggggctggctcagtagggggatgtccctcgcggggttcatgtaggnnnnnnnnnnntntctnactacgcncacaccctctcgcgcaacaccactccaccagttgttgtcgtttccccaccaccaccccacacacctcgtgtggtccatagagactacggggagacagccaatcgtgcccgcc

SEQ ID NO: 21634 - DNA, 688 bp, Zea mays
  misc_feature: Ceres CLONE 1390926-F
  misc_feature: Translation starting site: 118
  misc_feature (234)..(234): n is a, c, t, g, unknown, or other
  misc_feature (264)..(264): n is a, c, t, g, unknown, or other
  misc_feature (359)..(359): n is a, c, t, g, unknown, or other
tggagctccccgcggtggcggccgctctagaactagtggatcccccgggctgcaggaattcgcacgagaccattacctagaacatcctaatcgaaaaatcgatcccagccccaggccatggcgacgaggtggaggaggtcgctgctctgggtcgccgtcgtccagttcctgaccctgtgcgtcgccgagcatctcgtagtggaagcatacaaaaaagtcctacattgtgtatcntggatcacatgcatatgggcgtgatgcgtncgcggaggagaatgctcgggcaaaccagtctcaccaccacctcctggcatcgatcctcggcggcgacgaccaccaccaccatgagagggcgcggnagtccatcttctactcttacaccaagagcaggatcaatggcttcgcggcgcacctgggaggagtccgccccgcaaaagatcggggaggaccctggagggggggggggtgctgaaaagaaaaatgttcaaggtggacaccacggcggcctgggactttatggacctggaggggcgagggccaccgccctccctgggttcctctggaacccccggttaaggttggaaaagtacgctatctccccccgccctcgacgtgggcgagggtggcccaattcccaacggtcttctcagaaaaccgctggccatggggcccccgtcgggggggaggg

SEQ ID NO: 21635 - DNA, 834 bp, Zea mays
  misc_feature: Ceres CLONE 1390927-F
  misc_feature: Encodes the peptide sequence at SEQ ID NO. 21636
  misc_feature (1)..(1): n is a, c, t, g, unknown, or other
  misc_feature (17)..(17): n is a, c, t, g, unknown, or other
  misc_feature (32)..(32): n is a, c, t, g, unknown, or other
  misc_feature (306)..(306): n is a, c, t, g, unknown, or other
ntttccctcccccttcncctccctccactatnaattaatgcttcacttcttcaaagctggagctccccgcggtggcggccgctctagaatagtggatcccccgggctgcaggaattcgcacgagaccattacctagaacatcctaatcgaaaaaagcaaagccaacgggatctccctctcattccagaggactccgcgtcgtcaggcccgcttcgcgtgcgacgccggcatatagggtttcgccggcgccggcgatggacccacccccgtgagcccggatcgctggggcccagtcagggcggtggngtcggccctccggcctccgccgatatgggctcaatttctccggctccagcctcctccaggcccccatcggggccctccttgagtactccgggggtattccaagcccggccctgggcctgggggggcacactccggccggcggggcccctccgtcggccgttgtccggcggccacaaggcacgatgcgtcttcttcccccactgccgcccattgatgatcccggtagatgttttcctaagactagattgccaggtcaatctccaagtgtgattaccgcaaccccccaccaaataccgctcgaaaaaagagcgaacaacatccaggcagaactggccttcctgccccatcctagcctgctggagaattacccgggcgaacaccacggctcagcacgagtggcgaggcgcgccacgacctccaccacgcttgtatgaagtataccgaccccgaatttagctgccccagcgattaacacccaccacgcccccggcggacagcgggcacgcctcccctcctgccgtatactcc

SEQ ID NO: 21636 - protein, 83 aa, Zea mays
  misc_feature: Ceres CLONE 1390927-F
MRLLPPLPPIDDPGRCFPKTRLPGQSPSVITATPHQIPLEKRANNIQAELAFLPHPSLLENYPGEHHGSARVARRATTSTTLV

SEQ ID NO: 21637 - DNA, 668 bp, Zea mays
  misc_feature: Ceres CLONE 1390929-F
  misc_feature: Encodes the peptide sequence at SEQ ID NO. 21638
  misc_feature (242)..(242): n is a, c, t, g, unknown, or other
  misc_feature (313)..(313): n is a, c, t, g, unknown, or other
  misc_feature (323)..(323): n is a, c, t, g, unknown, or other
  misc_feature (376)..(376): n is a, c, t, g, unknown, or other
  misc_feature (447)..(447): n is a, c, t, g, unknown, or other
  misc_feature (614)..(614): n is a, c, t, g, unknown, or other
  misc_feature (615)..(615): n is a, c, t, g, unknown, or other
  misc_feature (618)..(618): n is a, c, t, g, unknown, or other
aagctggagctccccgcggtggcggccgctctagaatagtggatcccccgggctgcaggaattcgcacgagaccattacctagaacatcctaatcaaaaaccccgggccttgcgtggcgatcgagttgccaccagacaactcggctcggctcgtcgtccaccgaccctcctcctcgctccaagtttccctctcccctcctcctccgtcagctggggagctagctagggagcggcgccggcgnctgatcgagcggacagacagctgaacgagccgaaaatgggcggcgggcgcgcgccgtggctcgccgccggnctcgtggcgntgctgatggtggtggccgcccgcgcgcggttcgtggtggaaaaaagcagcgtnggggtgctggcccccagcacatccgggccaccacgacgccgcatcgaaaacttcgggtgcccgactacggnggacgctcaccggggtcgtctctacacggacacaggcccacggggtggggacgacccgacgccaagttcaaggcaagtccccgcgccccgttatcctctggtcgaacggggaagaatgctacttcccgctcaaggggggaaacgcgcaacgcgcggccgcggcggcnnttnctaatccccaacaggggggaacaagcacttggttgagaaggaaaaccccg

SEQ ID NO: 21638 - protein, 112 aa, Zea mays
  misc_feature: Ceres CLONE 1390929-F
  misc_feature (16)..(16): Xaa is any aa, unknown, or other
  misc_feature (57)..(57): Xaa is any aa, unknown, or other
MGGGRAPWLAAGLVAXLMVVAARARFVVEKSSVGVLAPSTSGPPRRRIENFGCPTTXDAHRGRLYTDTGPRGGDDPTPSSRQVPAPRYPLVERGRMLLPAQGGKRATRGRGG

SEQ ID NO: 21639 - DNA, 715 bp, Zea mays
  misc_feature: Ceres CLONE 1390930-F
  misc_feature: Translation starting site: 235
  misc_feature: SWISSPROT Homolog: EC 3.6.3.14 H(+)-transporting two-sector ATPase
  misc_feature (258)..(258): n is a, c, t, g, unknown, or other
aagctggagctccccgcggtggcggccgctctataactagtggatcccccgggctgcaggaattcgcacgagaccattacctgaacatcctaatcgaaaaaaatttcgtcttcttccctctcccaccggtgtcctcgcctcgcctatccgatctgccacctcgccgtctcgcaggttcctttcccaactccccagcgcctctccgcgccgcgatccagatccaggttgttcagcatgggtctggtgaaggaggcgtcnacatggaggaggggaaccctagagatcggcatggagtacaggactgtatctggtggggccgggcctctggttatcttggataaaggaaaggggcccaaagtaccaagaaatgtaaacctcccgacttgaagatggcaccactcgccgtggtcaagtccttggagttgatggaaaaaaaagctgttgggaagggttttaaaggaactttctgaaataaacacaaatacccaaccgggcagtttaacgggggaggcctggggctaacgggaagagtttgtctcactgaaccccagaggggcacgggaaacaaaaacgcctctcccgaattttggagaaagaaagggtttgggcttgggtttaattccttccctaaaaacccccactcaggggggggagccctctggggaaggggggcccccccccatttttttaaggggttttccccttcctatcaccc

SEQ ID NO: 21640 - DNA, 725 bp, Zea mays
  misc_feature: Ceres CLONE 1390934-F
  misc_feature: Encodes the peptide sequence at SEQ ID NO. 21641
tccccgcggtggcggccgctctacaatagtggatcccccgggctgcaggaattcgcacgagaccattacctagaacatcctaatcgaaaaatcaatcttatcattgacacctactattctcctacaaagaaccctactgtaccaacgatgggagacaccctattttgcctccttatgctccttgtcccttctgcccgtggtgtgacggagaccattgtcccacgacgcctgcaacctcctatagattaccttcttcccctgcacctctcaccatgaggcgtctgccgtacgcgaaaacccaattcttcaagcctatactacccactagagaatcgcagctgtcatcttactctttatcgcccttgctcctcctatcattcatcagccctattacacaacataccttagtggcattgattgagacttgatatccctcaataacaactacatcatcttgccttagcaaaccattgctgcctactctcacaacagctttctcttccatgcaaccaagtaaatccattgaactctgcttcctatatgaaacgactactaccctatcgccagctatctgctgcctaaccacaaaaatctcttacattcaacctagtgacagctatgcactctcctgcttaatacgacaaaaaaactactaccattcattcagctacctgtggagaaccctgctaacctcttgagacaccacaatttgtgtccgtatacca

SEQ ID NO: 21641 - protein, 42 aa, Zea mays
  misc_feature: Ceres CLONE 1390934-F
MGDTLFCLLMLLVPSARGVTETIVPRRLQPPIDYLLPLHLSP

SEQ ID NO: 21642 - DNA, 733 bp, Zea mays
  misc_feature: Ceres CLONE 1390936-F
  misc_feature: Encodes the peptide sequence at SEQ ID NO. 21643
  misc_feature (461)..(461): n is a, c, t, g, unknown, or other
  misc_feature (490)..(490): n is a, c, t, g, unknown, or other
  misc_feature (523)..(523): n is a, c, t, g, unknown, or other
aagctggagctccccgcggtggcggccgctctagaatagtggatcccccgggctgcaggaattcgcacgagaccattacctagaacatcctaatcgaaaaagttctgattgggacgtctggagttggaagaacattcacaaaagaagttgttgaggccatggcttccttcaatgagaggcctatcatcttttcactgtcaaatccaacctctcattctgaatgtactgctgaagaagcatataactggactcagggtcgtgtaatatttgccagtggcagtccatttgaccctgtggagtacgatgggaaggtttttgtacctggacagtcgaacaacgcctacattttccctggatttggcctcggtcttgttatctctggagccatccgtgtccacgaggacatgcttcttgccgcctcggaagcactagctgctcaggccacacaggagaacttcgancagggatcaatcttccccgcccttcaccnaacatagaagatctctgcgcgcatggccgcagncgtggctgcaaagctaatgaactcggtttggcgacccgtctggcctccccagaggacctggtgaatatgcacagagctgcatgtacactcctgtctaccgtactaccggtagtgctgctgggatcatttctgcagaataaatatgtcgacgcaatgatcctgcatggttgagttattttttcatttggtggcctggtgctgaacactttg

SEQ ID NO: 21643 - protein, 112 aa, Zea mays
  misc_feature: Ceres CLONE 1390936-F
  misc_feature (1)..(113): Pfam Name: Malic_M Pfam Description: Malic enzyme, NAD binding domain
  misc_feature: SWISSPROT Homolog: EC 1.1.1.40 Malate dehydrogenase (oxaloacetate-decarboxylating) (NADP(+))
  misc_feature (101)..(101): Xaa is any aa, unknown, or other
  misc_feature (111)..(111): Xaa is any aa, unknown, or other
MASFNERPIIFSLSNPTSHSECTAEEAYNWTQGRVIFASGSPFDPVEYDGKVFVPGQSNNAYIFPGFGLGLVISGAIRVHEDMLLAASEALAAQATQENFXQGSIFPALHXT

SEQ ID NO: 21644 - DNA, 688 bp, Zea mays
  misc_feature: Ceres CLONE 1390938-F
  misc_feature: Encodes the peptide sequence at SEQ ID NO. 21645
  misc_feature (476)..(476): n is a, c, t, g, unknown, or other
cgctctagaactagtggatcccccgggctgcaggaattcgcacgagaccattacctagaacatcctaatcgaaaaagcgtgtcatcgccttcccctccccacaagccaaacgcgaataccacccccgtgacttcccgatctccggcgatggccgcgcggcgcctcggatcccccgcatctaggtggctgcgcccgtccgcgctgctcctcctggtcgcctctgctctcctctcggccccgtcgccggcccgggccctccggttcgacctcgagtccggccacaccaagtgcgtctccgacgagatcaaggtcaacgccatggccgtcggaaagtaccacatcgtcgggcccgaccccaactcacccgacgcccagctccccgagtcgcaccgcatctccctcagggtgacgtcgccgtacgggaacagcatgcactacgcggagaacgtgcagtcgggccacttcgccttcacggnggcggaggccgacgactacctggcctgcttctgggctcccgaccacaagccgccggtcaccatcgggttccgaggtcgactggaggagcggcgtctccggcaaggactatcccagcgtccgccaaaaagggcaaggccgaaatgatggaaattgcagctgaacaacctagagggaaactattaaaaatattcttggaagagaatgctttatc

SEQ ID NO: 21645 - protein, 157 aa, Zea mays
  misc_feature: Ceres CLONE 1390938-F
  misc_feature (76)..(137): Pfam Name: EMP24_GP25L Pfam Description: emp24/gp25L/p24 family/GOLD
  misc_feature (110)..(110): Xaa is any aa, unknown, or other
MAARRLGSPASRWLRPSALLLLVASALLSAPSPARALRFDLESGHTKCVSDEIKVNAMAVGKYHIVGPDPNSPDAQLPESHRISLRVTSPYGNSMHYAENVQSGHFAFTXAEADDYLACFWAPDHKPPVTIGFRGRLEERRLRQGLSQRPPKRARPK

SEQ ID NO: 21646 - DNA, 773 bp, Zea mays
  misc_feature: Ceres CLONE 1390939-F
  misc_feature (17)..(17): n is a, c, t, g, unknown, or other
  misc_feature (35)..(35): n is a, c, t, g, unknown, or other
  misc_feature (531)..(531): n is a, c, t, g, unknown, or other
accacttctctcatttnttttacagttaaaatatntgggcgtcttctccaaagtggagctccccgcggtggcggccgctctatactagtggatcccccgggctgcaggaattcgcacgagaccattgcctagaacatcctaatcgaaaaattttccgtacgccgtatttccccagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgtgggggcgcgcctctcctcgctcgcgggactgccccgcctcccggcgctccggcgcctctccctccccgacaaccgcctctcgggggccgccgccctcgccgccgtcgccgagggatgcggngccacgctgcgccaccctcgacctagggaacaaccggttcgcggaggtccaggagctcgcgcccctccccgggggcccgggtcgagtcgctcgaactgttccagtgccccggccacaagggccaaggggaacaggggatgaagtccttccccgctgattcccagcccccaggaacctccgatggcgctggagcctggaggccaaacgagcgttttgaagaaggatgaaccacgaccaccagg

SEQ ID NO: 21647 - DNA, 802 bp, Zea mays
  misc_feature: Ceres CLONE 1390941-F
  misc_feature: Encodes the peptide sequence at SEQ ID NO. 21648
aaagctggagctccccgcggtggcggccgctcttccaatagtggatcccccgggctgcaggtattcgcacgagaccattacctagaacatcctaatcgaaaaaagacgatctgcgaaacaaacactagtgcgtttgcgagagaaaccgagaaagagaagctacagagtcactgaccgaccgctatggcatcgaggcagaacacgcgtgaggcgcgcgccgaggccgacgcgcggcgcgccgtggaggagctggctcgggcgcgggacgagcacctcgagaagggggaggtgaacgcccgctcgggcgcggacgagatcgcgcgctcccgcgccgaccgcggtgccgccggtgtcggcggcatcctggaaagcgtgcaggagggccccaggtccttgccagggccgggggccgaactttcgggggcccccaggacccgacccggggacaaaaacccggaaaagggcccaccccggggtggaaaaactcggggaggacaggtaaaaccccggccaaaaaggcccggggagccaacaaaacggttttccggtaaaaacggccaaaaagggggggccccccccggaaaaaaggtgggtggaaaaacaagcacacgcccctgagaaaaaggggggggaaaacacctggcgcgtggtgggcaaaaagaaaaaagaaacacccgcgggggaccaacaaaaaaaaaatctcgggaagaacaaagaaacacccggcctccctccgaaaggggggtgagatacccccctaccccccaccccctctagaagatgcgagtggagcgcgcccacc

SEQ ID NO: 21648 - protein, 144 aa, Zea mays
  misc_feature: Ceres CLONE 1390941-F
MASRQNTREARAEADARRAVEELARARDEHLEKGEVNARSGADEIARSRADRGAAGVGGILESVQEGPRSLPGPGAELSGAPRTRPGDKNPEKGPPRGGKTRGGQVKPRPKRPGEPTKRFSGKNGQKGGAPPGKKVGGKTSTRP

SEQ ID NO: 21649 - DNA, 724 bp, Zea mays
  misc_feature: Ceres CLONE 1390943-F
  misc_feature: Encodes the peptide sequence at SEQ ID NO. 21650
tccccgcggtggcggccgctctattactagtggatcccccgggctgcaggaattcgcacgagaccattacctagaacatcctaatccaaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggctggcaggctaaagggctccacgctccttaccgaaggagtggtgacggatggatccgatgaatgggcaatctacggcgggaccggagagtttgctatggcgagaggtgtcgtcaaaagaaggtaccttgccgatagggacggcgccgggaacactgacgagctcagcatgcaggttttctgcccggtgtttggctcatcacagcaaccaaacaagcaggcacgtgctgtactgtatatatgtccgagagagagaaacagacagtagaatcctcatcagtagtataatcagc

SEQ ID NO: 21650 - protein, 186 aa, Zea mays
  misc_feature: Ceres CLONE 1390943-F
  misc_feature (7)..(161): Pfam Name: Dirigent Pfam Description: Dirigent-like protein
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGRLKGSTLLTEGVVTDGSDEWAIYGGTGEFAMARGVVKRRYLADRDGAGNTDELSMQVFCPVFGSSQQPNKQARAVLYICPRERNRQ

SEQ ID NO: 21651 - DNA, 704 bp, Zea mays
  misc_feature: Ceres CLONE 1390945-F
  misc_feature: Encodes the peptide sequence at SEQ ID NO. 21652
  misc_feature (502)..(502): n is a, c, t, g, unknown, or other
  misc_feature (634)..(634): n is a, c, t, g, unknown, or other
  misc_feature (645)..(645): n is a, c, t, g, unknown, or other
  misc_feature (646)..(646): n is a, c, t, g, unknown, or other
  misc_feature (704)..(704): n is a, c, t, g, unknown, or other
gctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgttcgccatcctggccggcgtgntgggcgcggcgtccaagctgggcggcgtgcaccacgtgcgcgcctggcgccacgacagcctgggcaccaacgccgcgtcgtcgctcatcgcctggggcatcacggcgctcgccttcgggctggcctgcaggnagatccacatnncgcgacaccgcggctggcgcctggcccgtgctgaagccttcgtcatcatcctcgcctn

SEQ ID NO: 21652 - protein, 129 aa, Zea mays
  misc_feature: Ceres CLONE 1390945-F
  misc_feature (14)..(129): Pfam Name: AWPM-19 Pfam Description: AWPM-19-like family
  misc_feature (63)..(63): Xaa is any aa, unknown, or other
  misc_feature (107)..(107): Xaa is any aa, unknown, or other
  misc_feature (110)..(110): Xaa is any aa, unknown, or other
  misc_feature (111)..(111): Xaa is any aa, unknown, or other
MAGIGRNMVAPLLVLNLIMYIIVIGFASWNLNHFINGQTNYPGVAGNGATFYFLVFAILAGVXGAASKLGGVHHVRAWRHDSLGTNAASSLIAWGITALAFGLACRXIHXXRHRGWRLARAEAFVIILA

SEQ ID NO: 21653 - DNA, 732 bp, Zea mays
  misc_feature: Ceres CLONE 1390947-F
  misc_feature: Encodes the peptide sequence at SEQ ID NO. 21654
  misc_feature (344)..(344): n is a, c, t, g, unknown, or other
  misc_feature (418)..(418): n is a, c, t, g, unknown, or other
  misc_feature (489)..(489): n is a, c, t, g, unknown, or other
  misc_feature (614)..(614): n is a, c, t, g, unknown, or other
aaagctggagctccccgcggtggcggccgctctagaactagtggatcccccgggctgcaggaattcgcacgagaccattacctagaacatcctaatcgaaaaatcccagatccacccctccccatctccatccgcggccatggcctccgccgacgccggcacttgcccgtgggatgccctcccgttgcacctccaggagcgaatcctctccctcctccccatcaccgaactacttcccgttgccgccgtgtcccgcgccttccaccgccttctgcgctccccgaccttccatgccctcctctccccgcatcgcctcgacgccttcttcctcctttccccacggntcgccgtccacccgctgtcccgccgcgtccgcactatgccccgcgtcgccgcgctctctcctccttctacccgntcgtctcctccccgtcccatcactccttttatcactgcgctcactccagttcctcccgcgatccccgacgnagcctaccctctatccgctatcgtcccatcgggcgggtcctccacctcctcacccttggtcgcgtcatcaccggggcaggcgggcggttctacaccctggaaacggggatccctccccaaggggncggtagaggggatctcccgttgcttccacgttcctggaaacgcgggggtttccggggaccgaaaaaactcttctccctcgccggggccccaaggggttttggtttttattccgggacg

SEQ ID NO: 21654 - protein, 197 aa, Zea mays
  misc_feature: Ceres CLONE 1390947-F
  misc_feature (9)..(56): Pfam Name: F-box Pfam Description: F-box domain
  misc_feature (69)..(69): Xaa is any aa, unknown, or other
  misc_feature (117)..(117): Xaa is any aa, unknown, or other
  misc_feature (159)..(159): Xaa is any aa, unknown, or other
MASADAGTCPWDALPLHLQERILSLLPITELLPVAAVSRAFHRLLRSPTFHALLSPHRLDAFFLLSPRXAVHPLSRRVRTMPRVAALSPPSTRSSPPRPITPFITALTPVPPAIPDXAYPLSAIVPSGGSSTSSPLVASSPGQAGGSTPWKRGSLPKGXVEGISRCFHVPGNAGVSGDRKNSSPSPGPQGVLVFIPG

SEQ ID NO: 21655 - DNA, 742 bp, Zea mays
  misc_feature: Ceres CLONE 1390948-F
  misc_feature: Encodes the peptide sequence at SEQ ID NO. 21656
  misc_feature (505)..(505): n is a, c, t, g, unknown, or other
  misc_feature (549)..(549): n is a, c, t, g, unknown, or other
  misc_feature (637)..(637): n is a, c, t, g, unknown, or other
aaactggagctccccgcggtggcggccgctctagaactagtggatcccccgggctgcaggaattcgcacgagaccattacctagaacatcctaatcgaaaaaaaattctattactagctgcaaaagggcgtgtttgagactagcggaccgaccttgaagttgaagttgaaaaggccggcctgcgcggcgatggatgtcaagtgccggcgtctggaggggaaggtggccatcgtgacggcgtccacgatggggatcggcctcgccatcgccgagcgcctcggtctggagggcgccgccgtcgtcatctcctcccgcaagcagaagaacgtgaacgaggcggtggaggggctcagggccaagggtatcaccgcggttggtgccgtctgccacgtctccgacgcacagcagcgcaagagcctcatcgagacggccgtcaagagctttgggcacatagatattcttgtctccaatgctgccgcaaatccttctgtagatagcatacttngaatgaaagagtctgttctcgataagttgtgggatattaacgtncaggcttctatccttcttttatcagatgctgctcctcacctacggaaggggtcatctgtgattattatttctccaattgctggttacnatccagaaacaggattgacaatgtatggtgtcacaagactgctctctttggtctcacgaggctcttgctggtgagatgggacccgatactcgtgttactgatagc

SEQ ID NO: 21656 - protein, 173 aa, Zea mays
  misc_feature: Ceres CLONE 1390948-F
  misc_feature (11)..(164): Pfam Name: adh_short Pfam Description: short chain dehydrogenase
  misc_feature: SWISSPROT Homolog: EC 1.1.1.184 Carbonyl reductase (NADPH)
  misc_feature (106)..(106): Xaa is any aa, unknown, or other
  misc_feature (150)..(150): Xaa is any aa, unknown, or other
MDVKCRRLEGKVAIVTASTMGIGLAIAERLGLEGAAVVISSRKQKNVNEAVEGLRAKGITAVGAVCHVSDAQQRKSLIETAVKSFGHIDILVSNAAANPSVDSILXMKESVLDKLWDINVQASILLLSDAAPHLRKGSSVIIISPIAGYXPETGLTMYGVTRLLSLVSRGSCW

SEQ ID NO: 21657 - DNA, 746 bp, Zea mays
  misc_feature: Ceres CLONE 1390950-F
  misc_feature: Encodes the peptide sequence at SEQ ID NO. 21658
  misc_feature (746)..(746): n is a, c, t, g, unknown, or other
aagctggagctccccgcggtggcggccgctctatactagtggatcccccgggctgcaggaattcgcacgagaccattacctagaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccgccgccgtgaagagccccctcgccgtggccgcgcccgccgccggcgacgccaagagcccgctcttctgccccaagccgcggcgccccgcggcgcccctgcggtgccaccagggcggcgacgccggcatggatctgctcgacctcctcctgtcaaagcacagtgtttagggtgatgaacagtgacacactgacacgctatatctgggggagaaaagaaggggaccgacacgtaggggggcgcctgtagggccaccgctgcggccataggactgtctggagggccgcactctaagccctcctctcccctattcctattccttggctaaggggcttacgggtgacctcctacgtcccggaagcggcagccctctaccgtgcccccctttgn

SEQ ID NO: 21658 - protein, 61 aa, Zea mays; identical to SEQ ID NO: 15488
  misc_feature: Ceres CLONE 1390950-F

SEQ ID NO: 21659 - DNA, 744 bp, Zea mays
  misc_feature: Ceres CLONE 1390951-F
  misc_feature: Encodes the peptide sequence at SEQ ID NO. 21660
  misc_feature (583)..(583): n is a, c, t, g, unknown, or other
  misc_feature (596)..(596): n is a, c, t, g, unknown, or other
  misc_feature (599)..(599): n is a, c, t, g, unknown, or other
  misc_feature (631)..(631): n is a, c, t, g, unknown, or other
  misc_feature (683)..(683): n is a, c, t, g, unknown, or other
aagctggagctccccgcggtggcggccgctctataactagtggatcccccgggctgcaggaattcgcacgagaccattacctagaacatcctaatcgaaaacagtgcaaacaagctcgctcgcaagcgcaacccacccacgtctacggtctaccacacgaagcatcgtagccagccagccagctaaacccacaccacacatggccgggatcgtggtggtgttcgacttcgacaagacgatcatcgacgtggacagcgacaactgggtggtggacagcctcggcctcaccgacctgttcgagcgcctcctccccaccacgccctggaacacgctcatggacacgatgatgggggagctgcacgcgcggggcaggacgctggccgaggtgaccgaggcgctcagggcggcgcccatcgacccgcgcgtgcccgccgccgtcagggccgcgcacgcgctcggctgcgacctgcgcgtgctcagcgacgccaacgccttcttcatccacaccgtcctggacccacacggcctgctcgcctgcttctcccaggtcaacaccaaccccagccgcgtcgacgcccacggncgactccgcatcnggncctggcacgacccgcgcgcgcgccgcacgggnttgcgggcgtcgcacctgcccgccaaacatgtgcaaagggcctcgtgctggnacgcatcctccgcgagcccgagggcgaagccgagaacgcatcctccgcgaaggcgccgtca

SEQ ID NO: 21660 - protein, 181 aa, Zea mays
  misc_feature: Ceres CLONE 1390951-F
  misc_feature (4)..(172): Pfam Name: Put_Phosphatase Pfam Description: Putative Phosphatase
  misc_feature: SWISSPROT Homolog: EC 3.1.3.74 Pyridoxal phosphatase
  misc_feature (133)..(133): Xaa is any aa, unknown, or other
  misc_feature (134)..(134): Xaa is any aa, unknown, or other
  misc_feature (162)..(162): Xaa is any aa, unknown, or other
MAGIVVVFDFDKTIIDVDSDNWVVDSLGLTDLFERLLPTTPWNTLMDTMMGELHARGRTLAEVTEALRAAPIDPRVPAAVRAAHALGCDLRVLSDANAFFIHTVLDPHGLLACFSQVNTNPSRVDAHGRLRIXXWHDPRARRTGLRASHLPAKHVQRASCWXASSASPRAKPRTHPPRRRR

SEQ ID NO: 21661 - DNA, 644 bp, Zea mays
  misc_feature: Ceres CLONE 1390955-F
  misc_feature: Encodes the peptide sequence at SEQ ID NO. 21662
  misc_feature (615)..(615): n is a, c, t, g, unknown, or other
  misc_feature (644)..(644): n is a, c, t, g, unknown, or other
tccccgcggtggcggccgctctataactagtggatcccccgggctgcaggaattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctaacgctcgccacagtgccaggcgctgcagcagcagtgctggcaccagatcaggcaggtggagccgctgcaccggtaccaagcgacatacggtgtgggtcctgcagtccttccctgcaacaacaagccgcaagggcgaagcttcccggcgcttgatgcncggcccaggaagcgcaacagctgacgggn

SEQ ID NO: 21662 - protein, 100 aa, Zea mays
  misc_feature: Ceres CLONE 1390955-F
MKVLIVALALLALAASAASSTSGGCGCQTPPFHLPPPFYMPPPFYLPPQQQPQPWQYPTQPPQLSPCQQFGSCGVGSVGSPFLGQCVEFLRHQCSPAATP

SEQ ID NO: 21663 - DNA, 696 bp, Zea mays
  misc_feature: Ceres CLONE 1390961-F
  misc_feature: Encodes the peptide sequence at SEQ ID NO. 21664
  misc_feature (647)..(647): n is a, c, t, g, unknown, or other
  misc_feature (659)..(659): n is a, c, t, g, unknown, or other
gctctagtactagtggatcccccgggctgcaggaattcgcacgagaccattacctagaacatcctaatcgaaaacttatcgttatggcttccgtcgctttgccggcgttcacctgccggagctcagcagatccgacgaaggaacttcgcgtctgcacgaaccgcacctgccgaaaacaaggctcattccaaatcctcgagacgctaacgtccctcgcacctccccaactccaagtcaatccctgcggctgcctcggccgatgcggctcgggtccgaacctcgtcgctctccctcaaggtctcttccttcgtcactgcgccacgccttctcgagctgctgaaatcttgttcagcctatgcggcgacggcagggaagcttcctcttcctccgccgtcgcagaggctctcgccgctttggcgctaaccaacaatgctctctctcagatcgaagctgagaacttcgaagaagcagagtcgcttctcacacaggctttagagatgaaaccatacggtggactgcatagaatcttcaaacacagagcagtggcgaaactaggaatgggttgatactctggggctcttgaagatatagccaagctctagcattagggtctaactattatgagccctacgtttgccaaggtgatngttacgttgcancaggtcaatatgatctcggcggagagtcatacttccg

SEQ ID NO: 21664 - protein, 160 aa, Zea mays
  misc_feature: Ceres CLONE 1390961-F
MASVALPAFTCRSSADPTKELRVCTNRTCRKQGSFQILETLTSLAPPQLQVNPCGCLGRCGSGPNLVALPQGLFLRHCATPSRAAEILFSLCGDGREASSSSAVAEALAALALTNNALSQIEAENFEEAESLLTQALEMKPYGGLHRIFKHRAVAKLGMG

SEQ ID NO: 21665 - DNA, 735 bp, Zea mays
  misc_feature: Ceres CLONE 1390965-F
  misc_feature: Encodes the peptide sequence at SEQ ID NO. 21666
  misc_feature (285)..(285): n is a, c, t, g, unknown, or other
  misc_feature (578)..(578): n is a, c, t, g, unknown, or other
aaagctggagctccccgcggtggcggccgctctataactagtggatcccccgggctgcaggaattcgcacgagaccatacctagaacatcctaatcgaaaaaactactccgtcactttgtttacaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggncgcccgatgggtgagcaggtgaagggcatgctccacgacaaggggccgacggcgtcgcaggcgctgacggtggtgacgctgttcccgctgggcgggctgctgctggtgctgtcggggctggcgctgacgccctccgtggtggggctggccgtggccacgcccgtgttcctgatcttcagccccgtgctcgtccccggcgcgctgctcatcgggacgggcgtcatggggttcctcacgtcgggcgcgctggggctcgggggcctgtcctcgctcacgtgcctcgccaacacggngcggaaggggtccagcgcaccccgtactacgtgaaggaagcccacccgaagaatgccggaggccgcggccaacccggtccacaagaccgcggagggaggccaggccatccagggcagggcgcagagagccgcccccgggtgaaggtgcaggtgcccg

SEQ ID NO: 21666 - protein, 135 aa, Zea mays
  misc_feature: Ceres CLONE 1390965-F
  misc_feature (44)..(136): Pfam Name: Oleosin Pfam Description: Oleosin
  misc_feature (125)..(125): Xaa is any aa, unknown, or other
MADRDRSGIYGGAHATYGQQQQQGGGGRPMGEQVKGMLHDKGPTASQALTVVTLFPLGGLLLVLSGLALTPSVVGLAVATPVFLIFSPVLVPGALLIGTGVMGFLTSGALGLGGLSSLTCLANTXRKGSSAPRTT

SEQ ID NO: 21667 - DNA, 720 bp, Zea mays
  misc_feature: Ceres CLONE 1390966-F
  misc_feature: Encodes the peptide sequence at SEQ ID NO. 21668
aaagttgggagtcccggcggggggggccgctctagaactagtggttcccccgggttgcaggaattcgcacgagaccattacctagaacatcctaatcgaaaaatcgcttgtttgctgctgcctttccctttccgccgcggcaaaagtgaggagcgcgcggccgagtaggtcgagacaaacccgccatagctccttcgcttaatcgcgtctcgtgctcctgtctcctgcgtatatgaacgcgtgattcgcgacggccggcgaggcgttcgctctccttctccatcccacgcgcgcgcagtctcataggccggatcggtgagctctcacatctcgtcggccgtggtgagacagagaccgaaggccgagttgaccgacgctccggaggaagatgtctagcggcacgcaccacaattgcaaggcgtgcaccaagacggtgtacccgatggaccatgtctccaccggcggcgcccgtcttccaccgctcctgcttccagtgccagcactgcaagcctaccctctcactgagcaactattcctcgttcgaaggactgccgccctgcacgacccacttcgacgacgtgtctcaggtagatcgtgagctacgacgcgagcttccaatcaaagtcacctgcacagattacttgcggaaaagttgctccctgaggtgaccaaatcaccaggaaacgatgcaagggaacttctcaggaacacaagaccagc

SEQ ID NO: 21668 - protein, 72 aa, Zea mays
  misc_feature: Ceres CLONE 1390966-F
MSPPAAPVFHRSCFQCQHCKPTLSLSNYSSFEGLPPCTTHFDDVSQVDRELRRELPIKVTCTDYLRKSCSLR

SEQ ID NO: 21669 - DNA, 713 bp, Zea mays
  misc_feature: Ceres CLONE 1390978-F
  misc_feature: Translation starting site: 321
  misc_feature (590)..(590): n is a, c, t, g, unknown, or other
  misc_feature (605)..(605): n is a, c, t, g, unknown, or other
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaaatctatcgccacccgcgtcccgtcctcctccatctgtaaccactccccgtcgtctctttcgcggtctcgcctcctgcagcctctcgcccagaaagggaaaccgcatctgctcccgtctcccgcctcggcgccgccgcctagtcgacctgagcccagagaggggggggcgtcgaggccgtcgggcgctcagatctggggcgggagtggcaagcgaaggacatgcagatgcacgtcggaggaggcgcggccgacagcccggaggcgacgcggccgagccgctacaagtcgcagaagcggcgggactggcacacgttcgggcagtacctgcgcaaccaccggccgccgctggagctggcgcggtgcagcggcgcgcacgtgctcgagttcctgcgctacctcgaccagttcggcaagaccaaggtcccacgcggcggggtgccccttcttcggcacccgtcgcggccggggccgtgcccggtgccgtgtggncccaagggtttgggnaancttcgaacggctcgtccgccgcctgcgcgccgctttcgaggagcacggggggccggcccgagggccaccccctcgggcgcgcgcgcgtgcggctctaacctccgg

SEQ ID NO: 21670 - DNA, 737 bp, Zea mays
  misc_feature: Ceres CLONE 1390982-F
  misc_feature: Encodes the peptide sequence at SEQ ID NO. 21671
  misc_feature (600)..(600): n is a, c, t, g, unknown, or other
ggagctccccgcggtggcggccgctctagaactagtggatcccccgggctgcaggaattcgcacgagaccattacctagaacatcctaatcgaaaaatcaacgacagccccagacaacactcaccgatagcaagtagcgccgccgacgtttcgagagcagagtatccaagctagccaagcgcgcacctcggtgacctagctagttcaggcgacgatatggcgtcaggtcaggaaagcaggaaggagctggaccgcaaggcccgcgagggcgagaccgtcgtccccggcgggaccggcggcaagagcgtcgaggcccaggagcacctcgccgaagggcgcagccgcggaggccagactcgcagggagcagctggggcagcaggggtacagcgagatggggaagaaaggcgttctgagcaccagggacgagtccggcggcgagcgcgcccgcagggagggcgtcagcatcgacgagtccaagtcaccaagtagtcctatcgcgtgcgtgcgtacgcagcgttcgtagctgtctgcgtagtgtactttgcccgaagctagtgctactctcctactttggagtagctgaatgagtataatgtanctagcagcatgcatggaggcgatcatacatacgtacgtacccaggtaccggggggggggatcatgtatgccttccagaagggtattctaacttaatccaggcacggtcgtcaagtcgccaaaatggcaggggtcccg

SEQ ID NO: 21671 - protein, 102 aa, Zea mays
  misc_feature: Ceres CLONE 1390982-F
  misc_feature (1)..(93): Pfam Name: LEA_5 Pfam Description: Small hydrophilic plant seed protein
MASGQESRKELDRKAREGETVVPGGTGGKSVEAQEHLAEGRSRGGQTRREQLGQQGYSEMGKKGVLSTRDESGGERARREGVSIDESKSPSSPIACVRTQRS

SEQ ID NO: 21672 - DNA, 688 bp, Zea mays
  misc_feature: Ceres CLONE 1390984-F
  misc_feature: Encodes the peptide sequence at SEQ ID NO. 21673
aagctggagctccccgcggtggcggccgctctagtactagtggatcccccgggctgcaggaattcgcacgagaccattacctagaacatcctaatcgaaaaaacctctgacgatcaccatcgccgctagcctccaccaccaacttcccatcgcctccccctcatctccccacactcctgacctcacctctccgaactgcagcacctcccctcccgccacccacacgtgctcccatggccgccaccgcgatctcagtccgcctccacccaaccgccgcgcgccatgtggcctccgcccgccgcgcccgcctcggggccgtccgcgcgcagtccgcgccggcggcggcggcggcggcgctgacgcaggacgacctcaagcggctggcggcggtgcgcgccgtcgagcaggtgaagagcgggatggtgctcgggctcgggacgggctccacggccgcctttcgcgtcgccgagatcggcgcgctcctgggcgcgggcaagctcgagaagatcgtcggcgtgcccacatccaagcgcaccttcgagcaggggcagtcgctcgggatcccgctcttcacgctcgaagaaaacccggtcatcgacctccgcatcaacggggccgacgaggtttacccctgactccaacttgggaaaggcggggtggtgctcctcttccggaaaaaatggttgag

SEQ ID NO: 21673 - protein, 133 aa, Zea mays
  misc_feature: Ceres CLONE 1390984-F
  misc_feature: SWISSPROT Homolog: EC 5.3.1.6 Ribose-5-phosphate isomerase
MAATAISVRLHPTAARHVASARRARLGAVRAQSAPAAAAAALTQDDLKRLAAVRAVEQVKSGMVLGLGTGSTAAFRVAEIGALLGAGKLEKIVGVPTSKRTFEQGQSLGIPLFTLEENPVIDLRINGADEVYP

SEQ ID NO: 21674 - DNA, 723 bp, Zea mays
  misc_feature: Ceres CLONE 1390986-F
  misc_feature (465)..(465): n is a, c, t, g, unknown, or other
  misc_feature (604)..(604): n is a, c, t, g, unknown, or other
  misc_feature (632)..(632): n is a, c, t, g, unknown, or other
  misc_feature (662)..(662): n is a, c, t, g, unknown, or other
  misc_feature (664)..(664): n is a, c, t, g, unknown, or other
  misc_feature (709)..(709): n is a, c, t, g, unknown, or other
aagctggagctccccgcggtggcggccgctctagaactagtggatcccccgggctgcaggaattcgcacgagaccattacctagaacatcctaatcgaaaaactgcgatgtggtcctctcctcctatcacctgacctccacacacacacacagacagacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcaggagggctctgaagcctccgtcgccagctccccgccgccccagccgccgccgtcggcctcctcctggtggcgcgacatgcagcacccggctgccctacgcgcgtggcctccgtcccccgcgncgaggtggccgcccccggtatcgatggcgccggcagcgacgcagcagcagcagcagcacgggcggccgggcgacgacgtcctccgacggtctctcggcctccaacgccaccgtagcgtcctttcacaaccactcccggntcgggctcagctggactcgcggtgaaanttgaggggccccccccccctttgccccccncncctccaaagagccactttctggaacaaggcctcatggccgcccgngggcaaaagttgaa

SEQ ID NO: 21675 - DNA, 757 bp, Zea mays
  misc_feature: Ceres CLONE 1390988-R
  misc_feature (475)..(475): n is a, c, t, g, unknown, or other
ccaattgggtaccgggccccccctcgaggtcgacggtatcgataagcttttttttttttttttttggagagacactttaccgatgtatggtattaaactgacatcctggcatgatacaacataaatcaacggagcaacgtaaactctccacgcaaggccacaagtcagacgatcaggaggggatagtcccatagctacatctacctccgatatccgaagctttaaacaccagcagaacacgtactatacttcgctgatgctacatgagaggcgcatgcgcagcgcggcgcaaccttatctgtcagcagtgtgccgcagatcatcagttccaagccaatccatcatcagttccggagaaaacgtcatggtcccctcgctgcccccatccctcaggtgctagctatggtcctcagactcatgtagatcgtcaatgcgatccctataccgatgattccgttatgcccaaaaagtacancaagcatggaatcaacaaaaacccaacgcaaccctgggagaaaccaagtttctgtgaccgaacctcccaaagttaatccctcaaaaccaaaagcccaggatttgagggcctggccccccgaaaaaaggaatcccctggaaaaaacttgaaaaccgggccccccccttgggaaaattccccccccaaaccctttaaaggccccccgccccggggaaaacccttccccaaaaaagtttctcccaaaaccggggaggggggggggaacactttttttttgttttt

SEQ ID NO: 21676 - DNA, 748 bp, Zea mays
  misc_feature: Ceres CLONE 1390991-F
  misc_feature: Encodes the peptide sequence at SEQ ID NO. 21677
  misc_feature (302)..(302): n is a, c, t, g, unknown, or other
  misc_feature (377)..(377): n is a, c, t, g, unknown, or other
  misc_feature (391)..(391): n is a, c, t, g, unknown, or other
  misc_feature (392)..(392): n is a, c, t, g, unknown, or other
  misc_feature (409)..(409): n is a, c, t, g, unknown, or other
  misc_feature (447)..(447): n is a, c, t, g, unknown, or other
  misc_feature (539)..(539): n is a, c, t, g, unknown, or other
  misc_feature (573)..(573): n is a, c, t, g, unknown, or other
  misc_feature (652)..(652): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
aaagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcnggacatcatcgagtgcggctacgtggaggagacgggcttcgtgtggctccggcagcgccgcagggtggacactanctcgcaagggcggnncgcacgtgtcctacggngccgaggtgtcggcggtggccgacaagggcccgctcangaagatcacgggcgtcagggcaggaaatgctgctgggggtcaccctccaggagatttgcgtcgacgacccggccactggtagcttcactggnaggcccttcgggggctgtcccgaatttccccgtngagggctccaaagccaaagacccggccccccggaaacccgggggtgcttcccaggggcggggagaaaaaaagagaaaantnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 21677 - protein, 159 aa, Zea mays
  misc_feature: Ceres CLONE 1390991-F
  misc_feature (43)..(43): Xaa is any aa, unknown, or other
  misc_feature (68)..(68): Xaa is any aa, unknown, or other
  misc_feature (73)..(73): Xaa is any aa, unknown, or other
  misc_feature (79)..(79): Xaa is any aa, unknown, or other
  misc_feature (91)..(91): Xaa is any aa, unknown, or other
  misc_feature (122)..(122): Xaa is any aa, unknown, or other
MTLTIPDEVRAKAEVYVGDAAGQEKTRLLLQETGLPSGLLPLXDIIECGYVEETGFVWLRQRRRVDTXSQGRXARVLRXRGVGGGRQGPAXEDHGRQGRKCCWGSPSRRFASTTRPLVASLXGPSGAVPNFPVEGSKAKDPAPRKPGGASQGRGEKKRK

SEQ ID NO: 21678 - DNA, 725 bp, Zea mays
  misc_feature: Ceres CLONE 1390992-F
  misc_feature: Encodes the peptide sequence at SEQ ID NO. 21679
  misc_feature (396)..(396): n is a, c, t, g, unknown, or other
  misc_feature (629)..(629): n is a, c, t, g, unknown, or other
  misc_feature (640)..(640): n is a, c, t, g, unknown, or other
  misc_feature (651)..(651): n is a, c, t, g, unknown, or other
  misc_feature (686)..(686): n is a, c, t, g, unknown, or other
aagctggagctccccgcggtggcggccgctctagaactagtggatcccccgggctgcaggaattcgcacgagaccattacctagaacatcctaatcgaaaaatggactctcctctaatggagcccctactagtgcccaacaaccacagtcccggtccggttgtcgccgccacgccgggagaacacggcggtgctgcggtcgacgagagcagcaccctcgtggatgctgccagtggcacggatgagagccacagggcactcgccgacgccgacgtgaagatgaacgacgatggcgacgtacaaggggacgagctgtccgcgtccgtgcagcgccggctggacgagagcagcgccgtggagggggaggatgaagaggaggagattggtgacgacgcgnaggccgacgacatggcggcgcgcatgggacggcgcctggcggcgctgcccgggaatgcgcatgagagcgagccgttcaccatcttccgcgtgggcgggcccatgcgcgaccgcaaccggcacctctacgagccgcagatgatctccatcgtggcctttcccacgtggcgccggccggcacctcgccgccatggaggagcacaagtggcggtacctccgcgacatctggccccnccccggcgggngcgacgcttgnctcgtacgcccgcgccggggggttgatggaggctncgcgcggcgccggtacgcggagcccgtgctgctgcccgg

SEQ ID NO: 21679 - protein, 224 aa, Zea mays
  misc_feature: Ceres CLONE 1390992-F
  misc_feature (132)..(132): Xaa is any aa, unknown, or other
  misc_feature (213)..(213): Xaa is any aa, unknown, or other
  misc_feature (217)..(217): Xaa is any aa, unknown, or other
AGAPRGGGRSRTSGSPGLQEFARDHYLEHPNRKMDSPLMEPLLVPNNHSPGPVVAATPGEHGGAAVDESSTLVDAASGTDESHRALADADVKMNDDGDVQGDELSASVQRRLDESSAVEGEDEEEEIGDDAXADDMAARMGRRLAALPGNAHESEPFTIFRVGGPMRDRNRHLYEPQMISIVAFPTWRRPAPRRHGGAQVAVPPRHLAPPRRXRRLXRTPAPGG

SEQ ID NO: 21680 - DNA, 715 bp, Zea mays
  misc_feature: Ceres CLONE 1390993-F
  misc_feature: Encodes the peptide sequence at SEQ ID NO. 21681
  misc_feature (418)..(418): n is a, c, t, g, unknown, or other
  misc_feature (421)..(421): n is a, c, t, g, unknown, or other
  misc_feature (422)..(422): n is a, c, t, g, unknown, or other
  misc_feature (426)..(426): n is a, c, t, g, unknown, or other
  misc_feature (494)..(494): n is a, c, t, g, unknown, or other
  misc_feature (495)..(495): n is a, c, t, g, unknown, or other
  misc_feature (500)..(500): n is a, c, t, g, unknown, or other
  misc_feature (528)..(528): n is a, c, t, g, unknown, or other
  misc_feature (536)..(536): n is a, c, t, g, unknown, or other
  misc_feature (608)..(608): n is a, c, t, g, unknown, or other
aaagctggagctccccgcggtggcggccgctctagaactagtggatcccccgggctgcaggaattcgcacgagaccattacctagaacatcctaatcgaaaaaggattagtttgaccccctccagtacgtccgcaccgcaaggcctctcgccgtccttggacattctccgtccgtcgcctttgcctggggcagataacaatatctgatatccctgggccttcgccgtccgggcccccctaccttctctcatccgtcctcacacaaagcagaagggggagggagttttaaggggaggagggggcggcaggaggagccattattatttcttcttccagcggcaattcctggccaccaccgggcgcgctatattactccgggttcgtggacaagcatgcagaggggcgtgtccttccctgncgnnatgncgaaggagtgcccgcccgccgagctctggctcccggacgagttcctggacgacgacttcttctccganngaganaaaggcggcggtcgcggccagagccagnagcgaccnagaaggaaagggatggacggcctctcgcaccgcgcggccggctcgtcgtcggggggggggaaaggggaccgnttcccctgcaaaagcgcaagtgttaccgggctcgccgcattcaattctgtgcggctgcattgtttccggggaggacagcccaacggggggggggtccaaggcaactc

SEQ ID NO: 21681 - protein, 107 aa, Zea mays
  misc_feature: Ceres CLONE 1390993-F
  misc_feature (9)..(9): Xaa is any aa, unknown, or other
  misc_feature (10)..(10): Xaa is any aa, unknown, or other
  misc_feature (12)..(12): Xaa is any aa, unknown, or other
  misc_feature (34)..(34): Xaa is any aa, unknown, or other
  misc_feature (35)..(35): Xaa is any aa, unknown, or other
  misc_feature (36)..(36): Xaa is any aa, unknown, or other
  misc_feature (46)..(46): Xaa is any aa, unknown, or other
MQRGVSFPXXMXKECPPAELWLPDEFLDDDFFSXXXKGGGRGQSQXRPRRKGMDGLSHRAAGSSSGGGKGDRFPCKSASVTGLAAFNSVRLHCFRGGQPNGGGVQGN

SEQ ID NO: 21682 - DNA, 737 bp, Zea mays
  misc_feature: Ceres CLONE 1390995-F
  misc_feature: Encodes the peptide sequence at SEQ ID NO. 21683
  misc_feature (257)..(257): n is a, c, t, g, unknown, or other
  misc_feature (272)..(272): n is a, c, t, g, unknown, or other
  misc_feature (386)..(386): n is a, c, t, g, unknown, or other
  misc_feature (387)..(387): n is a, c, t, g, unknown, or other
agagctggagctccccgcggtggcggccgctctagaatagtggatcccccgggctgcaggaattcgcacgagaccattacctagaacatcctaatcgaaaaatcatcacactcgaaacccaacagcttccttcctggcgatccaattaacggcttctcttctgagctcagcacgaacaatggccaccatcctcaccgtcgcaagcttcttcgcacttgtgtgcatctctcaacaagcgcgggctgcgaactacacgntcatgaaggacgcgntgcacgcgccgcggacgggcttctacgactacatcatagtcggcggcggcacggcgggctgcccgctggcgccaaccctgtcgccgcccgcggttgctgctgctggagcccggnnctcctccaacgaggacgcgcgcgtcctgacaatggcccacttctcggaagggttggagaaaacgtcgggggcttcccccctcaaaagggttcgtggccaaagaagggggaatcactccccccccgggggggtggggggggagaatttaaataaaacccttttttttccgggggcggggggggatataaataagggcccccggttggaaccccaagagaggggggggggccaaacgggggggggagaaaaaattttcctctccccccccgggtggggcccccggaaaaccccccgggggaaggtgcccctttaaaaaaacggtgttttcccaaaaaaacgggccccacaaa

SEQ ID NO: 21683 - protein, 173 aa, Zea mays
  misc_feature: Ceres CLONE 1390995-F
  misc_feature: SWISSPROT Homolog: EC 4.1.2.10 Mandelonitrile lyase
  misc_feature (27)..(27): Xaa is any aa, unknown, or other
  misc_feature (32)..(32): Xaa is any aa, unknown, or other
  misc_feature (70)..(70): Xaa is any aa, unknown, or other
MATILTVASFFALVCISQQARAANYTXMKDAXHAPRTGFYDYIIVGGGTAGCPLAPTLSPPAVAAAGARXSSNEDARVLTMAHFSEGLEKTSGASPLKRVRGQRRGNHSPPGGVGGENLNKTLFFPGAGGDINKGPRLEPQERGGGQTGGGEKIFLSPPGWGPRKTPRGKVPL

SEQ ID NO: 21684 - DNA, 719 bp, Zea mays
  misc_feature: Ceres CLONE 1390996-F
  misc_feature: Translation starting site: 484
  misc_feature (299)..(299): n is a, c, t, g, unknown, or other
  misc_feature (300)..(300): n is a, c, t, g, unknown, or other
  misc_feature (336)..(336): n is a, c, t, g, unknown, or other
  misc_feature (385)..(385): n is a, c, t, g, unknown, or other
  misc_feature (461)..(461): n is a, c, t, g, unknown, or other
aagctggagctccccgcggtggcggccgctctagaactagtggatcccccgggctgcaggaattcgcacgagaccattacctagaacatcctaatcgaaaaactggagccctataggctatagccaccaccgcactcgcctccctctctccctcccacactccaccacccgcgccgccgcctcctactccgccccggcccctctgatccgtaccgagcgccggccatggcgctcgccttcgacgagttcgggcgccccttcattatccctgcggagcaggagaagaagacgcgccttcnnggggcttgacgcgcagaaggccaacatcgcctcggncaaggccgtcgcgcggatcctccgcacgtcgctgggacccaagggcatnggacagatgctccagtcccccgacggcgacgtcatcatcacaaatgatggagcgaccatcctggagcagatggatngtgacaccagatagcaaagctgatggtggagctgtcccgtagtcaagactatgaaatcggggatggtaccaccggggtggtagtcatggcaggggctcttctcgagcagctgagaagcttctggagcgtggatcaccccatttaggtgctgaggctattagatggcgccaaggtacttttgaccactgaacataatcgaaaaagtttgagtcagtgagacaacattgacccctggtccaactggatgacactctttcc

SEQ ID NO: 21685 - DNA, 782 bp, Zea mays
  misc_feature: Ceres CLONE 1390998-F
  misc_feature: Encodes the peptide sequence at SEQ ID NO. 21686
  misc_feature (283)..(283): n is a, c, t, g, unknown, or other
  misc_feature (399)..(399): n is a, c, t, g, unknown, or other
aaagctggagctccccgcggtggcggccgctctagaactagtggatcccccgggctgcaggaattcgcacgagaccattacctagaacatcctaatcgaaaaatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacgncgcagtgaccgatctcgtcggtcaggtcctcgacctgaaagtccgtcgcacgggcagccggttcagtttcacagcaactgacgggaaggataagatgcaggggatgcttcccaccnactccgggtcgaagggtcggttctggcaacctgaaagaacttcgggcctcatcggaatcattcgaatacactgggaaaaggctcaagggaaaagatggaaaaggccttggttggcaatcaaatggaaagttggggggcaaggggcttgagacccaaaatcaagggggaggccaaaaaagagggggcccccaattggggtaaaaccctaaggggagaggggggggggggggacccccccccctcctttaaacccccccggggggggggggagctcggcgccccaaaattgggaaaaggagcggggggaaaaaagtgttctttggaaaccccctttttaggagagaaagaggggccctcttttttattcctctccaaccccacag

SEQ ID NO: 21686 - protein, 112 aa, Zea mays
  misc_feature: Ceres CLONE 1390998-F
  misc_feature (25)..(25): Xaa is any aa, unknown, or other
  misc_feature (64)..(64): Xaa is any aa, unknown, or other
MDAAKLVTPVAVSHILAHPSAGSDXAVTDLVGQVLDLKVRRTGSRFSFTATDGKDKMQGMLPTXSGSKGRFWQPERTSGLIGIIRIHWEKAQGKRWKRPWLAIKWKVGGQGA

SEQ ID NO: 21687 - DNA, 700 bp, Zea mays
  misc_feature: Ceres CLONE 1390999-F
  misc_feature: Encodes the peptide sequence at SEQ ID NO. 21688
  misc_feature (474)..(474): n is a, c, t, g, unknown, or other
  misc_feature (485)..(485): n is a, c, t, g, unknown, or other
aaagctggagctccccgcggtggcggccgctctagaactagtggatcccccgggctgcaggaattcgcacgagaccattacctagaacatcctaatcgaaaaatcacaattcactccactcatcttttctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctctccgtcgcttcagtcatggcaggatggcaccctgagggtctcaggtcgatgctagcactatgattcctagatgcangagctgctgancaccgggagaactggaggagtcctcccttcatatggaggaagttttggaaagtttgggtggaaagggccttccaagaaaaacttctggagaggatttttgggttaaaggggttaaaaagcccctctggaattttcgggaaaagggaatttttccccttttggaaggggggtttttggggtgtgttttctcaaaagaaaaaatttgggggaaaggg

SEQ ID NO: 21688 - protein, 90 aa, Zea mays
  misc_feature: Ceres CLONE 1390999-F
MDASGAGSKGKKGAAGRKAGGPRKKSVTRSVKAGLQFPVGRIGRYLKKGRYAQRVGTGAPVYLAAVLEYLSVASVMAGWHPEGLRSMLAL

SEQ ID NO: 21689 - DNA, 721 bp, Zea mays
  misc_feature: Ceres CLONE 1391001-F
  misc_feature: Encodes the peptide sequence at SEQ ID NO. 21690
  misc_feature (1)..(1): n is a, c, t, g, unknown, or other
  misc_feature (409)..(409): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (560)..(560): n is a, c, t, g, unknown, or other
  misc_feature (588)..(588): n is a, c, t, g, unknown, or other
  misc_feature (694)..(694): n is a, c, t, g, unknown, or other
naaagctggagctccccgcggtggcggccgctctagaactagtggatcccccgggctgcaggaattcgcacgagaccattacctagaacatcctaatcgaaaagatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacgggagtggcggcggaggcggcgctccctcgaccatcgcggccatcgtcacctcactcggcggaggccctgcagcggtggggatcgtgcggatctccggncccgatgccgtcgcccgtcgccgaccgcgttttccgcccagccgnnnaccaggaggggcgtcgacgccgtggcaaccgcgcagcccactttgttgagtacggactcgcgctcgacgcggacggagcgttatttgacgaggtttttgggggntgcaatgctcctccccgaggtctacacncgagagggatgttgttgaagcttcagtgccatgggcacgatctctgcttggcgcggcgggctcaaggcttgcttgggagctggagccagactgctggatcccgggnggttccaccttcggcatccccgaaagg

SEQ ID NO: 21690 - protein, 131 aa, Zea mays
  misc_feature: Ceres CLONE 1391001-F
  misc_feature (116)..(116): Xaa is any aa, unknown, or other
MARAAARLLPIFLPWRRPPPPCLLRRGFLNPSSPRTSARVDTLVLPGDERLPFPSPPRLPNQLRPDYGSGGGGGAPSTIAAIVTSLGGGPAAVGIVRISGPDAVARRRPRFPPSRXPGGASTPWQPRSPLC

SEQ ID NO: 21691 - DNA, 699 bp, Zea mays
  misc_feature: Ceres CLONE 1391002-F
  misc_feature: Encodes the peptide sequence at SEQ ID NO. 21692
  misc_feature (380)..(380): n is a, c, t, g, unknown, or other
  misc_feature (398)..(398): n is a, c, t, g, unknown, or other
  misc_feature (557)..(557): n is a, c, t, g, unknown, or other
aagctggagctccccgcggtggcggccgctctagaactagtggatcccccgggctgcaggaattcgcacgagaccattacctagaacatcctaatcaaaaagtactgggagtgggagggggaggcacaggcaccataacgcgcgcttcagttccggaggcctcaccgcctcacgcaggcacgcacatcacacaacgccagcgagaaagagctctcgtccgcaccacggcgcaaccaacggggagaagaggaagcagtgagctgtcccgcgcgtgcgcgccccgcctcccgcccgcccgtctgatgaggaagctctgcccgaacctcgagcgcgacgacgcgctggacacggtgctggaggtgcccatccccgaggaaggntcttcggggggggcgggngcctcccgcggctccaccaggtcgggtggcacaacgtcagggcttggatggggccccacgccccgacgggtccggcgcgggcgacccgggtccatgacccgcggggaggtggaggtcatggtggggggatcgggggcccctttatccccgtggcccggntacacggcaaaccaggggccctggtccgtgctctgggaagagggcaagggcaatccccctggggcggtcccccggcaaagacaattgggagaaaaaaaaaaagggggccccggggggggagggggcccctaaacaaaggaaa

SEQ ID NO: 21692 - protein, 128 aa, Zea mays
  misc_feature: Ceres CLONE 1391002-F
MRKLCPNLERDDALDTVLEVPIPEEGSSGGAGASRGSTRSGGTTSGLGWGPTPRRVRRGRPGSMTRGEVEVMVGGSGAPLSPWPGYTANQGPWSVLWEEGKGNPPGAVPRQRQLGEKKKGGPGGGGGP

SEQ ID NO: 21693 - DNA, 706 bp, Zea mays
  misc_feature: Ceres CLONE 1391003-F
  misc_feature: Encodes the peptide sequence at SEQ ID NO. 21694
aagctggagctccccgcggtggcggccgctctagaactagtggatcccccgggctgcaggaattcgcacgagaccattacctagaacatcctaatcgaaaaagcagcagcagcacagtcatccacactaacgaacgaactcttgctccgatcacgagctagctgaggtcgacgatggcggctgtgctgaacagcaggaagacggcgcaggcggtggtggccgtgctggtggcggcgccgctgctggcttcgtccacttcggcggcgatcacctgcgtgcaggtggagtcgtcgctggcgccgtgcatcccgaacgcgacggtcagggccagcgcgctccccgcgtcgtgctgcagcggcgtcaagagcctcaacagcgcggagcggaccagcgcgcaccgccgggcggcgtgccgctgcctcaagagcctcgccaacagcgtcaagagcgtcatacatggccaccgtcgccaccatccccaggaagtgcggcgtctccgtcgtattcccatcagcatgtccaccgactgcaacaagatcagctaagctacgacgaacaagctaataagcctaccgaacgtacacgaacgtcccgcgcgctgcacgagtgatgatgccagcgagaatatataaaagcgctgtatcgcagcagcgcatggtttattatcgatctatatatatactggactggacactctatatagagg

SEQ ID NO: 21694 - protein, 123 aa, Zea mays
  misc_feature: Ceres CLONE 1391003-F
  misc_feature (34)..(119): Pfam Name: Tryp_alpha_amyl Pfam Description: Protease inhibitor/seed storage/LTP family
MAAVLNSRKTAQAVVAVLVAAPLLASSTSAAITCVQVESSLAPCIPNATVRASALPASCCSGVKSLNSAERTSAHRRAACRCLKSLANSVKSVIHGHRRHHPQEVRRLRRIPISMSTDCNKIS

SEQ ID NO: 21695 - DNA, 617 bp, Zea mays
  misc_feature: Ceres CLONE 1391004-F
  misc_feature (266)..(266): n is a, c, t, g, unknown, or other
  misc_feature (299)..(299): n is a, c, t, g, unknown, or other
  misc_feature (300)..(300): n is a, c, t, g, unknown, or other
  misc_feature (382)..(382): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
aaagctggagtcctcgcggtggcggccgctctagaactagtggatcccccgggctgcaggaattcgcacgagaccattacctagaacatcctaatcgaaaagttgggtgccgtgcgagctccaagtacccctgtctccctcccgtcttgcgggcttgcctttgcctgttccatttccggctcctccagttggtagtgtcgtttcaatgcgagacgccgtccttcacgagcttgattgcccttgaaagcgaagttggtgttggtgtncgttgcccggtgaggaggaagagggggatatanntggctcccaacggaagaggcagcaggggaaggacgagcggctgctgaaggatcttctccgcttccttccccccgaaaagggnannnggaggggttgtgaaaaaaagataaaaaaaaaccccccccccctaaaaaactcaagggggggttttaaaaggggggcccccacccccctttttgggggagattctaaaagggggggggggaaaacaaaacaacaccgcggggggaaaaagggggggggtgttgttaaaaagggggggaaaaaacccccccaaaaaaaaaaaaaaaaagggggggggggggggagaacaaaac

SEQ ID NO: 21696 - DNA, 709 bp, Zea mays
  misc_feature: Ceres CLONE 1391005-F
  misc_feature: Encodes the peptide sequence at SEQ ID NO. 21697
  misc_feature (533)..(533): n is a, c, t, g, unknown, or other
  misc_feature (534)..(534): n is a, c, t, g, unknown, or other
  misc_feature (540)..(540): n is a, c, t, g, unknown, or other
  misc_feature (541)..(541): n is a, c, t, g, unknown, or other
aaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccgggccgccattcccggtggtggacctctcggtgacgcggcgcgaggacctagtcgagcaggtgaggcacgcggcccgggacggtgggcttcttctggctggtgaaacacggagtgccggaggagctgatggcggaatgcctccgcggggtggcagtcaggggggccccgcggggggggggannaaaaannccctttcctcaggggaccttgttggaagggggggtttcccctccaatttcaccttttcaagggtggttggcccgatgggggaacccttggttttgggggggggtccccaacccccccccgggggaggacgtgccggaccccccagggaactggatggtggggcacggt

SEQ ID NO: 21697 - protein, 187 aa, Zea mays
  misc_feature: Ceres CLONE 1391005-F
  misc_feature: SWISSPROT Homolog: EC 1.14.11.20 Desacetoxyvindoline 4-hydroxylase
  misc_feature (129)..(129): Xaa is any aa, unknown, or other
  misc_feature (131)..(131): Xaa is any aa, unknown, or other
  misc_feature (132)..(132): Xaa is any aa, unknown, or other
MAPTTATKDDSGYGDERRRELQAFDDTKLGVKGLVDSGVKSIPSIFHHPPEALSDIISPAPLPPSPPSGPPFPVVDLSVTRREDLVEQVRHAARDGGLLLAGETRSAGGADGGMPPRGGSQGGPAGGGXKXXLSSGDLVGRGGFPSNFTFSRVVGPMGEPLVLGGGPQPPPGGGRAGPPRELDGGAR

SEQ ID NO: 21698 - DNA, 707 bp, Zea mays
  misc_feature: Ceres CLONE 1391009-F
  misc_feature (345)..(345): n is a, c, t, g, unknown, or other
aagctggagctccccgcggtggcggccgctctagaactagtggatcccccgggctgcaggaattcgcacgagaccattacctagaacatcctaatcgaaaagtcctcttggctttctctttcccgctctcctcctcgcttgccccccgccagctcgatctccagggagtggactagtgcagggagggagggaagaaaggagtggtgcagctgtgagtgaagccgcctctcgtttccttgattgattggagccgagccgaaatgtgatgcgagagaggtgtgcaaattagcaccgttcgcaggacacaactgagcaatcctctgaggggcaaacaccccctttcangtagccatctctgaaggaacatacaggctttttcataagatagtcatggcagagttcaagatcggtaggctggatggccaaccaccaagggtcagaaatgtgcccattgccgtcaccccggaaggtatctggtgctgcccatcacaggccgcgcttcagaagacagcgaagagcccaaccagaaggcagggcctagaggggaacatcccctgcgccttcgaggcgtctcgggtcagaaggttccagcgttccttcagagagagaggacagtccactcctactaggtcagaaacattcagatggagaagggtgccctcaggaaatgctggtgctggccctgatcggccaaggtagtacttgcc

SEQ ID NO: 21699 - DNA, 756 bp, Zea mays
  misc_feature: Ceres CLONE 1391010-F
  misc_feature: Encodes the peptide sequence at SEQ ID NO. 21700
  misc_feature (407)..(407): n is a, c, t, g, unknown, or other
  misc_feature (411)..(411): n is a, c, t, g, unknown, or other
  misc_feature (474)..(474): n is a, c, t, g, unknown, or other
aaagctggagctccccgcggtggcggccgctctagaactagtggatcccccgggctgcaggaattcgcacgagaccattacctagaacatcctaatcgaaaaatctagtcgccgcccccgctcaccgattgtcctctgctgtggagcgagcaagcagcggcgaagcgatggaggaggagatcagaaaggagttccagagtaacggcttctccatcggaggagccggccccgaggacgccgcccagatcctctccacgctgctgacctactgcatcaactacaagatgagccccgcggatctcgtctcagactgggaggtctactacctcaataggcaattggatggcttaaagctcgaaagctcgtatcttgatggttgtctgtcacaccttcaaaatggaggtaangacngggatataaaagaagaagctaaccttcacatttactccagtaacgatggtgacatgctcttangcaattcacatgtagatgaggcagcattccatgacataccaggctatgaacaggaaagggcacctggaggatcatctatctctgaggtaactccctcgggcaggggcagaccatccttccgggaaaggggcaaaaaaaatcccgggtgggtattaccccttttggaaccggggaaattaattttcccccacggtttgtttccaggggtaaaaacccaattttgtggcgccgaaaaatggttaatccccccaatgggaaattttttaaagaggcccccctcct

SEQ ID NO: 21700 - protein, 196 aa, Zea mays
  misc_feature: Ceres CLONE 1391010-F
  misc_feature (80)..(80): Xaa is any aa, unknown, or other
  misc_feature (82)..(82): Xaa is any aa, unknown, or other
  misc_feature (103)..(103): Xaa is any aa, unknown, or other
MEEEIRKEFQSNGFSIGGAGPEDAAQILSTLLTYCINYKMSPADLVSDWEVYYLNRQLDGLKLESSYLDGCLSHLQNGGXDXDIKEEANLHIYSSNDGDMLLXNSHVDEAAFHDIPGYEQERAPGGSSISEVTPSGRGRPSFRERGKKNPGWVLPLLEPGKLIFPHGLFPGVKTQFCGAEKWLIPPMGNFLKRPPS

SEQ ID NO: 21701 - DNA, 743 bp, Zea mays
  misc_feature: Ceres CLONE 1391011-F
  misc_feature: Encodes the peptide sequence at SEQ ID NO. 21702
  misc_feature (381)..(381): n is a, c, t, g, unknown, or other
  misc_feature (382)..(382): n is a, c, t, g, unknown, or other
  misc_feature (519)..(519): n is a, c, t, g, unknown, or other
aaagctggagctccccgcggtggcggccgctctagaactagtggatcccccgggctgcaggaattcgcacgagaccattacctagaacatcctaatcgaaaaaaaataaaatccaattttctcagtctcgagcgcccgcgtccctcgccccgtcgcgactcgcgacttcgcgagtcgccccgtcccagcctcccagccgtcccggctccccgcgaccccgccctccggcagtccggcgcgggggctcctctccgatccggtgagccgaacgaggatcccaactccccgaagaaagcggccacagccagagccagggtggctcggctctcctctcacagactgcgccgcagcgcctagcgctcggctggcagccgctccggnncggtcgccccgcgcccccgcccctgctgcctacatcccgctgcagccagaagatctgcctccagcgaccgccctgcctgccccttgtggcttctggtggtctgcacaccagcacacgcacttgtccccaaacacggncggcggcgatgagtatctcagaagagctccccggcgaaagatctgacggtggagaggaggtcttcatccacgaggaggacatcatccacgagataaccatcgacgaagaagatctcccggaccgcgacgacaaagatgacgacgtcgtcaacggggatggttgattccgaagacgtcgatgattctacatacgcttttcagggccaccaagaggagtctttctt

SEQ ID NO: 21702 - protein, 51 aa, Zea mays
  misc_feature: Ceres CLONE 1391011-F
MSISEELPGERSDGGEEVFIHEEDIIHEITIDEEDLPDRDDKDDDVVNGDG

SEQ ID NO: 21703 - DNA, 761 bp, Zea mays
  misc_feature: Ceres CLONE 1391012-F
  misc_feature: Encodes the peptide sequence at SEQ ID NO. 21704
  misc_feature (531)..(531): n is a, c, t, g, unknown, or other
  misc_feature (572)..(572): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcaccatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggaccaaggagttcatggaagcccttggctgccggcgctgatgtgtccatgattggncagttcccgggcgtcggtttctactctgcctacctcgtcgnccgaatggagttgtcgtgaccaccaagcacaacgatgacgaggcagtacccgtgtgggagtcccaagcgggggcggggtcgttcacctggtactcgntgaccacgtcagggggaggcagctttggcagggggcactaaagatcacactggtccctacagggacgatcagctgggaggtacctttgaggg

SEQ ID NO: 21704 - protein, 114 aa, Zea mays
  misc_feature: Ceres CLONE 1391012-F
MASETETFAFQAEINQLLSLTINTFYSNKEIFLRELISNSSDALDKIRFESLTDKSKLDAQPELFIHLVPDKATNTLSIIDSGIGMTKSDLVNNLGTIARSGTKEFMEALGCRR

SEQ ID NO: 21705 - DNA, 723 bp, Zea mays
  misc_feature: Ceres CLONE 1391015-F
  misc_feature: Encodes the peptide sequence at SEQ ID NO. 21706
  misc_feature (401)..(401): n is a, c, t, g, unknown, or other
  misc_feature (407)..(407): n is a, c, t, g, unknown, or other
  misc_feature (467)..(467): n is a, c, t, g, unknown, or other
  misc_feature (486)..(486): n is a, c, t, g, unknown, or other
aaagctggagctccccgcggtggcggccgctctagaactagtggatcccccgggctgcaggaattcgcacgagaccattacctagaacatcctaatcgaaaaactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgcggaagggagtcttcctcgtcgagacatggnacacgnctccagctccaggggagtcatgggcgcactcaggggcgtctactttctccgaccctccgntaaacacgtccagaggctncgcagggacctcggcatgccgcgctccgccgaggacacctatttctctcaggatattggagggcccgaaaattcaaatactgttgacccggagaaaagggggtttggcgcaaggtcgggagtccatgtgaattttgggccttggccctacattttcctccaaaaaaaaaaaaccccgggttttgccccaagggggcccccccggggataggggttttgggaaaagcctttaaggttt

SEQ ID NO: 21706 - protein, 125 aa, Zea mays
  misc_feature: Ceres CLONE 1391015-F
  misc_feature (55)..(55): Xaa is any aa, unknown, or other
  misc_feature (57)..(57): Xaa is any aa, unknown, or other
  misc_feature (77)..(77): Xaa is any aa, unknown, or other
  misc_feature (83)..(83): Xaa is any aa, unknown, or other
MVLITLVRDYIDRMLHDIPGMKVLVLDPQTVGMVSVVYSQSDLLRKGVFLVETWXTXPAPGESWAHSGASTFSDPPXNTSRGXAGTSACRAPPRTPISLRILEGPKIQILLTRRKGGLAQGRESM

SEQ ID NO: 21707 - DNA, 739 bp, Zea mays
  misc_feature: Ceres CLONE 1391016-F
  misc_feature: Encodes the peptide sequence at SEQ ID NO. 21708
  misc_feature (456)..(456): n is a, c, t, g, unknown, or other
  misc_feature (509)..(509): n is a, c, t, g, unknown, or other
  misc_feature (527)..(527): n is a, c, t, g, unknown, or other
  misc_feature (544)..(544): n is a, c, t, g, unknown, or other
  misc_feature (583)..(583): n is a, c, t, g, unknown, or other
  misc_feature (597)..(597): n is a, c, t, g, unknown, or other
  misc_feature (662)..(662): n is a, c, t, g, unknown, or other
  misc_feature (680)..(680): n is a, c, t, g, unknown, or other
  misc_feature (681)..(681): n is a, c, t, g, unknown, or other
  misc_feature (721)..(721): n is a, c, t, g, unknown, or other
aaagctggagctccccgcggtggcggccgctctagaactagtggatcccccgggctgcaggaattcgcacgagaccattacctagaacatcctaatcgaaaagttcccctttccctcctgcgcacccgtcttctcctccccgcgtcaaaccccagcacaaaaagcaaccgcccgccgcctcctcgctcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaactacgtcaaggcgttccctctctacatgaacgcgctcgagtacttcaaaacccacctcaagtacgagaagaaccccaagatcaaggaggccatcaccgccnagttcaccgagtacctccgccgcgccgaggagatccgggcggtcctcgatggngggtggcgcagggctggncccccaacgggtgccgnacgcagctgtcgccacgcgccccaagacaggggcaaggnacggggacggaggncacgggaggggatgacctccgagcagtccaaggctgagggcgggggctcaactccgccatcatcnacgagagcccaacattanngtgggaacgacgttgcccggcctcgagagcgccaggcagnactgggcagagggccgtt

SEQ ID NO: 21708 - protein, 151 aa, Zea mays
  misc_feature: Ceres CLONE 1391016-F
  misc_feature (5)..(73): Pfam Name: MIT Pfam Description: MIT (microtubule interacting and transport) domain
  misc_feature: SWISSPROT Homolog: EC 2.7.11.1 Non-specific serine/threonine protein kinase
  misc_feature (58)..(58): Xaa is any aa, unknown, or other
  misc_feature (87)..(87): Xaa is any aa, unknown, or other
  misc_feature (100)..(100): Xaa is any aa, unknown, or other
  misc_feature (105)..(105): Xaa is any aa, unknown, or other
  misc_feature (132)..(132): Xaa is any aa, unknown, or other
  misc_feature (133)..(133): Xaa is any aa, unknown, or other
  misc_feature (146)..(146): Xaa is any aa, unknown, or other
MYSNFKEQAIEYVKQAVQEDNAGNYVKAFPLYMNALEYFKTHLKYEKNPKIKEAITAXFTEYLRRAEEIRAVLDGGWRRAGPPTGAXRSCRHAPQDRGKXRGRRXREGMTSEQSKAEGGGSTPPSSTRAQHXXGNDVARPRERQAXLGRGP

SEQ ID NO: 21709 - DNA, 735 bp, Zea mays
  misc_feature: Ceres CLONE 1391017-F
  misc_feature: Translation starting site: 248
  misc_feature: Pfam Name: GH3 Pfam Description: GH3 auxin-responsive promoter
  misc_feature (407)..(407): n is a, c, t, g, unknown, or other
  misc_feature (504)..(504): n is a, c, t, g, unknown, or other
  misc_feature (557)..(557): n is a, c, t, g, unknown, or other
  misc_feature (563)..(563): n is a, c, t, g, unknown, or other
  misc_feature (628)..(628): n is a, c, t, g, unknown, or other
  misc_feature (638)..(638): n is a, c, t, g, unknown, or other
  misc_feature (641)..(641): n is a, c, t, g, unknown, or other
  misc_feature (685)..(685): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
aaagctggagctccccgcggtggcggccgctctagaactagtggatcccccgggctgcaggaattcgcacgagaccattacctagaacatcctaaccgaaaaaacccaggcaacacagcaatcagcagaaaaacatctccttggccttccatccatatgatccatccctccaggctccagctaactccaaactaccctctggttcgactcgcgttcgcatcgcaagcagcagcgtaccatcgaggcaatggcggtgatggccgaagtagtgtcgaccaccggcgcggcgctccggagcccggccacgcagcagccggcggcggcgggcgcggcgaagggcaccgacgctgagaagctccagttcatcgaggacatgacctccaacgtggacgccgtgcaggagcgcngtgctgggggagatcctcgcccgcaacgcggacaccgagtacctctccagcagtgcggggcctcgcccggcgctacggaccgcgccaccttccgcgncaagggtgcccgatggcggacgtacgaggaacctgcagccgtacatccggcgnaatcgnccgacggcgacgctcgcccctttctggtcggggcaccgggtctccgaagtcctcacagctccggnacgtccgggnggngagcggaagctcatgcccaccatcgaggacgagctcaaccgcgncagctgctgtacagctccagagcggggnnnnnnnnnnnnnnnnnnnnnnn

SEQ ID NO: 21710 - DNA, 742 bp, Zea mays
  misc_feature: Ceres CLONE 1391018-F
  misc_feature: Encodes the peptide sequence at SEQ ID NO. 21711
  misc_feature (396)..(396): n is a, c, t, g, unknown, or other
  misc_feature (397)..(397): n is a, c, t, g, unknown, or other
  misc_feature (563)..(563): n is a, c, t, g, unknown, or other
  misc_feature (579)..(579): n is a, c, t, g, unknown, or other
  misc_feature (580)..(580): n is a, c, t, g, unknown, or other
  misc_feature (589)..(589): n is a, c, t, g, unknown, or other
  misc_feature (694)..(694): n is a, c, t, g, unknown, or other
  misc_feature (735)..(735): n is a, c, t, g, unknown, or other
aaagctggagctccccgcggtggcggccgctctagaactagtggatcccccgggctgcaggaattcgcacgagaccattacctagaacatcctaatcaaaaggtggttgacggccgcttacccgcaccggcgccatgcgcgcgcgcggctaggtggtcgaggtcaagccaaacgctgcccaccgcctctgcctctgcctcgcatatatcctcgcgcacgttctttgctcgtctcgcactcgcttccttcgacgactcatcgccgatcacaccaggctagctagcccacccacagtcgtagggccaggaccgatcggaggagctcggtttttcgaccaggaccgccgccgccacacccgaagaagccgacgatgcagacgacgacgtcctcggcggnnggcgtcgccgcgcccgcgcgcgcgggcgccgcagtccgtggtggccgagctggagggcgcgctgctccggagcgcggacacgttcccgtacttcatgctcgtggcgttcgaggcgtccgggctgccgcgcttcgcgctgctgctggcgctgtggccgctgctgcgnctgctggaggtggcgnncccgcgcgncctggcgctgcgcgccgccgcgttcgtggccaccgcgggcgtgccccgcccggagggggaggcaggccccgcgccgggctgccaagttcttggccggacaagtcntcccccgcgggtggggcggccttcgggagttgaaggggacncccgtct

SEQ ID NO: 21711 - protein, 83 aa, Zea mays
  misc_feature: Ceres CLONE 1391018-F
  misc_feature (30)..(30): Xaa is any aa, unknown, or other
  misc_feature (33)..(33): Xaa is any aa, unknown, or other
  misc_feature (68)..(68): Xaa is any aa, unknown, or other
  misc_feature (82)..(82): Xaa is any aa, unknown, or other
MLVAFEASGLPRFALLLALWPLLRLLEVAXPRXLALRAAAFVATAGVPRPEGEAGPAPGCQVLGRTSXPPRVGRPSGVEGDXR

SEQ ID NO: 21712 - DNA, 727 bp, Zea mays
  misc_feature: Ceres CLONE 1391020-F
  misc_feature: Encodes the peptide sequence at SEQ ID NO. 21713
  misc_feature (200)..(200): n is a, c, t, g, unknown, or other
  misc_feature (371)..(371): n is a, c, t, g, unknown, or other
  misc_feature (411)..(411): n is a, c, t, g, unknown, or other
  misc_feature (441)..(441): n is a, c, t, g, unknown, or other
  misc_feature (444)..(444): n is a, c, t, g, unknown, or other
  misc_feature (637)..(637): n is a, c, t, g, unknown, or other
aaagctggagctcaccgcggtggcggccgctctagaatagtggatcccccgggctgcaggaattcgcacgagaccattacctagaacatcctaatcgaaaaatctctactcgagtctctgcgaatccgttgccggtagcctctctgcggtgagagttccgctgccgcctgctggagatgatggacgacggaggaggaggnttgcagtcgcagggcgtcaacccggactgccccaacgccgccaaccccttcccacgctgcgccgcgtactgccccgtccccgccccggcccccaccaaagccgccgccgccgccgccgtgcgcagcaagccgtctccgcctcgtccgagggcaacggcggtggcagcgcanaaacggacagccaagcacggagacggcgctgcgcgtgtcnctcccgcctccgacgcggaggacgacgacnacnacggaggcgagagggaaggagtcgcggctgtcaacccgggctacccggggtctccgcctcgtccggggccgagggcgacccacgcggcgcagaacgggaccgcgcgccgcgacgagggttgaggagaaatgcaaaatcaccgtcgtcgacgaattcgagggacaccgcgaagagcgtcgaggaccacgggggncaggagcaaggaaggagaagtccaccggcgggggcaaggaaaagggcaaaccccccgtccccacccagggaaaagtgggggggaggcccc

SEQ ID NO: 21713 - protein, 129 aa, Zea mays
  misc_feature: Ceres CLONE 1391020-F
  misc_feature (65)..(65): Xaa is any aa, unknown, or other
  misc_feature (79)..(79): Xaa is any aa, unknown, or other
  misc_feature (89)..(89): Xaa is any aa, unknown, or other
  misc_feature (90)..(90): Xaa is any aa, unknown, or other
MMDDGGGGLQSQGVNPDCPNAANPFPRCAAYCPVPAPAPTKAAAAAAVRSKPSPPRPRATAVAAXKRTAKHGDGAARVXPASDAEDDDXXGGEREGVAAVNPGYPGSPPRPGPRATHAAQNGTARRDEG

SEQ ID NO: 21714 - DNA, 688 bp, Zea mays
  misc_feature: Ceres CLONE 1391022-F
  misc_feature: Encodes the peptide sequence at SEQ ID NO. 21715
  misc_feature (400)..(400): n is a, c, t, g, unknown, or other
  misc_feature (409)..(409): n is a, c, t, g, unknown, or other
  misc_feature (427)..(427): n is a, c, t, g, unknown, or other
  misc_feature (509)..(509): n is a, c, t, g, unknown, or other
  misc_feature (577)..(577): n is a, c, t, g, unknown, or other
  misc_feature (578)..(578): n is a, c, t, g, unknown, or other
aaagctggagctccccgcggtggcggccgctctagaactagtggatcccccgggctgcaggaattcgcacgagaccattacctagaacatcctaatcgaaaagtcggaagctcccttcatttctttcacctccgattcgattccttgtcccctcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggtcgccatccttctcgggtactgcggcgcggngtatcaggncatgcaaaagaatccggncgcgcgcaccatcgagggggacctcgagggagcgctctaccaggcgggcgccgtgcccgaaggcgaacggtccgcgccgcgncgttacgattgggcacgtgctgggcgcacggaaagggcgtcagcgccgcggcgcaggtggtggccggnngcttctacgtcgaccccgcggttttcatcaatcgcttgaacggccagttccggcccaaatccgcgcttacggttacggggggttaccactcatcaacggggaaaagtctg

SEQ ID NO: 21715 - protein, 135 aa, Zea mays
  misc_feature: Ceres CLONE 1391022-F
  misc_feature: SWISSPROT Homolog: EC 5.4.99.12 tRNA-pseudouridine synthase I
  misc_feature (64)..(64): Xaa is any aa, unknown, or other
  misc_feature (67)..(67): Xaa is any aa, unknown, or other
  misc_feature (73)..(73): Xaa is any aa, unknown, or other
  misc_feature (123)..(123): Xaa is any aa, unknown, or other
MAAASPPPSPPHAKRPKMSSSSDPEADAEPTSASAAVEGADPAQRRPRYKRRKVAILLGYCGAXYQXMQKNPXARTIEGDLEGALYQAGAVPEGERSAPRRYDWARAGRTERASAPRRRWWPXASTSTPRFSSIA

SEQ ID NO: 21716 - DNA, 714 bp, Zea mays
  misc_feature: Ceres CLONE 1391028-F
  misc_feature: Translation starting site: 201
  misc_feature: Pfam Name: HATPase_c Pfam Description: Histidine kinase-, DNA gyrase B-, and HSP90-like ATPase
aaagctggagctccccgcggtggcggccgctctagaactagtggatcccccgggctgcaggaattcgcacgagaccattacctagaacatcctaatcgaaaactctcgattcggaaaacctccaaccctagccgcgatccgacaacgcctccatccctagccgactgctgcaagcttcagagctcaagagtcagggcgccatggcgacagagacggagaccttcgcctttcaggctgagatcaaccagctgctctcactcatcatcaacaccttctattccaacaaggagatcttcctccgggagctcatttccaactcttccgatgcgttggacaaaatcaggttcgagagcctcactgacaagagcaagctcgatgcgcagccggagctgttcatccacattgtaccagacaagggcttcgaacactctctccatcatcgacagcggcatcggcatgaccaagtccgaccttgtcaacaacctcggtaccatcgccaggtcccggacaaaggagtcatggaagccctgctgctggcgctgatgtgtctatgattgggcagttcggtggcggtttctactctgcctacctcgtcgccgagagggtcctcgtgaccaccaagcataacgatgacgagcagtacgtgtgggaaatcccaagggggcggttcgttcactggtactcctgacacctcgtgaggagcaactttggcag

SEQ ID NO: 21717 - DNA, 715 bp, Zea mays
  misc_feature: Ceres CLONE 1391029-F
  misc_feature: Translation starting site: 218
  misc_feature: SWISSPROT Homolog: EC 5.2.1.8 Peptidylprolyl isomerase
  misc_feature (506)..(506): n is a, c, t, g, unknown, or other
  misc_feature (633)..(633): n is a, c, t, g, unknown, or other
agagctggagctccccgcggtggcggccgctctagaactagtggatcccccgggctgcaggaattcgcacgagaccattacctagaacatcctaatcgaaaaatatttcccccctcgtgctctctctcgaaccttcttccaaagcacccgaaccctagtgatctcggaaccctagccgcgcgcggatctcggcttttccccttcctccacgccagccatggacgaggacttcgagatgcctcccgccggcgccgatgagatgatgggcgacgacgagatgggcgacttcggcggcgacgagggccccgtgatgaaggtgggcgaggagaaagaggtcggcaaggaggggctcaagaagagctgctcagggagggcgagggctgggagactcccgaggtcggcgacgaggttgaagtgcattacacgggcacgctccttgatgggacaaaattcgactcaagccgggatcggtgagaaacccttcaagttcaagcttggaacaggtncagtggataagggttgggaatcagggaatcaagaacatggagaaaggagaaaatggtattttttaccattcctcccagaggtggcttatggaggatttgggtccccttccactatcccaccaatggnaacctggagtttgaggtaaagctgctttcatggaccagggcaaagaattttggaaagatggggggttaattcaagagaatct

SEQ ID NO: 21718 - DNA, 731 bp, Zea mays
  misc_feature: Ceres CLONE 1391030-F
  misc_feature: Encodes the peptide sequence at SEQ ID NO. 21719
  misc_feature (298)..(298): n is a, c, t, g, unknown, or other
  misc_feature (301)..(301): n is a, c, t, g, unknown, or other
  misc_feature (302)..(302): n is a, c, t, g, unknown, or other
  misc_feature (322)..(322): n is a, c, t, g, unknown, or other
  misc_feature (363)..(363): n is a, c, t, g, unknown, or other
  misc_feature (472)..(472): n is a, c, t, g, unknown, or other
  misc_feature (573)..(573): n is a, c, t, g, unknown, or other
aagctggagctccccgcggtggcggccgctctagaatagttgatcccccgggctgcaggaattcgcacgagaccattacctagaacatcctaatcgaaaaagttaagtctcgttcactgcctgtgctgctcagtgctctgctcacacatcctcgtcgccaatggcggctcccgtccgggccatcccgctcccgtcgcccgtcctgtacccccgcatgtccttatggggccgcagcagctgcagccggcgacgtgcccccggagttcgcgcagcagtggaggcggcggagggtgcttcncgnncgacggagcccgtggaggtnggtcgcgtaagcagccggaaagacgccgtcatcgacttctngctgggctcacgcacgctgtcctccacccccatccgcttctggacagtacatgtgatggataatttctaaagtcaggtaatacaaaaaggtcatggaactgatgcagtngtcaaagacttggaaccctccttatttcttcatccttgccccactgcgtttattcttgtttctagtgcaggacaggatgctgatcatattactggcatggnagtacttaggcgttgcaaatctgctgggaaactggctgcatcattatttttgagcccttctgcttcgagggacaaagaggcaagtagaggcatttatttgattgcaaactacaacatgtcaaacttcatattggtatggagctgatcattgttggaaa

SEQ ID NO: 21719 - protein, 90 aa, Zea mays
  misc_feature: Ceres CLONE 1391030-F
  misc_feature (48)..(48): Xaa is any aa, unknown, or other
  misc_feature (68)..(68): Xaa is any aa, unknown, or other
MAAPVRAIPLPSPVLYPRMSLWGRSSCSRRRAPGVRAAVEAAEGASRXTEPVEVGRVSSRKDAVIDFXLGSRTLSSTPIRFWTVHVMDNF

SEQ ID NO: 21720 - DNA, 728 bp, Zea mays
  misc_feature: Ceres CLONE 1391031-F
  misc_feature: Translation starting site: 237
  misc_feature: Pfam Name: tRNA-synt_2b Pfam Description: tRNA synthetase class II core domain (G, H, P, S and T)
  misc_feature: SWISSPROT Homolog: EC 6.1.1.14 Glycine--tRNA ligase
aagctggagctccccgcggtggcggccgctctagaatagtggatcccccgggctgcaggaattcgcacgagaccattacctagaacatcctaatcgaaaacgcttcccatctgatgctcgtgctccgccgcgtctccttcctcctctcgtcgccctcccctcgcgcgccgctcgcaaaactctcctgctgctacgcccgccccaaccctagcccgacagcgcggcagctcgtggatatggccgcgtcagtcccgtcgggcggtggggcgacgatgagccgcgacgcgttccgcgcggccgtgaccacacgctggagcgccgtctcttcttcgtggcctctttcaagatctacggcggcgtcgcggggctctacgactacggacccccaggttgcgctgtcaaagctaacgtccctcgcattctgggggcagcatttttgtattggaggaagggatgcttgaggtttactgtccatgtgtgacgccagaagttgtctttaaagcctctggacatgtggataaattacagacttaatgggtaaagatgaaaagaacggcaactgctaccggggggatcatttgctgagggacttctgaaggataacctggaaaagatcacccttggtcccagagatggcaaaagaaacaataaagtctttctatccgggataatcccactgaaaaacattgggggctaagaataggaagataaaaattgtgttccaaaac

SEQ ID NO: 21721 - DNA, 719 bp, Zea mays
  misc_feature: Ceres CLONE 1391032-F
  misc_feature: Translation starting site: 362
  misc_feature: SWISSPROT Homolog: EC 3.1.2.15 Ubiquitin thiolesterase
  misc_feature (338)..(338): n is a, c, t, g, unknown, or other
  misc_feature (557)..(557): n is a, c, t, g, unknown, or other
  misc_feature (719)..(719): n is a, c, t, g, unknown, or other
agagctggagctccccgcggtggcggccgctctagaactagtggatcccccgggctgcaggaattcgcacgagaccattacctagaacatcctaatcgaaaactttctcctccagcaagtaaaccccgtttccacaacgtcgccgcaccgccgtcatggcgaccgtaagtgtggaaatggcagaaggagctctttccaggaatagagattgacactagccagtctccgattgttttcaagactcagatgtacacactaactggtgggccacctgaacgccaaaaaattatggtgaaggcaggaatattgaaggacgatgcagattgctctactttggnagtgaaagatcgtccaaaagttgatgatgataggcacggctgatgatattgtgaaagctccggataaaggaccagagtttgttgacgatctaccagaacaagagcaagtgattgcactgcgtcacagtgctcgtctttataacctgtggaatacatgctatatgaattccacattgcgatgtctgcattctggttcagagctgaagtcagggtgatagntatttcagatgctgtaagaggtaactgcattgaccaggcttctcataatttgactggtgctactcgtaatacccttgggtgatcaggatcaaaggggttcgccctgttgcacctctacaattcttgcaaacactggcgaaaaaaatacccgcaatttgcgcn

SEQ ID NO: 21722 - DNA, 577 bp, Zea mays
  misc_feature: Ceres CLONE 1391036-F
  misc_feature: Translation starting site: 185
caccgcggtggcggccgctctagaactagtggatcccccgggctgcaggaattcgcacgagaccattacctagaacatcctaatcgaaaagctctcaaatatctctcaccacctctccccttagcttctccccacctttggtcaggcaggctcaggcaaagggggcggccaacaaggacgagcgatggcgaccaaggtcatctgcttccttgtgctcgcatccctgctcctcgccgtcgcctttcccgtgtctgctctgcggcagcaggtgaagaagggcggcggcggcggtggtggcggaggcagtgttagcggaagcggaggcggcaacctaatccctgggagtgctcgcccaagtgcgggtcgcggtgctccaagacgcagtacaggaaggcctgcctcaccttatgcaacaagtgctgcgccgtctgagcgccccatccttggacgcttctcctcccacctcaagaatcgggatcgttggggttgccaaaagggtgggaaaaatcaaactttttttccaacataggaaacgaaaggttggcttaaccccagcttgggaaaattttccctttcc

SEQ ID NO: 21723 - DNA, 615 bp, Zea mays
  misc_feature: Ceres CLONE 1391040-F
  misc_feature: Encodes the peptide sequence at SEQ ID NO. 21724
  misc_feature (449)..(449): n is a, c, t, g, unknown, or other
  misc_feature (516)..(516): n is a, c, t, g, unknown, or other
  misc_feature (517)..(517): n is a, c, t, g, unknown, or other
  misc_feature (527)..(527): n is a, c, t, g, unknown, or other
  misc_feature (609)..(609): n is a, c, t, g, unknown, or other
aaagctggagctccccgcggtggcggccgctctagaactagtggatcccccgggctgcaggaattcgcacgagaccattacctagaacatcctaatcgaaaaacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactggttcccctctgacttcaccttcggtgccgccacttcagcgtaccaaattgaaggtgcttgnaatgaagatggaaagggggaaagcaactgggatcacttctggcacaatcatccggaaaagatactgnnacggagcaantcagacattggagcgaattcgtaccatatgtacaaaacggacgtcatatggctcaaggaaatgggcatgaacgcatataggntctcta

SEQ ID NO: 21724 - protein, 87 aa, Zea mays
  misc_feature: Ceres CLONE 1391040-F
  misc_feature: SWISSPROT Homolog: EC 3.2.1.21 Beta-glucosidase
  misc_feature (32)..(32): Xaa is any aa, unknown, or other
  misc_feature (55)..(55): Xaa is any aa, unknown, or other
  misc_feature (58)..(58): Xaa is any aa, unknown, or other
  misc_feature (86)..(86): Xaa is any aa, unknown, or other
MLSPSEIPQRDWFPSDFTFGAATSAYQIEGAXNEDGKGESNWDHFWHNHPEKILXRSXSDIGANSYHMYKTDVIWLKEMGMNAYRXS

SEQ ID NO: 21725 - DNA, 654 bp, Zea mays
  misc_feature: Ceres CLONE 1391043-F
  misc_feature: Encodes the peptide sequence at SEQ ID NO. 21726
aaagtggagctcaccgcggtggcggccgctctagaactagtggatcccccgggctgcaggaattcgcacgagaccattacctagaacatcctaatcgaaaacttgcaagcaagcagctgctctcgtgtgacatctagtcgtcgccagtcagtcacctctccagcctccagcaccaaccatccaccaccgagctagcagctgtctgctcgcctcccccacctaggctaggactaggagccaccaaactctgccccgccatgccgggcctcgccgcctcaggcaactcgcccccggcggcggcgccggccccgcgccgtctctcgtcgccgatgcccctgcgggcgccaccgtccccatcgcccttggtgttcatgtgcgccaaggcgtgccccatgctcgccctcaccgaggtctccttgcacctccgggcatgtagctcccttgctccagtcctctcagctctttgccatgaagacagtaaaattctctctgtgttgcactcgatggggatctcatccaaaccactccaccgctgcccgatacctgttgcggatgatccaaatgttgttgtcataccaaagaggactcccaacacaattgtgaagaagttgccatatataactgttgacaaacaggataaagatccctcaccgc

SEQ ID NO: 21726 - protein, 108 aa, Zea mays
  misc_feature: Ceres CLONE 1391043-F
MPLRAPPSPSPLVFMCAKACPMLALTEVSLHLRACSSLAPVLSALCHEDSKILSVLHSMGISSKPLHRCPIPVADDPNVVVIPKRTPNTIVKKLPYITVDKQDKDPSP

SEQ ID NO: 21727 - DNA, 662 bp, Zea mays
  misc_feature: Ceres CLONE 1391044-F
  misc_feature: Encodes the peptide sequence at SEQ ID NO. 21728
  misc_feature (26)..(26): n is a, c, t, g, unknown, or other
  misc_feature (404)..(404): n is a, c, t, g, unknown, or other
  misc_feature (405)..(405): n is a, c, t, g, unknown, or other
  misc_feature (415)..(415): n is a, c, t, g, unknown, or other
aagctggagctccccgcggtggcggncgctcttttcataaggatcccccgggctgcaggaattcccacgagaccattacctagaacatcctaatcgaaaacttcctcgtgccgacgaccgggcgaccgccgcgccccggcccgcgcccccttgtctcgggccactcgccggcaacgagcagccaccaggaaatgttgtgaggactgatgcaataactaagcttgctggatggacggatgtgattgcatcgagccactatggcctaccgatgatctccttgtcaagtatcagtacatctcagacttcttcatagccctcgcgtacttctctattccgttggagctcatatatttcgtgaaagagtcgtcctttcttccgtacagatgggtcttgatccagtttgnntgcgttatangtctctgtggggccacccatctgataaacctgtggacgtccacacacatacaaagacgttgcgatggtcatgaccatagcaaaggtttctacagaattggggccctggccactgctttgaagcttggccaaccatcccgacttttgggcgggaaactaaaaagtgttccgaaaaaaaaattaaaaaacttgccaaaaaatggccttaaaagcccccaggggaccccgaaaacttttaaagtcgttca

SEQ ID NO: 21728 - protein, 144 aa, Zea mays
  misc_feature: Ceres CLONE 1391044-F
  misc_feature: SWISSPROT Homolog: EC 2.7.13.3 Histidine kinase
  misc_feature: Functional homolog of the protein sequence given in SEQ ID NO 96878
  misc_feature: Useful for making plants with modulated biotic stress sensitivity
  misc_feature: The sequence is a functional homolog of SEQ ID NO 6 in US patent 7105654
  misc_feature (59)..(59): Xaa is any aa, unknown, or other
  misc_feature (63)..(63): Xaa is any aa, unknown, or other
MDGCDCIEPLWPTDDLLVKYQYISDFFIALAYFSIPLELIYFVKESSFLPYRWVLIQFXCVIXLCGATHLINLWTSTHIQRRCDGHDHSKGFYRIGALATALKLGQPSRLLGGKLKSVPKKKLKNLPKNGLKSPQGTPKTFKVV

SEQ ID NO: 21729 - DNA, 647 bp, Zea mays
  misc_feature: Ceres CLONE 1391071-F
  misc_feature: Encodes the peptide sequence at SEQ ID NO. 21730
  misc_feature (335)..(335): n is a, c, t, g, unknown, or other
  misc_feature (336)..(336): n is a, c, t, g, unknown, or other
  misc_feature (366)..(366): n is a, c, t, g, unknown, or other
  misc_feature (403)..(403): n is a, c, t, g, unknown, or other
  misc_feature (449)..(449): n is a, c, t, g, unknown, or other
aaactggagctccccgcggtggcggccgctctagaactagtggatcccccgggctgcaggaattcgcacgagaccattacctagaacatcctaatcgaaaaacgcacctcccgacttctccggttctcccttcttcatagcagccacccacgcatctcagcgccgaggcgagcgaggacctcgtggttcgtgccctgctcacctcgtgaggatgtggatcgcgagccggctcttcctcgcggcggcggcgctgctgatggctgtgcttctgctcgtcgcggggcccggtgggcggcgcaggacgcggcggtggagggcgtggccccgcctgcggnnagagatcgcgcgaacgcgagggccaagggnagcgtggttctggccgccgagctagtgcagctcaggncgaagatctccgcgttagagtctcgcattgcagagcagaacctggnagttcagaccagaatgatggcatcgaaaccctgaatatgaatgtcaaggaaaagccccagaagattgctaccattgcaaatgaaagcaaaagggtctttaacttgcaagggaacaggcaagcaaaggccaatggacttgggttattgagcttcaaaaaagccaccccagaaagcctccggaaaggttatttcccgaaa

SEQ ID NO: 21730 - protein, 54 aa, Zea mays
  misc_feature: Ceres CLONE 1391071-F
MNVKEKPQKIATIANESKRVFNLQGNRQAKANGLGLLSFKKATPESLRKGYFPK

SEQ ID NO: 21731 - DNA, 690 bp, Zea mays
  misc_feature: Ceres CLONE 1391081-F
  misc_feature: Encodes the peptide sequence at SEQ ID NO. 21732
  misc_feature (435)..(435): n is a, c, t, g, unknown, or other
  misc_feature (508)..(508): n is a, c, t, g, unknown, or other
aaactggagctccccgcggtggcggccgctctagaactagtggatcccccgggctgcaggaattcgcacgagaccattacctagaacatcctaatcgaaaaattacttactggtcctcactcccacaccaaccaaccaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggntcagcactgcagcagcagtagaggagcccatcacgccgtcagtccatgtgaactacacaaagctcctcataantgccaaactttgttgatccggcatccgggaagaacctccccaattctgaacccctcgaaaaagggaagggaattcgctcagtgggcttgaaggtgaaccccaaagaaattaaacccgggcaataaactcgcgccccccaaagtttttttgaagaaagggccagggcccaaaaaacaccgccc

SEQ ID NO: 21732 - protein, 78 aa, Zea mays
  misc_feature: Ceres CLONE 1391081-F
  misc_feature (50)..(50): Xaa is any aa, unknown, or other
  misc_feature (74)..(74): Xaa is any aa, unknown, or other
MARRAASSLVSRCLLARAPAGAPPAAPSALRRTVPADGMHRLLPGVLQRXSTAAAVEEPITPSVHVNYTKLLIXAKLC

SEQ ID NO: 21733 - DNA, 679 bp, Zea mays
  misc_feature: Ceres CLONE 1391085-F
  misc_feature (390)..(390): n is a, c, t, g, unknown, or other
aaagctggagctcaccgcggtggcggccgctctagaactagtggatcccccgggctgcaggaattcgcacgagaccattacctagaacatcctaatcaaaaaattctcttgccctacttggcaacgtctctccttgtttggctccgtccgtcgcacgcatcctgcaacagcaaactcccccagataaatttaagcaggccgggcccggcgacgaccagctccgttccgcgcgaagatttaaacgcgcgaagcgagaaagcacgcatcaggcggcagcgacaagcaacgaacgcgatcgcgcgccgacgacgacgcgcggtgcctgcgcctggtggtgccgtgttgcggactccgctgcatcgtctcggtcggtcgtcgtcgttatcatgnatgtccggctgtcgagtgggtgttccaccgtcctcgtcctcctcgtgcggacgagcgtggcgcgatagtaaacgtccatcttcaatttcggagaactcctggtggacgccggcaaccctggggggggacggaattctggaaatatctgcccacggcgacccctggccgaaggccatggacccactttcggaaacccccacccggccggcttgataccaaaaggacggctttcctctttaacaattataatcatgtccaagagagcggcccaaaaatcttacctacaaag

SEQ ID NO: 21734 - DNA, 631 bp, Zea mays
  misc_feature: Ceres CLONE 1391086-F
  misc_feature: Encodes the peptide sequence at SEQ ID NO. 21735
  misc_feature (541)..(541): n is a, c, t, g, unknown, or other
  misc_feature (553)..(553): n is a, c, t, g, unknown, or other
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaacactactctggtcgtcctcgcgccgccgcagcagcagcagcgacgcgaccgccggtaatggcttccaccgttgtgctccggaacgccggctcccgccgactcttctgctactccactctccgcgccgccgcaatattgggacccgccgcgccacctgatgcgcgccgcggcggcgtcggcccagccgccaccgatggcaggaaccctctgggcgaggtccatggccactttcacgcgcacgaagccacatgtgaacgtcggcaccattggggcacgtcgatcacggcaaaaccacactcactgctgccattaccaaggttctggcagagggcagggaaggccaaagcaattgctttttgacgagatcgacagggccccggaagagagagccagaggaatcaccattgcaacagctcatgtcgagtatgagacggctaanaggattatgctncatgttgattgtcaggtcacgcagattatgtcaagaactgatcactggagtgtcaaaaggatggnggtaattcttgcc

SEQ ID NO: 21735 - protein, 124 aa, Zea mays
  misc_feature: Ceres CLONE 1391086-F
  misc_feature (94)..(94): Xaa is any aa, unknown, or other
  misc_feature (120)..(120): Xaa is any aa, unknown, or other
MRAAAASAQPPPMAGTLWARSMATFTRTKPHVNVGTIGARRSRQNHTHCCHYQGSGRGQGRPKQLLFDEIDRAPEERARGITIATAHVEYETAXRIMLHVDCQVTQIMSRTDHWSVKRMXVILA

SEQ ID NO: 21736 - DNA, 664 bp, Zea mays
  misc_feature: Ceres CLONE 1391087-F
  misc_feature: Encodes the peptide sequence at SEQ ID NO. 21737
  misc_feature (390)..(390): n is a, c, t, g, unknown, or other
  misc_feature (391)..(391): n is a, c, t, g, unknown, or other
  misc_feature (430)..(430): n is a, c, t, g, unknown, or other
aagctggagctccccgcggtggcggccgctctagaactagtggatcccccgggctgcaggaattcgcacgagaccattacctagaacatcctaatcaaaaaacgctcccgtccgaggtttcgcgtgcggccatgctcgtccgcatcaacaccctcctccagggctactccggcatccgcttcgagatcctcgaggccatcaccaagctcatcaacaccggcgtcagcccgtgcctgccgctgcggggcaccatcaccgcgtcgggcgacctcgtcccgctgtcctacatcgccggcctcatcacggggcgtcccaacgcgcaggccgtcacggttgacggcaggaaggtggacgccgccgaggcgttcaagggggcgggcatcgaaggcnncttcttcaagctcacccccaaggaggggctggccatcgncaacggcacggccgggggggcggcgctccgccgccatggtgtggtttcaacgccgagcccctccccctccctggtccgagggtgggggccgccggtcttctggcggggggagtgaacggccgggcgcggagtaccggacccgtgtgtccgccggccctcgcgcgcccccggggggcgcgcccggcggccccgcgcctctgtgggaggcgccgccccgaatggggcggggctctt

SEQ ID NO: 21737 - protein, 180 aa, Zea mays
  misc_feature: Ceres CLONE 1391087-F
  misc_feature (1)..(179): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature (130)..(130): Xaa is any aa, unknown, or other
  misc_feature (143)..(143): Xaa is any aa, unknown, or other
AGAPRGGGRSRTSGSPGLQEFARDHYLEHPNQKTLPSEVSRAAMLVRINTLLQGYSGIRFEILEAITKLINTGVSPCLPLRGTITASGDLVPLSYIAGLITGRPNAQAVTVDGRKVDAAEAFKGAGIEGXFFKLTPKEGLAIXNGTAGGAALRRHGVVSTPSPSPSLVRGWGPPVFWRGE

SEQ ID NO: 21738 - DNA, 682 bp, Zea mays
  misc_feature: Ceres CLONE 1391088-F
  misc_feature: Encodes the peptide sequence at SEQ ID NO. 21739
  misc_feature (319)..(319): n is a, c, t, g, unknown, or other
  misc_feature (327)..(327): n is a, c, t, g, unknown, or other
  misc_feature (387)..(387): n is a, c, t, g, unknown, or other
  misc_feature (390)..(390): n is a, c, t, g, unknown, or other
  misc_feature (682)..(682): n is a, c, t, g, unknown, or other
tggagctccccgcggtggcggccgctctagaactagtggatcccccgggctgcaggaattcgcacgagaccattacctagaacatcctaatcgaaaacccaatctcctctccatcgaaaccctagcacgacgcaattcccgtcttcccacgccgtgtcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcaggnggcaggcnggcgaggatgtataggaaatcgagggaggtgcaggtcccaggagggaagtgggaagtggnaanatgaaagaagaaaggcgagagcgatccagggcttcgatccagggcgctggctggaattcggttcccccaagaaccagcttcgtcgaagctgtttacgcgaccgctgccatcggctcacgggagacggtggtaaccaacattcccgggggcgggggccgacgcccgacccggggttcaggggggaagatctttggaacacgggcctccggttgggaacaccaaaaaccggacacccttcaccggaggccctttgggcccaataggggggggataggaggattcccaggggccn

SEQ ID NO: 21739 - protein, 161 aa, Zea mays
  misc_feature: Ceres CLONE 1391088-F
  misc_feature (51)..(51): Xaa is any aa, unknown, or other
  misc_feature (54)..(54): Xaa is any aa, unknown, or other
  misc_feature (74)..(74): Xaa is any aa, unknown, or other
  misc_feature (75)..(75): Xaa is any aa, unknown, or other
MGKKRKLEPKSAAGFTPVKASPTTRSATAKAAGLSEVLAPVEATMEKLPQXAGXRGCIGNRGRCRSQEGSGKWXXERRKARAIQGFDPGRWLEFGSPKNQLRRSCLRDRCHRLTGDGGNQHSRGRGPTPDPGFRGEDLWNTGLRLGTPKTGHPSPEALWAQ

SEQ ID NO: 21740 - DNA, 635 bp, Zea mays
  misc_feature: Ceres CLONE 1391092-F
  misc_feature: Encodes the peptide sequence at SEQ ID NO. 21741
  misc_feature (381)..(381): n is a, c, t, g, unknown, or other
  misc_feature (396)..(396): n is a, c, t, g, unknown, or other
  misc_feature (397)..(397): n is a, c, t, g, unknown, or other
  misc_feature (422)..(422): n is a, c, t, g, unknown, or other
  misc_feature (461)..(461): n is a, c, t, g, unknown, or other
  misc_feature (465)..(465): n is a, c, t, g, unknown, or other
  misc_feature (467)..(467): n is a, c, t, g, unknown, or other
  misc_feature (478)..(478): n is a, c, t, g, unknown, or other
  misc_feature (564)..(564): n is a, c, t, g, unknown, or other
tggagctcaccgcggtggcggccgctctagaactagtggatcccccgggctgcaggaattcgcacgagaccattacctagaacatcctaatcgaaaaacttccaccccggaccgacaaagcagagcacgcgctggcagccaagtgcacacagacacgtctctctgttcgttctcagcttgctatagcaacctctagtaggtagccatggagatggtcctggactggcgctcgctgggctccctgctggcgaccgtcgtggtgttccgcaccgcgctgcgtaacttcctgccgccggaggccgagatgctcctgcgccgcttcctcgcgtgggtcgccgccgcgttccgcccgcccagcgacaccatcctcatcgacgaggncggacgggcccacgnnggagcgccaacgacctctacgagtncgcgcagctctacctcagcgcgcgctgcctcgcacggcngccngncgtggcgctgnacaagccgggccagtcgccgcggccccggtggggtccctcccggattcgaaaccaacgagacaccttttccggggggtccggggtncagtggactctcaacacgggaaacgttaaacgtaggggaaaggggggggggggaaaacccgtaaacctttt

SEQ ID NO: 21741 - protein, 140 aa, Zea mays
  misc_feature: Ceres CLONE 1391092-F
  misc_feature (59)..(59): Xaa is any aa, unknown, or other
  misc_feature (64)..(64): Xaa is any aa, unknown, or other
  misc_feature (73)..(73): Xaa is any aa, unknown, or other
  misc_feature (86)..(86): Xaa is any aa, unknown, or other
  misc_feature (87)..(87): Xaa is any aa, unknown, or other
  misc_feature (88)..(88): Xaa is any aa, unknown, or other
  misc_feature (91)..(91): Xaa is any aa, unknown, or other
  misc_feature (120)..(120): Xaa is any aa, unknown, or other
MEMVLDWRSLGSLLATVVVFRTALRNFLPPEAEMLLRRFLAWVAAAFRPPSDTILIDEXGRAHXGAPTTSTSXRSSTSARAASHGXXXWRXTSRASRRGPGGVPPGFETNETPFPGGPGXSGLSTRETLNVGERGGGENP

SEQ ID NO: 21742 - DNA, 657 bp, Zea mays
  misc_feature: Ceres CLONE 1391093-F
  misc_feature: Encodes the peptide sequence at SEQ ID NO. 21743
  misc_feature (404)..(404): n is a, c, t, g, unknown, or other
  misc_feature (508)..(508): n is a, c, t, g, unknown, or other
  misc_feature (531)..(531): n is a, c, t, g, unknown, or other
tccccgcggtggcggccgctctagaactagtggatcccccgggctgcaggaattcgcacgagaccattacctagaacatcctaatcgaaaaatcaataaaaaccctagcagatccacccgtcacccgaagcttcctcctcgcagcgcgccgcgcgtcgtcgcctctacccaccggacttcgcgcgccacgacgaggctgtgagtcatcaggccatcacccacccacccccccgccacgcagatctagggagcttaccctcccaccgggcggtcattcttccgtcccatcaccgatgcggacgccggcgatgctccggtgggccgcgacgatcgcaggactgctcgctgtcaccgcgacggccgtcgggttctacctctccggtgatggaccagagcgattacgncgaaggctgatcctgcttcagtgaaggtgaataggatgacatctatcaggactcaactcccgaatacatatctattcccttccgttctgcaaggcagataccantaggcgacagtggcgagattccnttgtcgaggtactcccgtcggcgagtcgcattgagaactcctccttatgtgttcaaaaatgggaaagcccaagatggtgccaaatcgcttgcagagcaccgatcactgaaaaagaagccaaggagt

SEQ ID NO: 21743 - protein, 44 aa, Zea mays
  misc_feature: Ceres CLONE 1391093-F
MRTPAMLRWAATIAGLLAVTATAVGFYLSGDGPERLRRRLILLQ

SEQ ID NO: 21744 - DNA, 665 bp, Zea mays
  misc_feature: Ceres CLONE 1391098-F
  misc_feature: Encodes the peptide sequence at SEQ ID NO. 21745
  misc_feature (218)..(218): n is a, c, t, g, unknown, or other
  misc_feature (310)..(310): n is a, c, t, g, unknown, or other
tggagctccccgcggtggcggccgctctagaactagtggatcccccgggctgcaggaattcgcacgagaccattacctagaacatcctaatcgaaaaccatccatccatccagttagttagttagtaagttagttgagggagaagaagcaggggaggggaagcgatgagcaacatgctgcgggctcgccgccgcctggacctcctgcaggtggtgctncttcgccgctgggctcctcgtcgtcgtcgccgacgccggcgtgacgagccagtaccggcggaagctggaggcgacggtggagatgccatggnacgccgacgtcttccgcgtcccgccggggtacaatgccccgcagcagtgcacatcacgctgggtgaccaggagggcacgtcgatgatcgtgtcgtgggtgacggccaatgagctgggcagcagcaccgtcatgtacagcgaggcgtcgccgaacccggagaagatggagctcccggccggaggcacccacacgcgctacgactacttcaactacacctccggcttcatccaccactgccaccctcacaaacctcaagcatagcaccagtactataaccgccattgggggtttcggccacacgggggagggagcttctgcttcaccacgcccacccatggcgggggcccctgaggg

SEQ ID NO: 21745 - protein, 59 aa, Zea mays
  misc_feature: Ceres CLONE 1391098-F
  misc_feature: SWISSPROT Homolog: EC 3.1.3.2 Acid phosphatase
MIVSWVTANELGSSTVMYSEASPNPEKMELPAGGTHTRYDYFNYTSGFIHHCHPHKPQA

SEQ ID NO: 21746 - DNA, 659 bp, Zea mays
  misc_feature: Ceres CLONE 1391099-F
  misc_feature: Translation starting site: 475
  misc_feature: Pfam Name: Mlo Pfam Description: Mlo family
  misc_feature (297)..(297): n is a, c, t, g, unknown, or other
aaagctggagctccccgcggtggcggccgctctagaactagtggatcccccgggctgcaggaattcgcacgagaccattacctagaacatcctaatcaaaaactttaaaatggacgcgcacctccacctgggtctgtctgcgcaggtacgcggacgcgacgacaccgggaagcaattgtctcatctgctccactccatctccatttaacgcactctccactccttcgagtcgggggtttaggcgcacggcgtaaggccaattaacgccgctgcgacgagcgccgagaggtaatcggncgttgacgccacgagggcgctggaccagacgacgaacgtgggcgagaccgacgtctgcgctgtcatcgtcagcgcgatcatactcctcgagggcttcctccaccactcggtcagttgctcaataagaagcgaaagaacgcgctgtctgacgctctgcagaatgttaaatccgagctgatgactctgatgctcatatcgctgctgctgaagtggaggggaaagtacatcgtaggaatctgtatcctcgaggcagccacaaaaccatgctgccctgcccgctgtccggtcactcggggggagaaaaaccccaaggacccatgtccaacttaactaattttaaagaaccaacaaactttttttcc

SEQ ID NO: 21747 - DNA, 655 bp, Zea mays
  misc_feature: Ceres CLONE 1391103-F
  misc_feature: Encodes the peptide sequence at SEQ ID NO. 21748
  misc_feature (516)..(516): n is a, c, t, g, unknown, or other
  misc_feature (564)..(564): n is a, c, t, g, unknown, or other
  misc_feature (615)..(615): n is a, c, t, g, unknown, or other
ccccgcggtggcggccgctctagaactagtggatcccccgggctgcaggaattcgcacgagaccattacctagaacatcctaatcgaaaaacatcgatcagtcgcgtgtctaggtttcctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcanctgcaacgaggtgatggccagcaagagcaagatatacttcgccatggnagtacggtcccggggcggcgagctcttcgcccgcgtcggcccgcggcgggnttcaaggaggacgcccgcgaagaaagtacttccaccagct

SEQ ID NO: 21748 - protein, 120 aa, Zea mays
  misc_feature: Ceres CLONE 1391103-F
  misc_feature: SWISSPROT Homolog: EC 2.7.11.1 Non-specific serine/threonine protein kinase
  misc_feature (74)..(74): Xaa is any aa, unknown, or other
MEKKPTILMNRYELGRTLGQGTFAKVYHGRNLASGESVAIKVIDKEKVMRVGMIDQIKREISVMRLVRHPNVVXLQRGDGQQEQDILRHGSTVPGRRALRPRRPAAGFKEDAREESTSTS

SEQ ID NO: 21749 - DNA, 656 bp, Zea mays
  misc_feature: Ceres CLONE 1391105-F
  misc_feature: Encodes the peptide sequence at SEQ ID NO. 21750
  misc_feature (552)..(552): n is a, c, t, g, unknown, or other
  misc_feature (583)..(583): n is a, c, t, g, unknown, or other
tggagctccccgcggtggcggccgctctagaactagtggatcccccgggctgcaggaattcgcacgagaccattacctagaacatcctaatcgaaccaatctcctctccctccctccctccttccccgccgccgtctaccagtacagctcgagcgaacgacgtctcgacagtcccgggccgctgagaacttgccgcgggagggagagcagcagcggcagcatcagacatgtcgtcggggcggtacatggcctactcgccctcgccgtcgaccaccccccactccccccgcatcgccggcctccgcgccccgtctgccgccatggccgaacaggagaagtaccttgccgaactgctcgcggagaggcagaagcttggcgcgttcgtcccagtgatcccgcatagtgtacgcttgctgaatcagaaattttacgtgtttccacactattggagaacgcatcccttttaaatcaaagtggactgaaacatgctagtccactagcaacaggaggattatattcaaatggagcagctactgacatggagtgtggtgnacatcagcatttcaaccagaaagctcacagncttatagctggggctggaaggatcccagggcagctccctctggacttattgtcagaaaaacaatgaagggtcg

SEQ ID NO: 21750 - protein, 79 aa, Zea mays
  misc_feature: Ceres CLONE 1391105-F
MSSGRYMAYSPSPSTTPHSPRIAGLRAPSAAMAEQEKYLAELLAERQKLGAFVPVIPHSVRLLNQKFYVFPHYWRTHPF

SEQ ID NO: 21751 - DNA, 662 bp, Zea mays
  misc_feature: Ceres CLONE 1391106-F
  misc_feature: Translation starting site: 138
aaagctggagctccccgcggtggcggccgctctagaactagtggatcccccgggctgcaggaattcgcacgagaccattacctagaacatcctaatcgaaaaagcctgcctcggtgcgccgacgccacacctccaccatggctgcaaccacaccggccaccgaaccgacagatgccttgcttgcaggaacaaatgatgctcccactcctgctcgtcccaccccggcgaagctggtagaccgcgccgtcgcccccgacaaggccgtcttcctctgcccgcctcccgtacgagaggcacccaaggaggaggtcaaagccgccggcggcgtgcccgtcgtaaagagtggacaagaagtccaagcgccagctcaagcgagagcggtagtaggaacaaaaatctacttctcacctttgtatcgaagtagggaaaagtgcaaatgtggactcatgcaaatatggtacttcatggcgtttcatccatgacataaatgcttatttgactactaaaccagctgagcttgaaggcacatgcccatttactgcactgctacatttgtgtccatatgaactatcttgtcgatcccttagtacacttgaagataaccttgctcctcagaatcatccagagggaaagtgtgagagaaatcctttgagcaaagacat

SEQ ID NO: 21752 - DNA, 669 bp, Zea mays
  misc_feature: Ceres CLONE 1391110-F
  misc_feature (264)..(264): n is a, c, t, g, unknown, or other
  misc_feature (267)..(267): n is a, c, t, g, unknown, or other
  misc_feature (284)..(284): n is a, c, t, g, unknown, or other
  misc_feature (285)..(285): n is a, c, t, g, unknown, or other
  misc_feature (287)..(287): n is a, c, t, g, unknown, or other
  misc_feature (334)..(334): n is a, c, t, g, unknown, or other
tggagctccccgcggtggcggccgctctagaactagtggatcccccgggctgcaggaattcgcacgagaccattacctaagaacatcctaaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcgncgncgctggctgcatgtggnngncgtcggtgctcaagaaacggggggtggcgacggcctcccggcggggncttcgggtttggccggggggggggaaactggtccaggggatcctggaggaacggcccttatggaaggggggcggggactcccggagaaagtacggggccatctttaccttgggggggggggccagggaccctccattgggggccccctcggggggggttcatccaccagggggggtgggggaaaaagggcccctcgtttcccgggacggcccccagagaaaagcccccccccccctctctttttggggggggggaagggggacccctaaaatcggggggccctaaaggccccccggggggggggtgttttttcgcggaaaaatttttgtgggagg

SEQ ID NO: 21753 - DNA, 647 bp, Zea mays
  misc_feature: Ceres CLONE 1391111-F
  misc_feature: Encodes the peptide sequence at SEQ ID NO. 21754
  misc_feature (386)..(386): n is a, c, t, g, unknown, or other
  misc_feature (453)..(453): n is a, c, t, g, unknown, or other
  misc_feature (585)..(585): n is a, c, t, g, unknown, or other
tggagctccccgcggtggcggccgctctagaactagtggatcccccgggctgcaggaattcgcacgagaccattacctagaacatcctaatcgaaaaggtgatagttctgattcccaggcaaggaaccctcttatcccttctcgtctcctgtcccgggaccggggaggccgggatcgagaaggggaacgagcgcgtcccgtgctcgccactcctcgccgatggcgtcctccactctgccagcctcccccttccgtatgtctcttcccggactacgagccccggaccctgctaaggttaagcacgtatccgttcgaacccccgctcgccgtcttcccgttgcagcctccgcggcaccatcaggcgccgcggcggcggcggcgagggnagcgcaggcgtttcctggagcgctacgggctcaaccccaaacgacttcgaggaagatgcagaggatnaatccgagggtctactccaattattctgaacttattcgtaatgcttgtcgctggcgaattgggtgtgattttgagtgggatgctttctcttttcattttttgcaggaggagagaaaggacaggcggaggcgnaggcagttcggggagaggggagcaaactgcggaagcggagtgactccagggaaggtggagga

SEQ ID NO: 21754 - protein, 142 aa, Zea mays
  misc_feature: Ceres CLONE 1391111-F
  misc_feature (56)..(56): Xaa is any aa, unknown, or other
  misc_feature (78)..(78): Xaa is any aa, unknown, or other
MASSTLPASPFRMSLPGLRAPDPAKVKHVSVRTPARRLPVAASAAPSGAAAAAARXAQAFPGALRAQPQTTSRKMQRXNPRVYSNYSELIRNACRWRIGCDFEWDAFSFHFLQEERKDRRRRRQFGERGANCGSGVTPGKVE

SEQ ID NO: 21755 - DNA, 672 bp, Zea mays
  misc_feature: Ceres CLONE 1391113-F
  misc_feature: Encodes the peptide sequence at SEQ ID NO. 21756
  misc_feature (410)..(410): n is a, c, t, g, unknown, or other
  misc_feature (440)..(440): n is a, c, t, g, unknown, or other
  misc_feature (469)..(469): n is a, c, t, g, unknown, or other
tggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtgggtgggcgtcggtgctcaagaaccggggggttgtcgacggccctcccgccggggccctccgggttggggcgggtggtgggggaacctggttccaggtgatcgctgcagcgacggcccttcattgtacgntggtgcgcgacctcccggggaagaagtacngggcccatcttcacccatgggcggatggnggcagcgcacccctcatcgtggtccacctcggcggagctcatccacgaggcgctgggtgaagcagggccccatgttcgcgagccggcccgaggacagccccacccgcctcctcttcagcgtcggcaagtgcaccgtcaactcggcgcctacggcccccctgtggcgtgctctgcgccgcactccgtcgccgagatcgtgtccc

SEQ ID NO: 21756 - protein, 149 aa, Zea mays
  misc_feature: Ceres CLONE 1391113-F
  misc_feature (62)..(62): Xaa is any aa, unknown, or other
  misc_feature (72)..(72): Xaa is any aa, unknown, or other
  misc_feature (82)..(82): Xaa is any aa, unknown, or other
MDVNDVLLVVLAAALAAMWVGVGAQEPGGCRRPSRRGPPGWGGWWGNLVPGDRCSDGPSLYXGARPPGEEVXGPSSPMGGWXQRTPHRGPPRRSSSTRRWVKQGPMFASRPEDSPTRLLFSVGKCTVNSAPTAPLWRALRRTPSPRSCP

SEQ ID NO: 21757 - DNA, 637 bp, Zea mays
  misc_feature: Ceres CLONE 1391116-F
  misc_feature: Encodes the peptide sequence at SEQ ID NO. 21758
  misc_feature (489)..(489): n is a, c, t, g, unknown, or other
tggagctccccgcggtggcggccgctctagaactagtggatcccccgggctgcaggaattcgcacgagaccattacctagaacatcctaatcgaaaaactgtactactacaattattgatttcttcctcagcttgctggataaggatgtcaacttactacacgggacggacgaaaccctagcggcgccgccccctccctccactccatcccacctcgccgtcaccagagggcgccgccggatgtccgcgcggccccaaggaaggtggcgccgaggcgatttttctctggattgagcgcgcctgcccggatctagtcgtgttccagcagctgtcagcggtgtgtgtgatccgcatacccttcgccggcgcggctcagcctcggcggcatcctgtcgacagtgagcgcgacgttcgtatggcacatccggacgttgcgcgtcctggatgggtgctcgcgcagcaggggggcatgcggccggccgtggctcncagccgcggagaaagtgctgtctgccgcccccagggcagggagcggcgccccccgtggaggtctgaatctagggggccggggggttcgcggccctccgggggcacccttgggaggggccgacaggctggccccgggatgggcccgggg

SEQ ID NO: 21758 - protein, 74 aa, Zea mays
  misc_feature: Ceres CLONE 1391116-F
  misc_feature (25)..(25): Xaa is any aa, unknown, or other
MAHPDVARPGWVLAQQGGMRPAVAXSRGESAVCRPQGRERRPPWRSESRGPGGSRPSGGTLGRGRQAGPGMGPG

SEQ ID NO: 21759 - DNA, 664 bp, Zea mays
  misc_feature: Ceres CLONE 1391117-F
  misc_feature: Encodes the peptide sequence at SEQ ID NO. 21760
tggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagacgtcgggcccggacgccggctcgccggccttctcggtgcgcgtgcgccgccgcctgccgtacttcctgcagtcggtgaacctcaagtacgtgcgcctcgggtaccactacctcatcagccacggcgtgtacctggacaccatccccgtcatcgtgctggtgtgcgacgccgagctggccaccctcaaccgcgacaagctgtggcgcagggtgtgggggaaggccacctacgacctcggcaccggggtcggcttccttcgccggcctccgctttaacatctccggtttaactaatggcccaggcccagggccggggaccctcatcgaaattcccatggttaaaaggcgggccgacaaagtccaaggggggccaggggggaggttctctcgactggggggcgaaaa

SEQ ID NO: 21760 - protein, 110 aa, Zea mays
  misc_feature: Ceres CLONE 1391117-F
  misc_feature: SWISSPROT Homolog: EC 2.3.1.119 Icosanoyl-CoA synthase
MAREEQALLSTEIVNRGVETSGPDAGSPAFSVRVRRRLPYFLQSVNLKYVRLGYHYLISHGVYLDTIPVIVLVCDAELATLNRDKLWRRVWGKATYDLGTGVGFLRRPPL

SEQ ID NO: 21761 - DNA, 694 bp, Zea mays
  misc_feature: Ceres CLONE 1391118-F
  misc_feature: Translation starting site: 137
  misc_feature (326)..(326): n is a, c, t, g, unknown, or other
  misc_feature (388)..(388): n is a, c, t, g, unknown, or other
  misc_feature (438)..(438): n is a, c, t, g, unknown, or other
  misc_feature (456)..(456): n is a, c, t, g, unknown, or other
aaagctggagctccccgcggtggcggccgctctagaactagtggatcccccgggctgcaggaattcgcacgagaccattacctagaacatcctaatcgaaaaatctagcggcagagaccaaagtgcccatcgcaccatgtcggccgccgaaaccgctgtttctccgacgacgacgccgcagccgcagctgcaatcggatccgaacgccgccgccgacgcggccagttccaattctctctgggtggccgacgagacgcaaaccctaaccgaggtcctgctccaaccccaaccaaaccacctgtcgcctcctccttctggtgaagggngacgacgggatcactgcctccggtgctcctggttgggtgggggacgccgcggcatctgcttnctgctgcggcggcggctaacgcgacatagaagagcggggtgagggggggnccgtggtcccccaagggnaggaccgcggtgctgagcaactccccggggggaaagtcccggggcgcggaaactgggacgctgaatcgcgcgtaggcatccccgggccggctccgggaaagtcctgccgaccctgcggctggggcaatcagcttcgaccccccaagtccaagcgcaagccttttcactggaagaggaggacccgaattaaaatgggaagctcatgctggtcatggggaaccagtgggcatctatcgct

SEQ ID NO: 21762 - DNA, 661 bp, Zea mays
  misc_feature: Ceres CLONE 1391122-F
  misc_feature: Translation starting site: 324
  misc_feature (320)..(320): n is a, c, t, g, unknown, or other
  misc_feature (456)..(456): n is a, c, t, g, unknown, or other
  misc_feature (457)..(457): n is a, c, t, g, unknown, or other
  misc_feature (584)..(584): n is a, c, t, g, unknown, or other
  misc_feature (585)..(585): n is a, c, t, g, unknown, or other
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcaaaaaggccgaaccagcgctagccctcttcctcttcctcgctatacagtacttcccagcagagcagagagctgagacgaaaacgagaagatcccatccactaccgcccggtcgccgtcctcccttcccgccgcgcccctcctgttccacccgctccgctttgctcgccgcagatcgccctcaggattttattccgccctccgtctccgggctcgcttggatcngagatgggcgtctgcgcgtccaaggccgcctactcctgctgctgctgctgctgctgccgcggccgccacaacggggttactaacgagaggaccgatgctgtaacggatgacgagaaggcatacgacctgcctgcgnntccaggagttacccttcgagcagttgggtagctacactcaggggtttggcggtggagaacatcgtgtctgagcaagggtgagaaggctcccaatgtgggtatacaaggggaagctccatgcccaggnnccgcatcgccgtcaagcgcttcaaccgctctgcctggccgnacccgcgcaggttcctggaagaaagctagatcagg

SEQ ID NO: 21763 - DNA, 632 bp, Zea mays
  misc_feature: Ceres CLONE 1391127-F
  misc_feature: Encodes the peptide sequence at SEQ ID NO. 21764
  misc_feature (538)..(538): n is a, c, t, g, unknown, or other
tggagctccccgcggtggcggccgctctagaactagtggatcccccgggctgcaggaattcgcacgagaccattacctagaacatcctaatcgaaaagaaaaggctagccaagaaaacgactgggcgcacgaggcttctgtgttctgtgacttctgtccctatccacacgaccccgacattccatgggcgactccggcggaccccaccaccaccgcccttcgccgccgcctctgctggacgccggcaagcgacggcgcatccccaacgtccgcctcgctggctccgtcccgctcccttcccacctgccccacccgcgccgcgtccccattgcccccgccaccaggtcccgcaaacccctccaacttcagcataacagcaaccagcatgaccacccctccgcggagccacccaataccctcctaaaacccttcgtcgacagcgggcgacgacgtcgtcttggccgccgcttttccccgcaaggtcagggccccggcttgaggggactggtggtggggagctactgccacgatgtgctantccggggcggcgcatagtgggggagacgctcggcggggctgcggccttcgtgtccaacgtgctcgacgccgcttcgccccagggcgccgcgctc

SEQ ID NO: 21764 - protein, 123 aa, Zea mays
  misc_feature: Ceres CLONE 1391127-F
  misc_feature (119)..(119): Xaa is any aa, unknown, or other
MGDSGGPHHHRPSPPPLLDAGKRRRIPNVRLAGSVPLPSHLPHPRRVPIAPATRSRKPLQLQHNSNQHDHPSAEPPNTLLKPFVDSGRRRRLGRRFSPQGQGPGLRGLVVGSYCHDVLXRGGA

SEQ ID NO: 21765 - DNA, 678 bp, Zea mays
  misc_feature: Ceres CLONE 1391136-F
  misc_feature (335)..(335): n is a, c, t, g, unknown, or other
  misc_feature (355)..(355): n is a, c, t, g, unknown, or other
  misc_feature (404)..(404): n is a, c, t, g, unknown, or other
  misc_feature (405)..(405): n is a, c, t, g, unknown, or other
aagctggagctccccgcggtggcggccgctctagaactagtggatcccccgggctgcaggaattcgcacgagaccattacctagaacatcctaatcgaaaagccgcaacccctctctcattttcttcctcgtctacacctccttctctcctcctcgatacattcgagcacgcccggacgcggtcagaagggagaaagcagcaagcggcgccgggttccccctcccttcgtcgcccccgatcgacgccgatcggggccgactgctcgtgggggacgccgaccgaagcccgggcggcgctgcttcaatatacggaagcagtttctagttttcttcangtcgccgctgcagtttcagnttttccagcggttcccaccagttgtctaataaacttaattgttgtttgnnacgtgagggtgctttttgtcgtattttgccaggttgctttttggtggattttgccaggtgacaccactttggtgttgtaaatcattgcctatttttgggtcatgactttgtttttattgaaatcaatgggctgccaagggtcactaaaatctttgatgcaacataataggattcaccatggcggcctttctcagagactggcccgcttgggttctagttctagcaaccccggccaggggtcaggagaatttacttccccacaactcttaaggg

SEQ ID NO: 21766 - DNA, 630 bp, Zea mays
  misc_feature: Ceres CLONE 1391137-F
  misc_feature: Encodes the peptide sequence at SEQ ID NO. 21767
  misc_feature (244)..(244): n is a, c, t, g, unknown, or other
  misc_feature (400)..(400): n is a, c, t, g, unknown, or other
  misc_feature (401)..(401): n is a, c, t, g, unknown, or other
  misc_feature (409)..(409): n is a, c, t, g, unknown, or other
tggagctccccgcggtggcggccgctctagaactagtggatcccccgggctgcaggaattcgcacgagaccattacctagaacatcctaatcgaaaaccattaagtttttatcgcttcgttatttctctgttgtgcttgtcttgttcttttgttgctctaaccatggacgcaggctcccgctcgatctcctcggcgaagaaccgcgccgccgccgcgccccggccgccgctggcaggaggcggnctcccgcccctacatgccatcgctgagctcgggaccccgcaacccgtcggccaagtgctacggcgacaggttcatcccggacaggtcggcgatggacatggacttggcgcactacttgcttactgagcccaggagggacaaggagaacgcgtcggnncatggcgncgtccccgtcccaaggaggcgtaccggaggctgctcgcggagaagctgctcaacaaccggacacggatcctcgctttcaggagcaagccgccggagccccgggaaacgtttcttttgcggacacgacttcctccaacctgcaggccaagcccggcaaacagcgtcgccacattcccagttctgccgagaggaccctagacgcaccagagctagttggagac

SEQ ID NO: 21767 - protein, 124 aa, Zea mays
  misc_feature: Ceres CLONE 1391137-F
  misc_feature (48)..(48): Xaa is any aa, unknown, or other
  misc_feature (51)..(51): Xaa is any aa, unknown, or other
MPSLSSGPRNPSAKCYGDRFIPDRSAMDMDLAHYLLTEPRRDKENASXHGXVPVPRRRTGGCSRRSCSTTGHGSSLSGASRRSPGKRFFCGHDFLQPAGQARQTASPHSQFCREDPRRTRASWR

SEQ ID NO: 21768 - DNA, 703 bp, Zea mays
  misc_feature: Ceres CLONE 1391138-F
  misc_feature: Encodes the peptide sequence at SEQ ID NO. 21769
  misc_feature (358)..(358): n is a, c, t, g, unknown, or other
  misc_feature (393)..(393): n is a, c, t, g, unknown, or other
  misc_feature (406)..(406): n is a, c, t, g, unknown, or other
  misc_feature (407)..(407): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (433)..(433): n is a, c, t, g, unknown, or other
  misc_feature (436)..(436): n is a, c, t, g, unknown, or other
  misc_feature (448)..(448): n is a, c, t, g, unknown, or other
  misc_feature (616)..(616): n is a, c, t, g, unknown, or other
  misc_feature (685)..(685): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
tggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggagcaggagaagacgcggctgctcctccaggagacgggcctcccgagcgggctgctcccgctgcgggacatcatcgagtgcggctacgtgggaggagacggggcttcgtggtggctccggcagcgnccgcaaggtggaccactactgtcgcgaagggcggncgccacgtgccanngnnnnnccgagggggtnnnnnnnngnggnccggaacagggnccggcctcaagaagaatcaccggccgtcaagggccaagaaaaatgcttggctggggctcacccctcccacgagattctggcgtcgacgacccggcccactgggtaagctccactgcaggggccatcgggcgggcctggtccgcagctttcccccgtcgagggccttcnaaggccgaggaagcccggcgcgcccgggaaaaccgggggtggctttcccaggggacggggaggaaaaanaaggggggggggggnnng

SEQ ID NO: 21769 - protein, 177 aa, Zea mays
  misc_feature: Ceres CLONE 1391138-F
  misc_feature (75)..(75): Xaa is any aa, unknown, or other
  misc_feature (79)..(79): Xaa is any aa, unknown, or other
  misc_feature (80)..(80): Xaa is any aa, unknown, or other
  misc_feature (81)..(81): Xaa is any aa, unknown, or other
  misc_feature (82)..(82): Xaa is any aa, unknown, or other
  misc_feature (86)..(86): Xaa is any aa, unknown, or other
  misc_feature (87)..(87): Xaa is any aa, unknown, or other
  misc_feature (88)..(88): Xaa is any aa, unknown, or other
  misc_feature (172)..(172): Xaa is any aa, unknown, or other
MTLTIPDEVRAKAEVYVGDAAEQEKTRLLLQETGLPSGLLPLRDIIECGYVGGDGASWWLRQRPQGGPLLSRRAXATCXXXXEGVXXXGPEQGPASRRITGRQGPRKMLGWGSPLPRDSGVDDPAHWVSSTAGAIGRAWSAAFPRRGPSKAEEARRARENRGWLSQGTGRKXKGGGG

SEQ ID NO: 21770 - DNA, 649 bp, Zea mays
  misc_feature: Ceres CLONE 1391142-F
  misc_feature (238)..(238): n is a, c, t, g, unknown, or other
  misc_feature (272)..(272): n is a, c, t, g, unknown, or other
  misc_feature (273)..(273): n is a, c, t, g, unknown, or other
  misc_feature (315)..(315): n is a, c, t, g, unknown, or other
  misc_feature (466)..(466): n is a, c, t, g, unknown, or other
aagctggagctccccgcggtggcggccgctctagaatagtggatcccccgggctgcaggaattcgcacgagaccattacctagaacatcctaatcaaaactgtccctccactcctcccgtcgagcacttggcactgccaatggcggctcccgcccacaccccttcgatgcgcgcaagccaccttctttccccgtgagatcgacgcacctccccctctcgtgcttcatttccgctcggncgtcgtttctttcggccccgagccgtcggggggnncgcctccacatctcgtcgtggcttaagggcttggggctccgnccggtcctgggaagggggacacccagtggccaccggtgcccacatacccaaaataacaatccctcgtggggtcccaagggggggaaaaaaaccatccggcggggaaatgggaaaaacccccctccccccaacccggggggggggggggggnataggggggccctggtaaaaggccccccccccgggggggtctccccccccgggtttaattgggggggggggggccctaaaaaaaacaacaaaaaaaatttttcttcccgggggaaaaacaccccgtggggggggggggttattttttgtaaaaggccccccccccctttgggggggggggtgg

SEQ ID NO: 21771 - DNA, 661 bp, Zea mays
  misc_feature: Ceres CLONE 1391143-F
  misc_feature: Translation starting site: 191
  misc_feature: SWISSPROT Homolog: EC 3.2.1.15 Polygalacturonase
  misc_feature (454)..(454): n is a, c, t, g, unknown, or other
aaagctggagctccccgcggtggcggccgctctagaactagtggatcccccgggctgcaggaattcgcacgagaccattacctagaacatcctaatcgaaaagaacacatacctaattatcacctgtaagccagctgaaccacatctcgtcgtgcacatccggagcccgggaacacacacacacattgccatggccatgcccatgcccaagcccgtcctgagcctgctcgtgcacctacacgccgccgtcctgttccttcccgccccggccggcggcgcggactacaacgttctgcgctacggcgcgcgccccgacggcgtgacggacgcggcggagcccttcctccgcgcgtgggcggacgcctgacgctcgcccctcccgagccgccgtgtacgtgccgtcagggaggtacctgatgcgaagcgccacgttcaccggaccgtgcacagccgncgccgtgacgttcgccgtcgccgccacggtcgtcgcccccgcgagctacggcgcgcgcggctcctcgggggaggaggatcaggttcgagcaatgtgtacggcctcgatcccctcagagtgggcataccggtgacgttcccgcaaagtgcgcatctgggctgctaaaaaacgcttctccacccgtgtggcccaaccccgcctcaagcg

SEQ ID NO: 21772 - DNA, 665 bp, Zea mays
  misc_feature: Ceres CLONE 1391144-F
  misc_feature (312)..(312): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgcctttgctcagcagcagtagtaaagccacgcctgacagacagctggttcatttctggttgctgccttgctggtggcagccctcggcgcaggctagccaaaaacagagagagcgagatggatgtgaacgacgtgctgctagtggtgctggcggcggcgctggctgccatgtggtggcgtcagtgctcctgaaccggnggtgtcgacggcctcccgccggggcctccgggttggccgtgggtggcgaacctgttccaggtgatcgtgcagcgacgatccttcatgtacggggagcgcgacctccgttagaagtacggatccatcttcaccatgcttgatggtgcagcgcaccctcatcgtggtcaccgtcggcggagctcatccacgaggcgctggtgaaacagggccccatgttcgcgagccgggcccgagggaagccccacccgcctcctcttcagtggcggcaagtgcagcgactactcggcggcctacgggccccctgtggggtggtctgcgccgaaacttcgtcgccgagatcgtggccccgcacc

SEQ ID NO: 21773 - DNA, 673 bp, Zea mays
  misc_feature: Ceres CLONE 1391145-F
  misc_feature: Encodes the peptide sequence at SEQ ID NO. 21774
  misc_feature (440)..(440): n is a, c, t, g, unknown, or other
  misc_feature (466)..(466): n is a, c, t, g, unknown, or other
  misc_feature (520)..(520): n is a, c, t, g, unknown, or other
  misc_feature (590)..(590): n is a, c, t, g, unknown, or other
  misc_feature (600)..(600): n is a, c, t, g, unknown, or other
  misc_feature (673)..(673): n is a, c, t, g, unknown, or other
tccccgcggtggcggccgctctagaactagtggatcccccgggctgcaggaattcgcacgagaccattacctagaacatcctaatcaaaaacacgcgaaggcacctagcagccgccactcgccgaactgaggaacacgccgggcgacgggatacagcagcagcgcgcccctctatgcccgacgcgacggcgccctgcagctgcagataaacctgttccaatggccaaacaaaaagagggtgtggacaaaagaactgctaggaagatgatccgatctacggaaggctgtgcaaagagcattactttcgagaggaacaacaaatcagacgctgtgcagcttcacgatctgccgaatgacatcctaggtagcatactatcacggttgacattcagagaatcctcacagatgggccttgtttctcatacctggcggcggctgtnggagaagctgttgcccggaaactggntctcaccagtgccaccatgtttccaacccgggaaataggagcatcaaacatacnaggaccaactttgccatggagagtcaacaggtttctttgcgtcagctacacactcatctactcctttaanaaagttgggnaattaaaggtcccgggctggcccaggaagcacactccgcatgtcaaacaagaatggattcgctttctggctcn

SEQ ID NO: 21774 - protein, 94 aa, Zea mays
  misc_feature: Ceres CLONE 1391145-F
  misc_feature (38)..(85): Pfam Name: F-box Pfam Description: F-box domain
  misc_feature (74)..(74): Xaa is any aa, unknown, or other
  misc_feature (83)..(83): Xaa is any aa, unknown, or other
MAKQKEGVDKRTARKMIRSTEGCAKSITFERNNKSDAVQLHDLPNDILGSILSRLTFRESSQMGLVSHTWRRLXEKLLPGNWXSPVPPCFQPGK

SEQ ID NO: 21775 - DNA, 630 bp, Zea mays
  misc_feature: Ceres CLONE 1391147-F
  misc_feature (152)..(152): n is a, c, t, g, unknown, or other
  misc_feature (213)..(213): n is a, c, t, g, unknown, or other
  misc_feature (229)..(229): n is a, c, t, g, unknown, or other
  misc_feature (230)..(230): n is a, c, t, g, unknown, or other
  misc_feature (532)..(532): n is a, c, t, g, unknown, or other
tggagctccccgcggtggcggccgctctagaactagtggatcccccgggctgcaggaattcgcacgagaccattacctagaacatcctaatcgaaaaaaatccgccacttcgtcgtcgtcgtcgcacggattggcattggctgccccccggncctgttcctcgtcctcctcatcaattcccgtctctcagtcctcccaataatggtggcgtgntgagaaatcttccgtnncggcgtcgtcttaaaagatgaactgtcctcttgctgcgcgctgccactcatcttctccggggttctcgcagcccggggggggtttagttgctaattggtccagaacaacggaaatcaaaaggggtttttctggggctaaaaaaggttccacgaaaacgataaagccgggggcccaacgggttgggggaaaaaaaaaaaaaattttttggggaaaaaacctttggaaaatccgaaaattttaaaaaactttttttttttgggggcccccaaacacttcccagaggggaaaaaatttttccccnaatttccccccgcgctttcttgggggggggccaaaaaaaaaaaaacccccggcgggggggtgtttttaaaaaacaccacccgggtggtggtaaaaaaa

SEQ ID NO: 21776 - DNA, 648 bp, Zea mays
  misc_feature: Ceres CLONE 1391149-F
  misc_feature: Translation starting site: 373
  misc_feature (235)..(235): n is a, c, t, g, unknown, or other
  misc_feature (266)..(266): n is a, c, t, g, unknown, or other
  misc_feature (267)..(267): n is a, c, t, g, unknown, or other
  misc_feature (291)..(291): n is a, c, t, g, unknown, or other
  misc_feature (292)..(292): n is a, c, t, g, unknown, or other
  misc_feature (320)..(320): n is a, c, t, g, unknown, or other
  misc_feature (335)..(335): n is a, c, t, g, unknown, or other
  misc_feature (355)..(355): n is a, c, t, g, unknown, or other
  misc_feature (358)..(358): n is a, c, t, g, unknown, or other
  misc_feature (361)..(361): n is a, c, t, g, unknown, or other
  misc_feature (362)..(362): n is a, c, t, g, unknown, or other
  misc_feature (404)..(404): n is a, c, t, g, unknown, or other
  misc_feature (409)..(409): n is a, c, t, g, unknown, or other
  misc_feature (431)..(431): n is a, c, t, g, unknown, or other
  misc_feature (462)..(462): n is a, c, t, g, unknown, or other
  misc_feature (490)..(490): n is a, c, t, g, unknown, or other
  misc_feature (492)..(492): n is a, c, t, g, unknown, or other
  misc_feature (493)..(493): n is a, c, t, g, unknown, or other
  misc_feature (511)..(511): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (555)..(555): n is a, c, t, g, unknown, or other
  misc_feature (556)..(556): n is a, c, t, g, unknown, or other
  misc_feature (561)..(561): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (583)..(583): n is a, c, t, g, unknown, or other
  misc_feature (587)..(587): n is a, c, t, g, unknown, or other
  misc_feature (588)..(588): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (617)..(617): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (639)..(639): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
aagctggagctccccgcggtggcggccgctctagaactagtggatcccccgggctgcaggaattcgcacgaaccattacctagaacatcctaatcgaaaaaatcagtgctcgctagcccaccacgccctgaacctagcccggacaccagccagaacaggccatgtccatgggctccccggtgcagctcaggcggctgaagcctctgtaccagttcgtggtgaacaacatcctggncatcgtggccgtgcgttcgggccaccgcggnntctgctcaggcgtcgtcgctcggnnccgaggagatcctggcgctcccggcggngcacctgttcctggncgcgttcctgcctgccgcgnccncgnngctgtccctgatgctcggggcggggcaggggttcctggtggnctccncctgcttccgcccccgcccccnctggcgcgtcccggtcgcggcgttcctgggncccctccggcgggtggccggggctccgncnngcgccggggtcgggttcntggcccggcctgctgggcgggtccnnnncttcggggggnnnccnnccctngctttnnnnncnnnccttttcncccnnccnnnnnnnnnnggggggccctcccgccncccnnngccnnnnnnngnnntntttttnnnn

SEQ ID NO: 21777 - DNA, 668 bp, Zea mays
  misc_feature: Ceres CLONE 1391151-F
  misc_feature: Encodes the peptide sequence at SEQ ID NO. 21778
  misc_feature (268)..(268): n is a, c, t, g, unknown, or other
  misc_feature (294)..(294): n is a, c, t, g, unknown, or other
  misc_feature (347)..(347): n is a, c, t, g, unknown, or other
  misc_feature (380)..(380): n is a, c, t, g, unknown, or other
  misc_feature (392)..(392): n is a, c, t, g, unknown, or other
  misc_feature (393)..(393): n is a, c, t, g, unknown, or other
  misc_feature (461)..(461): n is a, c, t, g, unknown, or other
  misc_feature (462)..(462): n is a, c, t, g, unknown, or other
  misc_feature (472)..(472): n is a, c, t, g, unknown, or other
  misc_feature (489)..(489): n is a, c, t, g, unknown, or other
  misc_feature (490)..(490): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaaggaatcctctcgagctcgtcgaaccttctggctcgccgccagcgcgctccattctccaactacctcaccaccctataaatgtagtcgcctactcgcctctgcgccgtcaccatcgcgaagacacactggggtaggaagatcgcagaaaaaggaagcagcagctttngatcgggtggagtttcttgctcatgnatcgtcgagttcctgtttcgattgaagttccaggcgcggacacgcatgaaaancttttggggtcccgtgaacgatgtcgaggaagncccgcagcgtgnnttgctcgcgtgccctcgtcgccgtgacagcgggcggcgcctggcggacggcgcgctgcttcccgtggnntcggcgaggnccgggcgcggctcgacnngggcagcggtggcccgacgtgggccctcctggcgggcgaaccgttccgggatcctggagaacgtcccgttcggcttcgaccgggaagacgtggccatggtctccttggcgcgggtggactggcgcgagaccccgaagcgcacaaaatgtggtccacgtgcccggnatgccaaggagaa

SEQ ID NO: 21778 - protein, 109 aa, Zea mays
  misc_feature: Ceres CLONE 1391151-F
  misc_feature (3)..(3): Xaa is any aa, unknown, or other
  misc_feature (14)..(14): Xaa is any aa, unknown, or other
  misc_feature (18)..(18): Xaa is any aa, unknown, or other
  misc_feature (41)..(41): Xaa is any aa, unknown, or other
  misc_feature (45)..(45): Xaa is any aa, unknown, or other
  misc_feature (51)..(51): Xaa is any aa, unknown, or other
  misc_feature (106)..(106): Xaa is any aa, unknown, or other
MKXFWGPVNDVEEXPQRXLLACPRRRDSGRRLADGALLPVXSARXGRGSTXAAVARRGPSWRANRSGILENVPFGFDREDVAMVSLARVDWRETPKRTKCGPRARXAKE

SEQ ID NO: 21779 - DNA, 663 bp, Zea mays
  misc_feature: Ceres CLONE 1391156-F
  misc_feature (461)..(461): n is a, c, t, g, unknown, or other
  misc_feature (640)..(640): n is a, c, t, g, unknown, or other
  misc_feature (642)..(642): n is a, c, t, g, unknown, or other
  misc_feature (644)..(644): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (653)..(653): n is a, c, t, g, unknown, or other
aagctggagctccccgcggtggcggccgctctagaactagtggatcccccgggctgcaggaattcgcacgagaccattacctagaacatcctaatcgaaaagtatcgtctcctctccttcctgacattggcactggcagctgcactcaccggaagccatggaagacttgctctactactccctcaccatagccatctgcatcgcagtcatcgccctcctctccatccttcgttcgttcaccgctaccggaccgccgccggcgctcccgcccggcccgtcgctgctgtcgctgatcaccccgctcctcttcctcggccgaacgaacttcggcatcgagcggatcctcccccgccgcgcggtcccgctacggccccgtcttcacgctctacctgctcccgtcccgcccggccatcttcatcgccgaccactccgtggcgcaccgcgtggctggtgcagggcgncgccgccttcgccgacaggccgccggccagcctccccttccgcctcttctccagtgaccagcgcaacatcacatccggcgcctacggggcccggtctggcgcgcgctccgtcacaacctccggggcaacgtgttccacccgtcgttcatggggcccggttcggcgccgccccgccgcgngngntgggnnngnctcggccgcc

SEQ ID NO: 21780 - DNA, 851 bp, Zea mays
  misc_feature: Ceres CLONE 1391157-R
  misc_feature: SWISSPROT Homolog: EC 3.2.2.20 DNA-3-methyladenine glycosylase I
ccgggcgccccctcgaggtcgatggtatcgataagcttttttttttttttttttctgaaatttaaaatatttaacttctcagaatacgagataaacaattttctcgggacgaaggaagcccctcaaaataggagatagacaattatctccggacaaaggtaccctgctgtcgttcaatggtcctgacacaccgaaaactaaaatttttctagcctacattgacgaggggtaaaactccagaaaaaggacgccgaatcacacctatactccggcccataaaatacacaaactaaccccttttcgtttcagcaccgctcctaccccgctatgaaatgctgagctcatcgatagtcctggagagttcaatacctgaatccagcccattcgtcccgttaatcttctgctctgccgggccatggctgctatcacttgaatttgctaggcttccatcaaaaagtttagcagcgcaagcagaggaggccgcgcattcagcaaaacggtagcaggaaataaggtggtcgttagtcatgccagaaacttgcatgaaggtatatacaactgttgggccgacactgcggaaaccccttcgaaccaagtctttgcttatggcatctgctttcgatgttttgacaggcacttgacgggagtacctgaatcggctcaatataggtttggggttcacgaagctccaacagtatttttggaaggacccaaattcccctttgaacttgagatttttgacgtgcatttttcaaaaaccccccccaatttctgtttcagaataacaagggagcaccttgggattttccgggcggcaataaatcttcctttcttcatttaagactttggaa

SEQ ID NO: 21781 - DNA, 652 bp, Zea mays
  misc_feature: Ceres CLONE 1391157-F
  misc_feature: Encodes the peptide sequence at SEQ ID NO. 21782
  misc_feature (613)..(613): n is a, c, t, g, unknown, or other
  misc_feature (624)..(624): n is a, c, t, g, unknown, or other
  misc_feature (630)..(630): n is a, c, t, g, unknown, or other
  misc_feature (634)..(634): n is a, c, t, g, unknown, or other
  misc_feature (635)..(635): n is a, c, t, g, unknown, or other
  misc_feature (645)..(645): n is a, c, t, g, unknown, or other
aaagctggagctccccgcggtggcggccgctctagaactagtggatcccccgggctgcaggaattcgcacgagaccattacctagaacatcctaatcgaaaaattgttcgtgccgcgcggcttctctctctctctaagccactgccagccatctctgctagcgtcgtgaccattcgccgagtaaattttcttccgcccacctgattacccttctacttctgattcggcgccgactccgtctctgccggaggtggcagccatggcgccagtgtcgcctctctcgcgctccgccacgcagaccatcactctgtcgtcgcctcgactcgcgggtgcatgtgcacgatgacatgggttttactgatctcgtctcaggccgacgtggtgccgcggtccaaagagaggcttctcctctatgcggccgttgcaagtcttcctgagcatgcactaagcgcgtcgtagagtatcgccctcagccgatccggcagcccacaggagacagctccgacgacgaggaggactatcccaagaagcgccgcgcgagcaacaacgaggcgcgcttgccgcccgtgtctgctggctacgatcccgtgtcctcgttcctcccggctcgagnactcgctcggnctcggngcgnntctgcgcggnaaacgag

SEQ ID NO: 21782 - protein, 41 aa, Zea mays
  misc_feature: Ceres CLONE 1391157-F
MCTMTWVLLISSQADVVPRSKERLLLYAAVASLPEHALSAS

SEQ ID NO: 21783 - DNA, 634 bp, Zea mays
  misc_feature: Ceres CLONE 1391158-F
  misc_feature (326)..(326): n is a, c, t, g, unknown, or other
  misc_feature (384)..(384): n is a, c, t, g, unknown, or other
  misc_feature (426)..(426): n is a, c, t, g, unknown, or other
  misc_feature (476)..(476): n is a, c, t, g, unknown, or other
  misc_feature (533)..(533): n is a, c, t, g, unknown, or other
tggagctccccgcggtggcggccgctctagaactagtgtatcccccgggctgcaggaattcgcacgagaccattacctagaacatcctaatcgaaaaaaaaagggtcatccgagttgccagccaattttgcatccccaccaccaatccaccaccccacacccagtgacagagacagaaggccgggcagggctacgcgacgcgacggagatggagcacacgaatcatcgccgccgccgtcaagctttggccaccgtgtcggcgacgacgacgctcctgctgcttctcctctgcctcgcggcgttgacgacggcagaggcgctgcgcngagcacagggacgagggcggcgctagcagcagtggcggaagcggaagcggctgcggcnagcaacgccgccggcggaagcaatcgccggccgggggggggntggttcggggaactcgtacgcggacacgggaaacctgggcgaccctcggncgggagctgaccccgcgagtggtacgacccgtacggaccacttttccccgggccggnccgccggccgttttctccgacggccgcgtcctcaccgacttctagccctccgcgatgggagggccacgccggtgcgacaaactggggacaggggcgccgcg

SEQ ID NO: 21784 - DNA, 667 bp, Zea mays
  misc_feature: Ceres CLONE 1391161-F
  misc_feature: Encodes the peptide sequence at SEQ ID NO. 21785
  misc_feature (324)..(324): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (425)..(425): n is a, c, t, g, unknown, or other
  misc_feature (456)..(456): n is a, c, t, g, unknown, or other
  misc_feature (583)..(583): n is a, c, t, g, unknown, or other
tccccgcggtggcggccgctctagaactagtggatcccccgggctgcaggaattcgcacgagaccattacctagaacatcctaatcgaaaaattcgcggcttcgcctgatcgcgtacgccgcttcgtcctgattctcaatctctggtgctcccatgaagaaagacagggaatgaaggaccgccacctcgcgctgaaccagacccagagggtccgcctcgaggccgcgcttcaagagctccagtccgttgcgcccgccgccgcgcccgccgctgccgtcaaccgtcgcgggcaccattcccgtcaatcaagaggacaacatcctncaaggggcatgggacgcggaccaggacgggggggaggtggttgcgacgctttgccggggtgggtggaagcgnnntcaacaagcctggtctacgtccgcacntcttcgcgcgagctgcagattctcgatgganaaaggaatgggggttctgcaagccgcggatgccaagttactgggtttacaaggggtgagggcgccgcgaatctcatcctcagctacaccggctcatcccctactatgcttggcaggggtattgcggntcaagaagcttctaaatgacaagtcacagctgccaccaagttggatggtcttctcaagcatgagcaactcctgtggggcatatc

SEQ ID NO: 21785 - protein, 143 aa, Zea mays
  misc_feature: Ceres CLONE 1391161-F
  misc_feature: SWISSPROT Homolog: EC 2.7.1.158 Inositol-pentakisphosphate 2-kinase
  misc_feature (52)..(52): Xaa is any aa, unknown, or other
  misc_feature (76)..(76): Xaa is any aa, unknown, or other
  misc_feature (96)..(96): Xaa is any aa, unknown, or other
  misc_feature (138)..(138): Xaa is any aa, unknown, or other
MKDRHLALNQTQRVRLEAALQELQSVAPAAAPAAAVNRRGHHSRQSRGQHPXRGMGRGPGRGGGGCDALPGWVEAXSTSLVYVRTSSRELQILDGXRNGGSASRGCQVTGFTRGEGAANLILSYTGSSPTMLGRGIAXQEASK

SEQ ID NO: 21786 - DNA, 642 bp, Zea mays
  misc_feature: Ceres CLONE 1391162-F
  misc_feature: Encodes the peptide sequence at SEQ ID NO. 21787
  misc_feature (270)..(270): n is a, c, t, g, unknown, or other
  misc_feature (271)..(271): n is a, c, t, g, unknown, or other
  misc_feature (373)..(373): n is a, c, t, g, unknown, or other
  misc_feature (443)..(443): n is a, c, t, g, unknown, or other
  misc_feature (536)..(536): n is a, c, t, g, unknown, or other
  misc_feature (541)..(541): n is a, c, t, g, unknown, or other
  misc_feature (622)..(622): n is a, c, t, g, unknown, or other
tggagctccccgcggtggcggccgctctagaactagtggatcccccgggctgcaggaattcgcacgagaccattacctagaacatcctaatcgaaaatcgtctccactgctctgctgctcctcgcaccgccgccgccgccgccgcagcgacgtaatggcttccgccgcggtgctccggaacgccggctcccggcgcctcttctcctaccctactctccgcgccgctgcgatatatgtaccttctgcgctacccgatgcgcccgcggcggnnggcagcgccggcccagccgccaccgacggccggggaccctctgggcgaggtctatggccaccttcacgcgcacgaagccccatgtgaatgtcggcaccattnggcacgtcgatcacggcaaaaccattctcactgctgtcattaccaaggtcctggccgaggcaggaagggncaaagccgttgctttcgacgagatcgacagggctcccggaggagaaagccagaggaatcaccattgcgacagctcacgtcgagtatgagacgnctaanaggattatgctcacgttgattgtccagtcacgcaaattatgtcaagacatgatcactggagctgctcaaatggatggtggnaatcctgtcctgcaactcct

SEQ ID NO: 21787 - protein, 68 aa, Zea mays
  misc_feature: Ceres CLONE 1391162-F
  misc_feature (17)..(17): Xaa is any aa, unknown, or other
  misc_feature (40)..(40): Xaa is any aa, unknown, or other
MATFTRTKPHVNVGTIXHVDHGKTILTAVITKVLAEAGRXKAVAFDEIDRAPGGESQRNHHCDSSRRV

SEQ ID NO: 21788 - DNA, 732 bp, Zea mays
  misc_feature: Ceres CLONE 1391165-F
  misc_feature (17)..(17): n is a, c, t, g, unknown, or other
  misc_feature (24)..(24): n is a, c, t, g, unknown, or other
  misc_feature (48)..(48): n is a, c, t, g, unknown, or other
  misc_feature (324)..(324): n is a, c, t, g, unknown, or other
  misc_feature (340)..(340): n is a, c, t, g, unknown, or other
  misc_feature (341)..(341): n is a, c, t, g, unknown, or other
  misc_feature (346)..(346): n is a, c, t, g, unknown, or other
  misc_feature (401)..(401): n is a, c, t, g, unknown, or other
  misc_feature (402)..(402): n is a, c, t, g, unknown, or other
  misc_feature (414)..(414): n is a, c, t, g, unknown, or other
  misc_feature (444)..(444): n is a, c, t, g, unknown, or other
  misc_feature (462)..(462): n is a, c, t, g, unknown, or other
  misc_feature (466)..(466): n is a, c, t, g, unknown, or other
  misc_feature (546)..(546): n is a, c, t, g, unknown, or other
  misc_feature (559)..(559): n is a, c, t, g, unknown, or other
  misc_feature (645)..(645): n is a, c, t, g, unknown, or other
cccgggctggactcccngcggtgncggccgctctatgactagtggatnccccgggctgcaggaattcgcacgagaccattacctagaacatcctaatcgaaagtcactcttgtgtcctcctaaaaccctaaccctccgccgcccctcggacccccaaccagcagctgccgcgcccatccgccggagagatggcgctttacctgctggcctagtcccctgccgtctgcccactatgcggagggaacagtttcggctaccctcttcccccgccgaaggtggttggttcgtgcaggctggacacacaagtctttccccaccccgggnagggcaaggggagggnncccgngttcacgcctgcacgagaatgggcgcggctttcctggggcggggggggggcggcnngggggggggggnggagggggggtggggtctcccccgccgcgnggggccgcgccgcgcccnaccntcaccagcgacgagaacggggcccgacgctcgaccgggagggagcccccgggggccccacccccccaccctaccccaacnaccgcccccgtcncccgtccgcggcggggaggggagacgcgcctgtgtgggacaccgatcccccatgaaagatgccctcgttccccccccctcccccgnccgctgttttttcttcttcgttcgggccgggcccccacccctccccacctgctccagcggtcggagggggaagttgttttctcacgg

SEQ ID NO: 21789 - DNA, 676 bp, Zea mays
  misc_feature: Ceres CLONE 1391167-F
  misc_feature: SWISSPROT Homolog: EC 1.14.13.93 (+)-abscisic acid 8'-hydroxylase
  misc_feature (355)..(355): n is a, c, t, g, unknown, or other
  misc_feature (410)..(410): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (568)..(568): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (612)..(612): n is a, c, t, g, unknown, or other
tggagctccccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctgaaaaaaaagggggaaaggccgcttcggggncccatggggaagggtctgctcccttgaagctgcctcctgggctccatgggctggncttacccttggcgagaccctccagctttactcccaggaccccagcttcttcttcgcttcaaaacagaaagagggaacgggcgagatcttcaagacgcacccttctgggttggcccgtgccgtgatgctgcgagccgnnnnnnnnnngnnncgttttcntgcttggtgacccannncgcaacctggtcaagccgacctacccncgcgaacaagggagcgcatgggatcgggcccgttcgtttctctttcttccaccagggggactaa

SEQ ID NO: 21790 - DNA, 570 bp, Zea mays
  misc_feature: Ceres CLONE 1391171-F
  misc_feature (209)..(209): n is a, c, t, g, unknown, or other
  misc_feature (234)..(234): n is a, c, t, g, unknown, or other
  misc_feature (246)..(246): n is a, c, t, g, unknown, or other
  misc_feature (263)..(263): n is a, c, t, g, unknown, or other
  misc_feature (323)..(323): n is a, c, t, g, unknown, or other
tggagctccaccgcggtggcggccgctctagaactagtggatcccccgggctgcaggaattcgcacgagaccattacctagaacatcctaatcgaaaaacggtccaccgacgactcttcttcctcacctcctcccgctccagctccagctcgtctctctcctcgcctcgcgtagggtttcgcttcccgtctcgccgccgtcagcatggngggacaactaacgatgacgaaggcngagcccgatcgntgaacttcgacgaaacngaaaccctccccctgagcatcagccgtaacgaggaactcgatgacgacctcgacggcggngggggattggaccggggaacggtcttcgacccccggtcaggggaacaacggggggggaaagggccctcctcaaacccccaaagggccttttcaaaaaaagggcggcgggtggaaagaattcccccgaaaaaaccccttgaaagaatttggggggggaaaaaaaaaaaacccgcccccttttctttggggggggaaaaaaaaaaaaaaactctcccccccctcctgaggggaaacccccccggggggg

SEQ ID NO: 21791 - DNA, 659 bp, Zea mays
  misc_feature: Ceres CLONE 1391173-F
  misc_feature: Encodes the peptide sequence at SEQ ID NO. 21792
  misc_feature (404)..(404): n is a, c, t, g, unknown, or other
  misc_feature (405)..(405): n is a, c, t, g, unknown, or other
  misc_feature (414)..(414): n is a, c, t, g, unknown, or other
  misc_feature (516)..(516): n is a, c, t, g, unknown, or other
  misc_feature (605)..(605): n is a, c, t, g, unknown, or other
  misc_feature (659)..(659): n is a, c, t, g, unknown, or other
aagctggagctccccgcggtggcggccgctctagaactagtggatcccccgggctgcaggaattcgcacgagaccattacctagaacatcctaatcgaaaaatcggctgtcgagtcgtcgcaaggtgttgctcgccgtatctcctttccccctcctccctgcgtcccccggctccggcgatccgccgcacctgaacccttctccacgtcgcctcgccggttgggttgaggtgagccgatcagatccgatcggggccggtccttgcgccactgctgcgtgagctcatctcggtcgaccgcctgcttggctcgatcggccgggggacggcgctggccagatctgcaatgcagggcaacaaggacgacgcggccaagtgcctgcgcatcgggctaaggacgcgctcnnacgccgagngaccgcgagcgcgtccatcaagttcctgtccaagggaaaagcgcctggacctctcgctgccccatcgaggacctcctcacctcccttcccaactctgaaggngactcccaggcttctgcgcccccgccgtcgtcaccaccgcagatggccgcagtaggagcatcggaaggagctgaagctgatgggctganagacagaaacacaagcgcaagataagggaggagggagcgactcgcagtacccgn

SEQ ID NO: 21792 - protein, 55 aa, Zea mays
  misc_feature: Ceres CLONE 1391173-F
  misc_feature (21)..(21): Xaa is any aa, unknown, or other
  misc_feature (24)..(24): Xaa is any aa, unknown, or other
MQGNKDDAAKCLRIGLRTRSXAEXPRARPSSSCPREKRLDLSLPHRGPPHLPSQL

SEQ ID NO: 21793 - DNA, 687 bp, Zea mays
  misc_feature: Ceres CLONE 1391174-F
  misc_feature (480)..(480): n is a, c, t, g, unknown, or other
  misc_feature (563)..(563): n is a, c, t, g, unknown, or other
  misc_feature (571)..(571): n is a, c, t, g, unknown, or other
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaaaattcttttctgctgctgcgaccgtaggatcggcgtccagcagcctcgccgcgtcggtatggttttcccttggcccacacatcctagctcttccgcattcttgaatttcgtggacgaggattaggggatttctcgtgcgctggtccaatttcgcgctaatcgtcctgtgcctgcctcggattactcgacttctcgtggtccccatctgttcttggcgttcgcacgcttgccgtgcggcgggcagggctgcagcagcagccggtagcgcgtgcatcttgcgaccccctttccagaaccagctgcaagctttggccttttccgcctgccgtacccgaaatcccgcaagaaactccacccaagaaaaaagcggcgcccttgntggctggctggctgccattcctcacgccccacggagtttgggtgaggcttatgaaacgagcacagctcacaagacagtgaggncttgcggntggggtgttttcctcgtcgggagatggnaggggaaatttggccgccgcaaaaccatgggtccccaggcggaaggcccctttcgatcttgggggcaagccgttcccaactttcgccg

SEQ ID NO: 21794 - DNA, 692 bp, Zea mays
  misc_feature: Ceres CLONE 1391184-F
  misc_feature: Encodes the peptide sequence at SEQ ID NO. 21795
  misc_feature (262)..(262): n is a, c, t, g, unknown, or other
  misc_feature (272)..(272): n is a, c, t, g, unknown, or other
  misc_feature (408)..(408): n is a, c, t, g, unknown, or other
tccccgcggtggcggccgctctagaactagtggatcccccgggctgcaggaattcgcacgagaccattacctagaacatcctaatcgaaaagctggtgcttctacggggcctggcgatttgaattcgagtggtgcgtgtatagagcgtgagagagagaaaagagagtggctcttgcgctctgcagtccagttcttgaatccagagctgcgattcgtgctcgcctgacgccgatgggccggagcctgagcccgctgctacggnaggagctggnacacctggacaaggacgctgacagcccgcgcgccgcctgaggggggttaagtcgtacgcccgaaacctggactccagtccatcccgacttccctcggcgaggttccaaaaccaccggggggcggggcgggggcccnaaaaggaattcccccccggggggaagttcccctcccgcctttaaagggggggggggggggggccccggcccaatttggggcgcaaataagaaaatttggggcccccattgggggggctccccccccgggggggggctttttctctccccacaattttttttagggggggggccccccccccggggggagataatatcccccccccccgggggggggggagagagggggtttctcccccccccctttggggtgtttttggggggggcgggggggggaggaacggg

SEQ ID NO: 21795 - protein, 74 aa, Zea mays
  misc_feature: Ceres CLONE 1391184-F
PRGGGRSRTSGSPGLQEFARDHYLEHPNRKAGASTGPGDLNSSGACIEREREKREWLLRSAVQFLNPELRFVLA

SEQ ID NO: 21796 - DNA, 645 bp, Zea mays
  misc_feature: Ceres CLONE 1391190-F
  misc_feature (326)..(326): n is a, c, t, g, unknown, or other
  misc_feature (336)..(336): n is a, c, t, g, unknown, or other
  misc_feature (348)..(348): n is a, c, t, g, unknown, or other
  misc_feature (495)..(495): n is a, c, t, g, unknown, or other
  misc_feature (499)..(499): n is a, c, t, g, unknown, or other
  misc_feature (547)..(547): n is a, c, t, g, unknown, or other
tggagctccccgcggtggcggccgctctagaactagtggatcccccgggctgcaggaattcgcacgagaccattacctagaacatcctaatcgaaaaatccaacgacccacactgagacgtcccctccccggtccgtgctctctcctctgccgccgagatgaagggatggaggggtccgccgtcttgccgccgatcgccgccttcgcgtctctcctatacgcgcggcgcttcaaccgccgttcaggtccgcagctcaggatcgtgctcacgccgcggctactggtgctgctctcagggattggcctgcgtcgttcttcgagagggncgcgccgcgnaggccactccgnaaaatcaaatctcttgttcagctcgtagggtgaaagaaatcctcaggcggggagcgaaagaggccccctacaattggggggacggaaagggcgacggggaaggcccatttggacggggttcccccccgggggtgtgtggggtttggncccnaaaaaacccatgcaaaattttttcccccggcaaaaaggctttgggccncatttattcgtcgggggcccccttttgggggggggggggggttttgcccctctaaaaagaattttttttgcccaccacaggaaaagggggtgtaaaaa

SEQ ID NO: 21797 - DNA, 660 bp, Zea mays
  misc_feature: Ceres CLONE 1391191-F
  misc_feature: Encodes the peptide sequence at SEQ ID NO. 21798
  misc_feature (471)..(471): n is a, c, t, g, unknown, or other
  misc_feature (532)..(532): n is a, c, t, g, unknown, or other
tggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaaacacctcggtaccatcgccaggtccggnaccaaggagttcatggaagcccttgctgccggcgctgatgtgtccatgattggccagttcnggggtcggtttctactctgctacctcgtcgccccataggaggtgtcgtgaccaccagcacacgatgacgagcagtaccgtgtgggagtccccagggggcggggtcgttcactgttactcgtgacacgg

SEQ ID NO: 21798 - protein, 134 aa, Zea mays
  misc_feature: Ceres CLONE 1391191-F
  misc_feature (123)..(123): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVKHLGTIARSGTKEFMEALAAGADVSMIGQFXGRFLLCYLVAP

SEQ ID NO: 21799 - DNA, 661 bp, Zea mays
  misc_feature: Ceres CLONE 1391193-F
  misc_feature (200)..(200): n is a, c, t, g, unknown, or other
  misc_feature (242)..(242): n is a, c, t, g, unknown, or other
tggagctccccgcggtggcggccgctctagaactagtggatcccccgggctgcaggaattcgcacgagaccattacctagaacatcctaatccaaaaagaggctggcgcacctgcgtcactcgctccgcgctgccgcgatctcctctgacgtcgaagtcgcccgggggatgacacagggggaaggggtggtgtgagaggntcgaacaggagctcgttgacttttgtgaggccgcctgatggnagagcgccgtctcgacacgccgtggatgaagagaatcagcgagtgggatatacgttcctaggttctgctaccttccctactgcggctcttggctctacttttcattagtagacatgtccctgctgctggttcgcatatggttccaagaggtcggtgccggaaccggagcgctgatagcttggtccatcccattttggagtgaaaaagaacagctatcctcttttaggttaggaaacgcgggccctgggatttcaaattttcagggcttttacccgctggaacggttcggtctagcccaacccgggaaaggaagttttgcggagttttgagggtgctccctttggcttgggtaggggggggggcggattcttttcactaagggtccccagggggatttaccctccgggggtggggggggg

SEQ ID NO: 21800 - DNA, 667 bp, Zea mays
  misc_feature: Ceres CLONE 1391194-F
  misc_feature: Encodes the peptide sequence at SEQ ID NO. 21801
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (491)..(491): n is a, c, t, g, unknown, or other
tggagctccccgcggtggcggccgctctagaactagtggatcccccgggctgcaggaattcgcacgagaccattacctagaacatcctaatcgaaaaaaaaaaaccaacgctccccctgcccccctctttcctccccagacccgcgctcccctccgtggcgtgcaacgcgttcctcggctcctgcaggcggcgacctcggaaaggcgggggcgtctcgtcgcgaggcatttgaggccaggattttttggtgctctcattgttagctgactggtgagggtctggatctagcaatggcggaaacacccacggtagtggtcgccacgtgcttggggacttgacaaatgttatttgcaagcgagcagccacatcagatgctggagaagagtacaggtgggataaagatcagacgggattgaaagactggggactagaaaagagtacgatgcaaatgcnnnagctagcagtattggggaaaggaattgtatttggncatttgggttggaggatgttgccagagagaaatttcaaagcattctatcttcagaaataagaagggttcaacacatagctggcggaagaagctggactcttaatccagggaagcaaatgactcgaaagaccactatgggatcaatcgggtcatttagaactccggggataaggaag

SEQ ID NO: 21801 - protein, 35 aa, Zea mays
  misc_feature: Ceres CLONE 1391194-F
  misc_feature (4)..(4): Xaa is any aa, unknown, or other
  misc_feature (5)..(5): Xaa is any aa, unknown, or other
MQMXXLAVLGKGIVFGHLGWRMLPERNFKAFYLQK

SEQ ID NO: 21802 - DNA, 856 bp, Zea mays
  misc_feature: Ceres CLONE 1391195-R
  misc_feature: SWISSPROT Homolog: EC 1.1.1.40 Malate dehydrogenase (oxaloacetate-decarboxylating) (NADP(+))
  misc_feature (713)..(713): n is a, c, t, g, unknown, or other
ccgattgggtaccgggccccccctcgaggtcgacggtatcgataagcttttttttttttttttttaggggggaagggtatgccgtatacggtacacagaaatacattgtatagaaatgaaagtatgtgtaaactcacccctctggctgcaacaaatatcacatcgaccctttattcactcacggactcaaaatttacccgtttcctttccttttgctcaggccgccgccccggccagggccctttccttaccggtagctgcggtaaatgggggtgtacatgcagctttaagcgtatttgacgagatcgtcggggcgtggcaggcggctggcaaggccaagctcgtaggccttgggggccaccttggcggcaatgcccgcggaaatggcccgaattttggtgaagggcgggaaaatgacccccttggcaaagggctcctcggggacctgctccgggagcgcctccaagggggccagcagcatgtcgtcccggacccggatggccccggaaataacaaccccaaggccaaaccccgggaaaatgtaggctttgttggactgccccggcaccagcaccttgccgtcaagctccacgttttcaaaggggctgccgcttgcgaacaccgcggggccctgggtcaaggtgtaggcctgctccgccgggcactccgagtgagagttcgggttctacagcgcgaagatgaccggcttctcnttctgggacgccttcgcctccaccacctccttggtgaaggtgccgcccttgcccgaggtgccaataaaaaccttcgggctcagggaatgcacggcctccaccagggtcgccacggggctcgggctcgtgcgcccatgacttct

SEQ ID NO: 21803 - DNA, 595 bp, Zea mays
  misc_feature: Ceres CLONE 1391197-F
  misc_feature: Encodes the peptide sequence at SEQ ID NO. 21804
  misc_feature (157)..(157): n is a, c, t, g, unknown, or other
  misc_feature (158)..(158): n is a, c, t, g, unknown, or other
  misc_feature (174)..(174): n is a, c, t, g, unknown, or other
  misc_feature (312)..(312): n is a, c, t, g, unknown, or other
  misc_feature (336)..(336): n is a, c, t, g, unknown, or other
  misc_feature (453)..(453): n is a, c, t, g, unknown, or other
  misc_feature (460)..(460): n is a, c, t, g, unknown, or other
  misc_feature (472)..(472): n is a, c, t, g, unknown, or other
aaagctggagctccccgcggtggcggccgctctagaactagtggatcccccgggctgcaggaattcgcacgagaccattacctagaacatcctaatcaaaagcccacacgttgaaggcacctagcagccgccactcgccgaactgaggaacacgccnngggcgacgggatacangcagcagcgcgcccctctctatcctcgacgcgacggcgccctgcagctgcagataaacctgttccaatggccaaacaaaaagagggtgtggacaaaagaactgctaggaagatgatccgatctacggaaggctgtgcnaagagcattactttcgagaggaancacaaatcagacgctgtgcagcttcacgatctggcgaatgacatcctaggtagcatactatcacggttgacattcagagaatcctcacagatgggccttggttctcatacctggcgncggctgnggagaaactggntgccggaaactggtctttcaccggggccaccatggtccaacccgggaatagggagcatcaaacttaccagggaccacttttggcatgaaaagccacaggtttcttgggggcaggtacccaccc

SEQ ID NO: 21804 - protein, 118 aa, Zea mays
  misc_feature: Ceres CLONE 1391197-F
  misc_feature (32)..(32): Xaa is any aa, unknown, or other
  misc_feature (74)..(74): Xaa is any aa, unknown, or other
  misc_feature (78)..(78): Xaa is any aa, unknown, or other
MAKQKEGVDKRTARKMIRSTEGCAKSITFERXHKSDAVQLHDLANDILGSILSRLTFRESSQMGLGSHTWRRLXRNWXPETGLSPGPPWSNPGIGSIKLTRDHFWHEKPQVSWGQVPT

SEQ ID NO: 21805 - DNA, 642 bp, Zea mays
  misc_feature: Ceres CLONE 1391199-F
  misc_feature: Encodes the peptide sequence at SEQ ID NO. 21806
  misc_feature (419)..(419): n is a, c, t, g, unknown, or other
  misc_feature (496)..(496): n is a, c, t, g, unknown, or other
aaagctggagctccccgcggtggcggccgctctagaactagtggatcccccgggctgcaggaattcgcacgagaccattacctagaacatcctaatcgaaaaatccgatttcgattcgatttgccggcggtgcccgcggcggagaggatggcgagctccttctccttcccgctgatgaatccggcggacattgcggaggcgctgcacagctactgcatcgcgcccagccccggcctccgcgccgagcacatcgtcaccccgcagcccggcctcgtcgccgaggtcctcgccctcttcctcgccaacttcgtcggcgacgacgagcccgacgagcagctagagtttcaggcgctgcaggcgatcgacaacccggagcaccacatgcgcgccatagcgctctcgcgcctctacgggagggncaacgccttccctcactccatcctcttccggggactcacgctccgcgaccttctcccgcgcgacggccgccgtgtcntctacatcctcagcggcataatcaacttcctccactacaggcaggataagctcagctttcttgagcccatcgtccaagagtacagcccccttcaggaacggcacacggagctcagggctaagatcggcgagcttcggaacgcaaaa

SEQ ID NO: 21806 - protein, 165 aa, Zea mays
  misc_feature: Ceres CLONE 1391199-F
  misc_feature (2)..(147): Pfam Name: Nuf2 Pfam Description: Nuf2 family
  misc_feature (91)..(91): Xaa is any aa, unknown, or other
  misc_feature (117)..(117): Xaa is any aa, unknown, or other
MASSFSFPLMNPADIAEALHSYCIAPSPGLRAEHIVTPQPGLVAEVLALFLANFVGDDEPDEQLEFQALQAIDNPEHHMRAIALSRLYGRXNAFPHSILFRGLTLRDLLPRDGRRVXYILSGIINFLHYRQDKLSFLEPIVQEYSPLQERHTELRAKIGELRNAK

SEQ ID NO: 21807 - DNA, 644 bp, Zea mays
  misc_feature: Ceres CLONE 1391200-F
  misc_feature: Encodes the peptide sequence at SEQ ID NO. 21808
  misc_feature (599)..(599): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaacttgttcttcttcccaaccagcgtgtggtccctcttcctcttccccttctctctcggggacgactgggtggtcgtatctgcctccatacgcctggcgccctgctcttcttcgggacattcgccggccgcgagcaccaccaaaagggacagcttcccagatagagaaacatattctccgtactctaacagatggagaggataaagcctaagcaattgctaatccagagcagaacaaagaaggctccatctcgaatcagctactctactatcatcacatggaacttgattgtcatattgtgtgagctatctctctatgctacctacagccattgacatcaaacgtctacccaagacttcgaaatggagcttcatgaagcttaccttgctgagagcacggaggatccaaaaatgataagtacatcaatatatgcggaaatgaccccgcaagatgcccaattactataaaatatacaatgatgcttctgctgaacgtgggnatagatttatcaacttgtgcaggattcatngtttcaaggaatggc

SEQ ID NO: 21808 - protein, 47 aa, Zea mays
  misc_feature: Ceres CLONE 1391200-F
  misc_feature: SWISSPROT Homolog: EC 5.2.1.8 Peptidylprolyl isomerase
MERIKPKQLLIQSRTKKAPSRISYSTIITWNLIVILCELSLYATYSH

SEQ ID NO: 21809 - DNA, 659 bp, Zea mays
  misc_feature: Ceres CLONE 1391203-F
  misc_feature: Encodes the peptide sequence at SEQ ID NO. 21810
  misc_feature (481)..(481): n is a, c, t, g, unknown, or other
  misc_feature (617)..(617): n is a, c, t, g, unknown, or other
aaagctggagctccccgcggtggcggccgctctagaactagtggatcccccgggctgcaggaattcgcacgagaccattacctagaacatcctaatcaaaacaaattcaaataactcggccgcaggcagcatccgcggagacgcggagcctccattccccgtctggcttcctcctctggatctagccgacgccgccctcaccctgtcacccaccgacgtcgccgtcgccacctatatcacccaccgcctctgaagaagaagacgcggatccgagggtagttaactgctgaagaagaagagccggtacggagaagacgcggagcagtacgtctccgatctggatgttggtaaggttcatcctgatttgaacggcaagctcactgataacgagttcctgggagggggaagctagacgatttctgttagaggaggaagaagaggatgatgaactcttcttagtacttgtccctgctattctctncggcatgcaagaagagaaaaagagcatagtagcatctgctgttgaaccggtgcaacatgtaccaagagagggcagcgagatcaatggtgctggaccaagtgtgggcagcgagactaatggtgatggactaatggtngatcagaaggctggtgaagttcagtcaccacctttctgtacg

SEQ ID NO: 21810 - protein, 58 aa, Zea mays
  misc_feature: Ceres CLONE 1391203-F
MQEEKKSIVASAVEPVQHVPREGSEINGAGPSVGSETNGDGLMVDQKAGEVQSPPFCT

SEQ ID NO: 21811 - DNA, 668 bp, Zea mays
  misc_feature: Ceres CLONE 1391205-F
  misc_feature: Translation starting site: 232
  misc_feature (241)..(241): n is a, c, t, g, unknown, or other
  misc_feature (273)..(273): n is a, c, t, g, unknown, or other
  misc_feature (277)..(277): n is a, c, t, g, unknown, or other
  misc_feature (399)..(399): n is a, c, t, g, unknown, or other
aagctggagctccccgcggtggcggccgctctagaactagtggatcccccgggctgcaggaattcgcacgagaccattacctagaacatcctaatcaaaaccctccactcgcctccaaatcttctctctcctttcctcctctcgtctcaccgcatcacctctccctccggcgcgcgcgtccgggtacagcgctagagtcactcaccaccatgcaggcggcggcggcggcgaatggcgcggncgacgtgcaaaagcctcagcagcaacgctggntggncgggggcgccgcccccaccgccgccggcggccgtggtgccgccccattgggtcgccatgccgttcgcaccgcctcccggggccgcggccatggtgatgcaggcgcaccatatggcgcctccnccgccgcagttcgcgccgactcacttcgtggcgttccacgccgtcgggcccgcgcgggcacagtcggtgccagcagcggtcgcactgggttccccggcggcgcatcagcccgggggaggagggagacaaggagggtcggggtcggcgacctccattactggatggacgaaaactacctaaccagttgggttcggtacaaccgggggaggttgggggggatcaaagtaatcccgcaacaagcaaactgggcaggccaaagggaaacgggt

SEQ ID NO: 21812 - DNA, 656 bp, Zea mays
  misc_feature: Ceres CLONE 1391206-F
  misc_feature (529)..(529): n is a, c, t, g, unknown, or other
  misc_feature (622)..(622): n is a, c, t, g, unknown, or other
aaagctggagctccccgcggtggcggccgctctagaactagtggatcccccgggctgcaggaattcgcacgagaccattacctagaacatcctaatcgaaaaccccaaccccgttcttctccctccgtccgaccgtccctcgacagtgccgaggcgcaacctagcagccgcccacgcggcgcgacatccactggcgcaagcgcaatccgcaagggccccccggcgcgccgccagcctcctggctcggccgcccccgcggctaacccaggggcggaaaggccggccagccgcccacaccccatccggccagccaggcggaaacgaccgtaagagggaagccgcagccggccgctgactccgatcccacctctagtcaaccccaggcagaccgatcctcttcgtctgaccacgacgtccatctcgcacgcctacttccactcaaccacataagtcttttctggcaggcctaacctttcccctgcgcccgctctactgtttttgcacagtgccgtgacgtgggaagacgtgnagatccaacgaaaattagatttatttcttcctttctcggtccacaggttcctcagcttgcgtaagatccgtctgggttgtccgccctccatgnactacccagggtgcgcgcatccacccagtggaag

SEQ ID NO: 21813 - DNA, 653 bp, Zea mays
  misc_feature: Ceres CLONE 1391207-F
  misc_feature: Encodes the peptide sequence at SEQ ID NO. 21814
  misc_feature (296)..(296): n is a, c, t, g, unknown, or other
  misc_feature (301)..(301): n is a, c, t, g, unknown, or other
  misc_feature (304)..(304): n is a, c, t, g, unknown, or other
aaagctggagctccccgcggtggcggccgctctagaactagtggatcccccgggctgcaggaattcgcacgagaccattacctagaacatcctaatcgaaaaaaaacaaattagatagagctcgccgagcaagcaagcaagccaactcggccgtccgaacgaaagcgaagcgcggccaaactcactcgctaaacgctcccgttctcctccgcctgcccccaccggctccccttgtacacgagcgccggagacgccatggcggcggcgcagccgaagccggccaagaggctgggcgncatgncgnaggcgctcgccatcgccgccgacctcggattccccgcctctaccacgcaggaagatcagactagctccgacaaaagcgatgatttggtgaaggttttgagggaactgactgtcgtgcagaggaacattgccaacttgcaagtggagctacagggaaaaaaggatgataaaaacattgctcatttgactcatgtgagtgagatggaaaagaatgcgagtctttgggcaaaatgactgccatttggaaagaagaattcagacaaggctcggattattggtcggctgaaacggcctatccccttgacgcaaaccagtcgaaagcgacctaccgaaggattttcggagctctt

SEQ ID NO: 21814 - protein, 93 aa, Zea mays
  misc_feature: Ceres CLONE 1391207-F
  misc_feature (14)..(14): Xaa is any aa, unknown, or other
  misc_feature (16)..(16): Xaa is any aa, unknown, or other
  misc_feature (17)..(17): Xaa is any aa, unknown, or other
MAAAQPKPAKRLGXMXXALAIAADLGFPASTTQEDQTSSDKSDDLVKVLRELTVVQRNIANLQVELQGKKDDKNIAHLTHVSEMEKNASLWAK

SEQ ID NO: 21815 - DNA, 606 bp, Zea mays
  misc_feature: Ceres CLONE 1391212-F
  misc_feature: Encodes the peptide sequence at SEQ ID NO. 21816
  misc_feature (302)..(302): n is a, c, t, g, unknown, or other
  misc_feature (311)..(311): n is a, c, t, g, unknown, or other
  misc_feature (314)..(314): n is a, c, t, g, unknown, or other
  misc_feature (315)..(315): n is a, c, t, g, unknown, or other
aaagctggagctccccgcggtggcggccgctctataactagtggatcccccgggctgcaggatttcgcacgagaccattacctagaacatcctaatcaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccaaggtccgacagcaacgacttcgtcgagctgctatgggagaacggccaggcggtggtgcacggnaggagaaancannatccccaggccgccttcccgcccttcacctgcggcgcggccagcagcagtagagctcaaaaaaccagccgggtactaccgacccggtctcgttgttcaagacgggaggcctcttccccgacttctcgtccggcctagaccccccccgtggcaaggttgacctttacaaaccgtgccctgaatcactggcccctcgtcaaagaaaaaagggccgcaaccccacctggccttgggggagggctaccccccaaattttcttctcggacttccctgcacccgccttaccaacggc

SEQ ID NO: 21816 - protein, 31 aa, Zea mays
  misc_feature: Ceres CLONE 1391212-F
  misc_feature (11)..(11): Xaa is any aa, unknown, or other
  misc_feature (14)..(14): Xaa is any aa, unknown, or other
  misc_feature (15)..(15): Xaa is any aa, unknown, or other
MGERPGGGARXEKXXSPGRLPALHLRRGQQQ

SEQ ID NO: 21817 - DNA, 665 bp, Zea mays
  misc_feature: Ceres CLONE 1391213-F
  misc_feature: Translation starting site: 202
  misc_feature: SWISSPROT Homolog: EC 3.6.3.14 H(+)-transporting two-sector ATPase
  misc_feature (529)..(529): n is a, c, t, g, unknown, or other
  misc_feature (539)..(539): n is a, c, t, g, unknown, or other
  misc_feature (540)..(540): n is a, c, t, g, unknown, or other
  misc_feature (543)..(543): n is a, c, t, g, unknown, or other
  misc_feature (647)..(647): n is a, c, t, g, unknown, or other
  misc_feature (648)..(648): n is a, c, t, g, unknown, or other
  misc_feature (655)..(655): n is a, c, t, g, unknown, or other
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcgaaaaaaacccaatccatccaaacccatttccctcgctcccatcccgtcccgccccttgtctcttccgcttccccccgaccccgcgcgccgcggaccagcagccatgtcgtgctcccacctctccaccgcctggtcctcctcggcgctcgccagcagcgcctccaccacccgacggcgctcccccccgcgctcgggtctcctggtgcggtgttccctccgtgagctccgcacccgcatcgactccgtcaggaacacgcagaagatcacggaggccatgaagctggtggccgccgccaaggtccggcgcgcgcaggaggccgtcgtctcctctcgccctttctcggaggcgctgggtggaggtgctctacaacatgaaccaggagatccagacggaggacatcgacctgcccctcacccgcacccgccccgtnaagaagtggnnccntcgtggtcctgaccggctagcgcggccctctggcggagcttcaacaacaacgtggctcaggaaggcggaaccccgcatcgatgagctcaagcagctgggctcanntacacgnnctcgggggg

SEQ ID NO: 21818 - DNA, 671 bp, Zea mays
  misc_feature: Ceres CLONE 1391214-F
  misc_feature: Encodes the peptide sequence at SEQ ID NO. 21819
  misc_feature (558)..(558): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (572)..(572): n is a, c, t, g, unknown, or other
  misc_feature (574)..(574): n is a, c, t, g, unknown, or other
  misc_feature (578)..(578): n is a, c, t, g, unknown, or other
  misc_feature (580)..(580): n is a, c, t, g, unknown, or other
aaagctggagctccccgcggtggcggccgctctagaactagtggatcccccgggctgcaggaattcgcacgagaccattacctagaacatctaatccaaaaaaaattaaaacgcacactactattccgcaacagcaaggctcagaaacatggctccaccacatctgttccggctcccgcctctcctcatcctcctcgtgatcgtgcctctgttccccaccgccgcgccgacggacactacgctgacgctgtaccgccacctatcgcacgtaggcgaggctcgtggctatcgcaccaccatcacccgatgtcccgcctggccgtcgagacactagcccgcgcgttgcacctcacgcgccgggacaccaaccaccacagccagaaaggatcaggtgaacacccgtcaataccagccaccgtcgagctgtacccgacgtcctagtgtggatacaccttcagggtgtctctcgggacgtcggcgcagccactcttcgtgctgctcgacacctcagcacccctccacgtgggagcatgcactcaaggctacgagatgcgcaantgctctnnnccatncnactncngggggccttgtttttcacccttaggactcctctctccccccacctcggggggttgccgaacccttttcggggcggggggtccattcgtgcc

SEQ ID NO: 21819 - protein, 44 aa, Zea mays
  misc_feature: Ceres CLONE 1391214-F
MSRLAVETLARALHLTRRDTNHHSQKGSGEHPSIPATVELYPTS

SEQ ID NO: 21820 - DNA, 662 bp, Zea mays
  misc_feature: Ceres CLONE 1391217-F
  misc_feature (337)..(337): n is a, c, t, g, unknown, or other
  misc_feature (354)..(354): n is a, c, t, g, unknown, or other
  misc_feature (394)..(394): n is a, c, t, g, unknown, or other
  misc_feature (427)..(427): n is a, c, t, g, unknown, or other
  misc_feature (454)..(454): n is a, c, t, g, unknown, or other
  misc_feature (496)..(496): n is a, c, t, g, unknown, or other
  misc_feature (646)..(646): n is a, c, t, g, unknown, or other
  misc_feature (658)..(658): n is a, c, t, g, unknown, or other
aaagctggagctccccgcggtggcggccgctctagaactagtggatcccccgggctgcaggaattcgcacgagaccattacctagaacatcctaatcgaaaacttcctcacggctgctgctgccctgccctgccctggagtaaggaagccgacaccacttggagttgctgccaactaccgggctcggctgtcaaattctctatctggcagccagcccgtgtccaattccaactccaccggtggtaaaccatcgacagcaggagcagggagggcaggctgcacaagaaaagagcatcattcctgctgatcggctcggctccactccaccccgaataanatggcttccttctcggnacatctccaccgcctcctgtccgccatggccgtggccgcnttcgcccgcgtctcctccacgagcttcccgacnagctgtcccaccacaggcttcctgatngcagcacaggcacggacgcgctcgcctcgcttcattgaccangtcagatgttcccgcagcgcctttcgcatctgccctttctggcgcgcagctattggccacggacctccacagcttgcgtctgctgaagcgccccttcgggtctgtgccggtcatgggcaacggtgtaacagtacgcccactttgcaaaanctcgggacagcncgat

SEQ ID NO: 21821 - DNA, 662 bp, Zea mays
  misc_feature: Ceres CLONE 1391220-F
  misc_feature: Encodes the peptide sequence at SEQ ID NO. 21822
  misc_feature (521)..(521): n is a, c, t, g, unknown, or other
  misc_feature (545)..(545): n is a, c, t, g, unknown, or other
  misc_feature (566)..(566): n is a, c, t, g, unknown, or other
  misc_feature (575)..(575): n is a, c, t, g, unknown, or other
  misc_feature (622)..(622): n is a, c, t, g, unknown, or other
aagctggagctccccgcggtggcggccgctctagaactagtggatcccccgggctgcaggaattcgcacgagaccattacctagaacatcctaatcgaaaaaatgtcaaatctctcgcgagcgaggcagacccacgggccgcggccatctcacggtggaagcagccaagcagccggcctggcgcccctccccttccgtcccgccgctgctgccgtgcctcgtgcctgccagcggcggatgccgccccgccccgctgctgaccaccgccgctgctgagcatggccgccgctcccgcgggcgctcagaaccgctgcgtcttcgttggcaacataccatatgatgcgacggaggagcagctcgtgcagatttgcgaagaagtcggcccagtcgtatccttcagattggtgattgacaaagagaccggcaagccaaaaggttatggcttttgcgagtacaaggatgaggaaactgctttaagtgcacgccggaaccttcagggttacgagattaatggtcgtcangtacgtgttgattttgctgaaagntggaggacactgatagaatanagaaaaggntcgtgggaggaccaggatggcatctaatggtgataggcaaaaacggntagctgggactttctggttgtggagagacaactttcattc

SEQ ID NO: 21822 - protein, 107 aa, Zea mays
  misc_feature: Ceres CLONE 1391220-F
  misc_feature (13)..(84): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (81)..(81): Xaa is any aa, unknown, or other
  misc_feature (89)..(89): Xaa is any aa, unknown, or other
  misc_feature (96)..(96): Xaa is any aa, unknown, or other
MAAAPAGAQNRCVFVGNIPYDATEEQLVQICEEVGPVVSFRLVIDKETGKPKGYGFCEYKDEETALSARRNLQGYEINGRXVRVDFAEXWRTLIEXRKGSWEDQDGI

SEQ ID NO: 21823 - DNA, 679 bp, Zea mays
  misc_feature: Ceres CLONE 1391224-F
  misc_feature (388)..(388): n is a, c, t, g, unknown, or other
  misc_feature (389)..(389): n is a, c, t, g, unknown, or other
  misc_feature (486)..(486): n is a, c, t, g, unknown, or other
  misc_feature (501)..(501): n is a, c, t, g, unknown, or other
  misc_feature (543)..(543): n is a, c, t, g, unknown, or other
  misc_feature (547)..(547): n is a, c, t, g, unknown, or other
  misc_feature (548)..(548): n is a, c, t, g, unknown, or other
  misc_feature (586)..(586): n is a, c, t, g, unknown, or other
aaagctggagctccccgcggtggcggccgctctagaactagtggatcccccgggctgcaggaattcgcacgagaccattacctagaacatcctaatcgaaaaagttcagtggcgccgtcgtgcctcgacgacggcgggagaccccgcaagcaggtgagagtgagacgggcggtgactagcgggcgcttaggccgacatcggccccgcagcggcggggtagggtgcgtcgacacgcgggactgcgacttgggggggattgattcccttcgctgttctctcttctccggcgcgtgcgcgcgggatcgaaggtagggtttgggccccaaagttcgtgtctttggggacagcggcggcgatggactacaccaacgccatccacatcatccgnngacgccgcgggccccgacgcggggcccaaggggcgggggggtcggccggcgggcggccgacgcccagcatctggggccaccggagtacgactacccnccaggtggagcgccngaaccagggctacgggcgaccgggacccccctcgtcgcgggncggnngagcggagcagcccgccgccgcgggcagaaaggctcgngggcgggggggcggcggcagcgatagcggggcggcgggtggcaggacggagcaagtcgcgccgccattgggcaaagatgttccttcaagaccc

SEQ ID NO: 21824 - DNA, 653 bp, Zea mays
  misc_feature: Ceres CLONE 1391229-F
  misc_feature: Encodes the peptide sequence at SEQ ID NO. 21825
  misc_feature (485)..(485): n is a, c, t, g, unknown, or other
tggagctccccgcggtggcggccgctctagaactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgccatggccaccacgttgcacaagcccctgggggcgatcaccgttgacgacctcgccgcggcggcgcctgggtcggacgccaccgcgctccacgcagcgctccggcgcgcgctcgactcgcacggacccaccgaagtgtggggcgagctctgccggtccgtgctctgtccgtctgtccccttcgccgtccaccggatgctctactacggttgcttcgcccggttcccgtctcccacgcccgccgctggacgcccgaccccaaggaggctgtcttgaccaatgtcgggcgtgtcctcgaggcgcgtgntagggacttcatcggcgacgcgtacaaggatccccatcacagcttcccagaccctcccacagtctccaacgagaacccagaagcgtactggaaagatgtatttggaggatatggtatccaattcagcgtagaagcatcctgcatctggagagagacactgcatatccg

SEQ ID NO: 21825 - protein, 90 aa, Zea mays
  misc_feature: Ceres CLONE 1391229-F
MATTLHKPLGAITVDDLAAAAPGSDATALHAALRRALDSHGPTEVWGELCRSVLCPSVPFAVHRMLYYGCFARFPSPTPAAGRPTPRRLS

SEQ ID NO: 21826 - DNA, 660 bp, Zea mays
  misc_feature: Ceres CLONE 1391230-F
  misc_feature: Encodes the peptide sequence at SEQ ID NO. 21827
tggagctccccgcggtggcggccgctctagaactagtggatcccccgggctgcaggaattcgcacgagaccattacctagaacatcctaatcgaaaaagggaagaaaatacaatcgctgaaaccagatgtccaacggatgactggaactcctgtcagtttgcactgagcaatggttcatccattctcaataaccacagtgctccacaggatagcctcacttatggagataatgatctaaactacattgattggcctggcattgacaattttgaggatgttgacacattattcaggagatctgatttcacatatgatccgcagcagctggagaatacagatgggttatcttggcttccttcttcagatgctgtttactcttctgatgttgctttgcagcaagggtttgactcgtcttattccgattatgatattctggatgatctctcagcattccaatgtgcagaagataaatcactaccctcagttggtccttcatcggatttatgtgataatcaattcaatgatacctatctgttcagtgagcagaagaatgcgaatgcatatggtgaacagatataccaagaggatgtggatggagttgttgcccactgaccagatatgcagtggacatgaaacatttgatatgggtggaaaacagt

SEQ ID NO: 21827 - protein, 203 aa, Zea mays
  misc_feature: Ceres CLONE 1391230-F
GAPRGGGRSRTSGSPGLQEFARDHYLEHPNRKREENTIAETRCPTDDWNSCQFALSNGSSILNNHSAPQDSLTYGDNDLNYIDWPGIDNFEDVDTLFRRSDFTYDPQQLENTDGLSWLPSSDAVYSSDVALQQGFDSSYSDYDILDDLSAFQCAEDKSLPSVGPSSDLCDNQFNDTYLFSEQKNANAYGEQIYQEDVDGVVAH

SEQ ID NO: 21828 - DNA, 663 bp, Zea mays
  misc_feature: Ceres CLONE 1391231-F
  misc_feature: Translation starting site: 166
  misc_feature: Pfam Name: Complex1_51K Pfam Description: Respiratory-chain NADH dehydrogenase 51 Kd subunit
  misc_feature: SWISSPROT Homolog: EC 1.6.99.5 NADH dehydrogenase (quinone)
aaagctggagctccccgcggtggcggccgctctagaactagtggatcccccgggctgcaggaattcgcacgagaccattacctagaacatcctaatcgaaaagatctccccaatccgaccagaccggcaggcaccttcgactcgagcggagcaggcgaggcagagatggcgctgcgacgggcgctcctcagatcggtcaacttctcccccgacagcaaggctgcaattgagtacttttattctttctcaagggcacagtctgcttgttctctcaatggtgctggtctttgtcctgctagtagatcatttagcacccaggctgccactacgtcaagcacaccacagcctccacctccaccaccccctccagagaagactcactttggtggtctcaaagatgaggatcgcattttcaccaacctctatggtctgcatgacccttttctgaaaggcgcggtgaagagaggtgactggtataggaccaaggatttggtgattaagggggcagactggatagttaatgaaatgaagaaatcaggtcttcggggtcgtgggaggtgcaggttttccctctggtctgaaatggtcctttatgggccaggtttctgatggacgccttccttatcttgttgttatggctgatgagagtgagcctgggacttg

SEQ ID NO: 21829 - DNA, 636 bp, Zea mays
  misc_feature: Ceres CLONE 1391232-F
  misc_feature (298)..(298): n is a, c, t, g, unknown, or other
  misc_feature (301)..(301): n is a, c, t, g, unknown, or other
  misc_feature (302)..(302): n is a, c, t, g, unknown, or other
  misc_feature (366)..(366): n is a, c, t, g, unknown, or other
  misc_feature (368)..(368): n is a, c, t, g, unknown, or other
  misc_feature (369)..(369): n is a, c, t, g, unknown, or other
  misc_feature (373)..(373): n is a, c, t, g, unknown, or other
  misc_feature (375)..(375): n is a, c, t, g, unknown, or other
  misc_feature (376)..(376): n is a, c, t, g, unknown, or other
  misc_feature (391)..(391): n is a, c, t, g, unknown, or other
  misc_feature (392)..(392): n is a, c, t, g, unknown, or other
aaagctggagctccccgcggtggcggccgctctagaactagtggatcccccgggctgcaggaattcgcacgagaccattacctagaacatcctaatcgaaaaatccaaaattccccaaaccccctcccaagtcccaaccctagccggctagcctccttccccttcagccttcacacctccgatttctcgcgccttcgtctcccgcccaatttccagaagcttctagaaccaggtttctaaccctaccgcagaatgatgctttcttgcgcctagtagcctggggcggaggcatggacgncgnncgggagggggctcgagcgggcggaggtccctatttctgcagcgaacaggaccccgagtcaattngnnagtngnnacgtgcagagcctcnnagatacctgctcagatctgctaggggagtctccggggagacgggcccactctgtcaactggcggagcgggttatactccagggatcgtcaagggacagaagaggtgggagacttgactcgtggggcttccggggtaaagtcccttcgaaaagaacgggacaactggaaatggtcactagtaaacaaaacacttaaattttcccgggaaaaaatgatttttatggggtaaagggtgcccagggaa

SEQ ID NO: 21830 - DNA, 657 bp, Zea mays
  misc_feature: Ceres CLONE 1391236-F
  misc_feature: Encodes the peptide sequence at SEQ ID NO. 21831
  misc_feature (487)..(487): n is a, c, t, g, unknown, or other
  misc_feature (561)..(561): n is a, c, t, g, unknown, or other
  misc_feature (579)..(579): n is a, c, t, g, unknown, or other
  misc_feature (612)..(612): n is a, c, t, g, unknown, or other
aaagctggagctccccgcggtggcggccgctctagaactagtggatcccccgggctgcaggaattcgcacgagaccattacctagaacatcctaattgaaaacttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcaacggattttgaggttgatggcatcgacaacctcagcgagaacgatgtcagcgactaggagatcgatgctgacgagctcgcccgacgnaatgtggaaggacaagggtcagctaaagaggatcaggggagaggcagcagaagcttgccctgcaggggctggangctggagaagacaagacnaaggaagtttcagaccaagccctccggaagaangatgacaggggccccaggacgggatcctcaagtactgtcagggtg

SEQ ID NO: 21831 - protein, 34 aa, Zea mays
  misc_feature: Ceres CLONE 1391236-F
MLDHLAIIASELGDDATDFEVDGIDNLSENDVSD

SEQ ID NO: 21832 - DNA, 667 bp, Zea mays
  misc_feature: Ceres CLONE 1391237-R
  misc_feature: Pfam Name: Vps5 Pfam Description: Vps5 C terminal like
cgattgggtaccgggccccccctcgaggtcgacggtatcgataagcttttttttttttttttttatttttttttttttttttttttttttttttttttttttttttttttttttttttttcaaggggggcttgttcttaacacttagcacttgaaaacaagtccccaacagttgccgttggatgttggagcaaattaaatagatcaaaaccaacttttctacactccctatacgtacatcatctgccccggtttgcatatacttctgtttcccccgttacctttgtccacatgttagcaaaatggcccgaataaaacacctgagttatcacaaaacctttcagcatctcgatgaaatcggggcgtctttccttgtcaaatctttttatttcaaaattgtggttttccttaacactttcatattccctaactgcatcacttttggctgcttccgctgatcttattgtttctttcaacccctctactttctgatatgttgaccactcatgccccatatctcttgctgacgacgattcaagtctccttgccctgatatgcaaggaaaacaaatctgctgacagactttgcacgtaatgtaaagcattaaagcgatcagtaaatgcatgatgaactgatatcatcatctccaaatattcagggatgctacc

SEQ ID NO: 21833 - DNA, 692 bp, Zea mays
  misc_feature: Ceres CLONE 1391241-F
  misc_feature: Encodes the peptide sequence at SEQ ID NO. 21834
  misc_feature (273)..(273): n is a, c, t, g, unknown, or other
  misc_feature (285)..(285): n is a, c, t, g, unknown, or other
  misc_feature (331)..(331): n is a, c, t, g, unknown, or other
  misc_feature (340)..(340): n is a, c, t, g, unknown, or other
  misc_feature (342)..(342): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (354)..(354): n is a, c, t, g, unknown, or other
  misc_feature (355)..(355): n is a, c, t, g, unknown, or other
  misc_feature (448)..(448): n is a, c, t, g, unknown, or other
aaagctggagctccccgcggtggcggccgctctagaactagtggatcccccgggctgcaggaattcgcacgagaccattacctagaacatcctaatcgaaaagatctccccaatccgaccagaccggcaggcaccttcgactcgagcggagcaggcgaggcagagatggcgctgcgacgggcgctcctcagatcggtcaacttctcccccgacagcaaggctgcaattgagtacttttattctttctcaggggcacagtctgcttggtctctncatggtgctggntcttgtcctgctagtagatcatttagcacccaggctggcactacgntcaggaaananagnnnctcactnncacacccccctcagaagagactcacgttggtggcctcaaagatgaggatcgcattttcaccaactcctagggctgcatgaccttttctgaaanggcccggtaaaaaaagggactgttatagacccaaggttttgggggtaaggggggcaaacgggaaaataaaggaaggaaaaaaccggtctcgggggcgggagaggggggggttttcccccggggggggaaaggggccttttggcccaggggtttggggggaccccttttaaatttgggggtaaaagggggagaaaaggggccccctcctcttcaaaaaaaaaaaaaaatccgggccaccccccca

SEQ ID NO: 21834 - protein, 89 aa, Zea mays
  misc_feature: Ceres CLONE 1391241-F
  misc_feature (56)..(56): Xaa is any aa, unknown, or other
  misc_feature (59)..(59): Xaa is any aa, unknown, or other
  misc_feature (60)..(60): Xaa is any aa, unknown, or other
  misc_feature (61)..(61): Xaa is any aa, unknown, or other
  misc_feature (64)..(64): Xaa is any aa, unknown, or other
MALRRALLRSVNFSPDSKAAIEYFYSFSGAQSAWSLHGAGSCPASRSFSTQAGTTXRKXXXSLXHPPQKRLTLVASKMRIAFSPTPRAA

SEQ ID NO: 21835 - DNA, 624 bp, Zea mays
  misc_feature: Ceres CLONE 1391243-F
  misc_feature: Encodes the peptide sequence at SEQ ID NO. 21836
  misc_feature (333)..(333): n is a, c, t, g, unknown, or other
  misc_feature (348)..(348): n is a, c, t, g, unknown, or other
  misc_feature (443)..(443): n is a, c, t, g, unknown, or other
  misc_feature (499)..(499): n is a, c, t, g, unknown, or other
  misc_feature (512)..(512): n is a, c, t, g, unknown, or other
  misc_feature (529)..(529): n is a, c, t, g, unknown, or other
  misc_feature (624)..(624): n is a, c, t, g, unknown, or other
aagctggagctccccgcggtggcggccgctctagaactagtggatcccccgggctgcaggaattcgcacgagaccattacctagaacatcctaatcgaaaaaccagacgccagtccaccaccgcttcccgtgcagcgccctccctctacgttcccccatttcctgtgttggcggcgatggcgcggcacttcgtgctcaacaccggcgccaagatcccctccgtggggctcggcacctggcagtctgaccccggcgtcgttggcaacgctgtctacgccgccgtcaagggcggttaccgacatatcgattgtgccagagtttacggcaacgaanaggagattggtttgncgctgaagaagctatttgaagaaggtgtagtgaagcgagaagatctgtttatcaccctctagctatggaatgatcatcatgctcctgaagatgtngctgaggcactaaatgacagcctgaatgatttgcagcttgagtacctggatctttnatctatccatggnccatttagagtcaaggngggaacaaataccagccccctgaaaatttgtacacctgacttccctgctactgggggggcaatggaaaaggtatatgatggctgcaagctcgcgn

SEQ ID NO: 21836 - protein, 77 aa, Zea mays
  misc_feature: Ceres CLONE 1391243-F
  misc_feature: SWISSPROT Homolog: EC 1.1.1.21 Aldehyde reductase
  misc_feature (53)..(53): Xaa is any aa, unknown, or other
  misc_feature (58)..(58): Xaa is any aa, unknown, or other
MARHFVLNTGAKIPSVGLGTWQSDPGVVGNAVYAAVKGGYRHIDCARVYGNEXEIGLXLKKLFEEGVVKREDLFITL

SEQ ID NO: 21837 - DNA, 655 bp, Zea mays
  misc_feature: Ceres CLONE 1391244-F
  misc_feature: Encodes the peptide sequence at SEQ ID NO. 21838
  misc_feature (340)..(340): n is a, c, t, g, unknown, or other
  misc_feature (427)..(427): n is a, c, t, g, unknown, or other
  misc_feature (603)..(603): n is a, c, t, g, unknown, or other
aaagctggagctccccgcggtggcggccgctctagaactagtggatcccccgggctgcaggaattcgcacgagaccattacctagaacatcctaatcgaaaagcaggacaggagaagcttgggtctcctatcctccccacccctctctcggtctcttccccaccgcttcttcgtcgtctcgtcttcctgcctccttcgcccgagaaaggagagaatggggagcagcgagaagaccgttaccgcttacggcgagtacacctacgctgagctggagagggagccctactgggccgagtgagaagctgaggatttcgattactggggctggtggtttcattgnatcccacattgctcgccgtctgaagaacgagggccattacatcattgcctctgactggaagaagacgagcacatgaccgaggacatnggtctgcatgagttccacctcgttgatctcagggtcatggacaactgtctcaaggtcacccatgggtgtcgacatgtctttcatcttgctgcagatatgggtggcatggggttcatccaggcaaatcactctgtgatcatgtacaacaacaccatgatcagttttaacatgctggnagctgcacgtatcatgggggggagaggttctcctatgcctcgagggatgcat

SEQ ID NO: 21838 - protein, 81 aa, Zea mays
  misc_feature: Ceres CLONE 1391244-F
  misc_feature: SWISSPROT Homolog: EC 5.1.3.18 GDP-mannose 3,5-epimerase
  misc_feature (5)..(5): Xaa is any aa, unknown, or other
  misc_feature (64)..(64): Xaa is any aa, unknown, or other
MTEDXGLHEFHLVDLRVMDNCLKVTHGCRHVFHLAADMGGMGFIQANHSVIMYNNTMISFNMLXAARIMGGRGSPMPRGMH

SEQ ID NO: 21839 - DNA, 647 bp, Zea mays
  misc_feature: Ceres CLONE 1391245-F
  misc_feature: Encodes the peptide sequence at SEQ ID NO. 21840
  misc_feature (263)..(263): n is a, c, t, g, unknown, or other
  misc_feature (519)..(519): n is a, c, t, g, unknown, or other
  misc_feature (527)..(527): n is a, c, t, g, unknown, or other
  misc_feature (635)..(635): n is a, c, t, g, unknown, or other
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaaatccgaagttccgaacccaagccaagccccagggtccgaccgcagaaccgacccaaaatgtcgcccgcctgctccatgctcaccaccgcgtcgctctcctccccgctcccagccccgcgcctccgcgccgccgccgccttcgctccgccgcgccgcgcggnagtcacactcgtcgtgcgcgcggcgtccgcatcttccaagtcccctgccacggcggaggcggccccgaagaagaagagggcgaccggcatcacccagccgaagtccgtgtcgccggcgctgcaggcaatcgtgggcgacccggttattccccgcaccgaggtcctcaagcgccctctggcctatatcaagaagcataacctccaggatccctctgataaaaaggtggtggtttgtgatgagaagctgaaggtcctngtcgcggngcgggagcgagtgggattccttgagatcggcaagcttctcaaccctcacttcgtgaagtgatgaggaggaggcaggccacttccaggaaatcgagtagcttatatggntggttggntact

SEQ ID NO: 21840 - protein, 142 aa, Zea mays
  misc_feature: Ceres CLONE 1391245-F
  misc_feature (65)..(141): Pfam Name: SWIB Pfam Description: SWIB/MDM2 domain
  misc_feature (35)..(35): Xaa is any aa, unknown, or other
  misc_feature (123)..(123): Xaa is any aa, unknown, or other
MSPACSMLTTASLSSPLPAPRLRAAAAFAPPRRAXVTLVVRAASASSKSPATAEAAPKKKRATGITQPKSVSPALQAIVGDPVIPRTEVLKRPLAYIKKHNLQDPSDKKVVVCDEKLKVLVAXRERVGFLEIGKLLNPHFVK

SEQ ID NO: 21841 - DNA, 647 bp, Zea mays
  misc_feature: Ceres CLONE 1391248-F
  misc_feature: Encodes the peptide sequence at SEQ ID NO. 21842
  misc_feature (405)..(405): n is a, c, t, g, unknown, or other
  misc_feature (409)..(409): n is a, c, t, g, unknown, or other
  misc_feature (441)..(441): n is a, c, t, g, unknown, or other
  misc_feature (486)..(486): n is a, c, t, g, unknown, or other
aaagctggagctccccgcggtggcggccgctctagaactagtggatcccccgggctgcaggaattcgcacgagaccattacctagaacatcctaatcgaaaagctggtgcttctacggggcctggcgatttgaattcgagtggtgcgtgtatagagcgtgagagagagaaagagagtggctcttgcgctctgcagtccagttcttgaatccagagctgcgattcgtgctcgcctgacgccgatgaggcggagcctgagcccgctgctacggcaggagctggacaacctggacaaagacgctgacagccgccgcgcccgcatgaaggcgctctagtcgtacgccagacacctggactccaagtccatcccgcacttcctgcgcgaggtctccgacaccacccgcgncggngccggcgccggaagcgtcatgcccaccggcgncgagttcaccatctcgctctacgaggtgctggcgcgggtgcacgnccgcaacatcgtgccgcaaaatcgccacatcatggcccacatcatgtgcacgctctctccagggggggctcgttcccgctccaccaggcctgctccagggtgtgccccgcatcgcgcggacggtatcgacccctcgcgcccgacggggagagggcggcatt

SEQ ID NO: 21842 - protein, 73 aa, Zea mays
  misc_feature: Ceres CLONE 1391248-F
  misc_feature (5)..(5): Xaa is any aa, unknown, or other
  misc_feature (20)..(20): Xaa is any aa, unknown, or other
MPTGXEFTISLYEVLARVHXRNIVPQNRHIMAHIMCTLSPGGARSRSTRPAPGCAPHRADGIDPSRPTGRGRH

SEQ ID NO: 21843 - DNA, 626 bp, Zea mays
  misc_feature: Ceres CLONE 1391250-F
  misc_feature: Encodes the peptide sequence at SEQ ID NO. 21844
agagctggagctccccgcggtggcggccgctctagaactagtggatcccccgggctgcaggaattcgcacgagaccattacctagaacatcctaatcgaaaaaaccgaagcaatccgacctgagaccaagacccgcaccacgcggctcgccgccgatggcgaacgccgacgccgacgaagcgccgctgctctctgtggaacacctccgtccaggatcctgcagccgcgagctcgagctgcgggagttccgcgaccgctacgtgatccgttcgctcgacggcgccgccgctttcgccgtccttcgctccggcggctccatccgccctctctccccagaggaagccgtagctgagagcgactgcaaggtttccagaatatacggggtggtaggcaccataagattgctcgctggaagctatgtactcgttatcacttctcagaaagatgctggctcttatctgggctcccctgtgtaccaagtgaactcaatgaaattcttatgctgcaacgaggctatcaagcacttgactccacaggaaagaagggatgaggcatacttcatgtctctcctgagaattgcagaaactacttgtggattgtattattcatacgacagggatttgaca

SEQ ID NO: 21844 - protein, 157 aa, Zea mays
  misc_feature: Ceres CLONE 1391250-F
MANADADEAPLLSVEHLRPGSCSRELELREFRDRYVIRSLDGAAAFAVLRSGGSIRPLSPEEAVAESDCKVSRIYGVVGTIRLLAGSYVLVITSQKDAGSYLGSPVYQVNSMKFLCCNEAIKHLTPQERRDEAYFMSLLRIAETTCGLYYSYDRDLT

SEQ ID NO: 21845 - DNA, 624 bp, Zea mays
  misc_feature: Ceres CLONE 1391253-F
  misc_feature: Encodes the peptide sequence at SEQ ID NO. 21846
agagctggagctccccgcggtggcggccgctctagatctagtggatcccccgggctgcaggaattcgcacgagaccattacctagaacatcctaatcgaaaagtcatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcggtgctcgcccacgacggcgcgcgcatcgcgtcgctcgccgcgcgcctcgccaagacgccgtcctctcggcccaccttgcttgacgagagccgcgcggggtcgtcgtcgtcgtcccccgatgacgagtcgtccctcgcgtccgtgccgctcgggccggggacgtccgtcggggtgggcaactacgtcacccgcatgggcctcggcacgcccggccagtcgtacgtca

SEQ ID NO: 21846 - protein, 143 aa, Zea mays
  misc_feature: Ceres CLONE 1391253-F
MALLRLLALISLLFAVATPVRDIAHDACSSEVKDFQHLNNSSGLHLTLHHPQSPCSPAPLPADLPFSAVLAHDGARIASLAARLAKTPSSRPTLLDESRAGSSSSSPDDESSLASVPLGPGTSVGVGNYVTRMGLGTPGQSYV

SEQ ID NO: 21847 - DNA, 625 bp, Zea mays
  misc_feature: Ceres CLONE 1391256-F
  misc_feature: Encodes the peptide sequence at SEQ ID NO. 21848
aaagctggagctccccgcggtggcggccgctctagaactagtggatcccccgggctgcaggaattcgcacgagaccattacctagaacatcctaatcgaaaacccgttagttgcccagccccagacccagagaggagggcgacgaacacacggtgacggagagccgagtggacaggacaggagcgcggagggaggaggaaacaaagcagaaaaagcaacccccgtcttccatcttcgcggaacgacgcccatctggcctgcccatctctttcgtgctcctaccccccgccttcttccgccctcaaggcttttccttccttctcatcttctgctcggaccggggacgggccgacggggacagggacaaaaggtggtgcgatcttgttcggcacagagagagagagagagcgacggagggtggcagggccgccgcgccggtgagccgacccccagccatggcattgccggctccccccgtccgcctggcgctgctgctgctcgtcgcgctgccattctgcgccgcgcatcccgggccgggggccttcaatgctcctcgccacttccagacgcccgcgctccactctgatggatttggcttggtggcaagaaggtcgattgctgaagc

SEQ ID NO: 21848 - protein, 56 aa, Zea mays
  misc_feature: Ceres CLONE 1391256-F
MALPAPPVRLALLLLVALPFCAAHPGPGAFNAPRHFQTPALHSDGFGLVARRSIAE

SEQ ID NO: 21849 - DNA, 647 bp, Zea mays
  misc_feature: Ceres CLONE 1391266-F
  misc_feature: Encodes the peptide sequence at SEQ ID NO. 21850
aaagctggagctccccgcggtggcggccgctctagaactagtggatcccccgggctgcaggaattcgcacgagaccattacctagaacatcctaatcaaaaaataccccgtctcggttctcaaacaccgccgccgccgttctcccgacatctccccgtccaggtcgttgggtcagcccctatccttcaccttcacgacttcacctgcttctccactgcgcgccccgcccccggccccgtcgtgcgccctgctcagatccatcgcacggggcttgccgcaccactgcgccaagcaaaaggtgggcggccagcggcgcgtgcgcagatcatgcactgttgtcttatgaagattggtaaggggagaaagaagatgaggaataaacagcgaaaatcatctgccctcggttctgatgcaggatgtggatcttctttatcttgtattgtatggagcttggtgggttttggtcttgtctgcttccttttccttaaacatcaagcagacagtggtcagacccatgtttatttcagtcctcttcatgcgaccagaaaattagaggacatcgaggaggatcatttccgcttgccacctcctcacaaggtgaatcctcgtgcagtgaaaaggaggggacctcgtaaacaaccaaaggt

SEQ ID NO: 21850 - protein, 106 aa, Zea mays
  misc_feature: Ceres CLONE 1391266-F
MHCCLMKIGKGRKKMRNKQRKSSALGSDAGCGSSLSCIVWSLVGFGLVCFLFLKHQADSGQTHVYFSPLHATRKLEDIEEDHFRLPPPHKVNPRAVKRRGPRKQPK

SEQ ID NO: 21851 - DNA, 644 bp, Zea mays
  misc_feature: Ceres CLONE 1391267-F
  misc_feature: Encodes the peptide sequence at SEQ ID NO. 21852
aaagctggagctccccgcggtggcggccgctctagaactagtggatcccccgggctgcaggaattcgcacgagaccattacctagaacatcctaatcgaaaaactggagccctataggctatagccaccaccgcactcgcctccctctctccctcccacactccaccacccgcgccgccgcctcctactccgccccggcccctctgatccgtaccgagcgccggccatggcgctcgccttcgacgagttcgggcgccccttcattatcctgcgggagcaggagaagaagacgcgccttcgggggcttgacgcgcagaaggccaacatcgcctcggccaaggccgtcgcgcggatcctccgcacgtcgctgggacccaagggcatggacaagatgctccagtcccccgacggcgacgtcatcatcacaaatgatggagcgaccatcctggagcagatggatgttgacaaccagatagcaaagctgatggtggagctgtcccgtagtcaagactatgaaatcggggatggtaccaccggggtggtagtcatggcaggggctcttctcgagcaggctgagaagcttctggagcgtggtattcaccccattagggtggctgaaggctatgagatggcgtcaaaggtag

SEQ ID NO: 21852 - protein, 139 aa, Zea mays
  misc_feature: Ceres CLONE 1391267-F
MALAFDEFGRPFIILREQEKKTRLRGLDAQKANIASAKAVARILRTSLGPKGMDKMLQSPDGDVIITNDGATILEQMDVDNQIAKLMVELSRSQDYEIGDGTTGVVVMAGALLEQAEKLLERGIHPIRVAEGYEMASKV

SEQ ID NO: 21853 - DNA, 599 bp, Zea mays
  misc_feature: Ceres CLONE 1391280-F
  misc_feature: Encodes the peptide sequence at SEQ ID NO. 21854
  misc_feature (208)..(208): n is a, c, t, g, unknown, or other
aaagctggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccngctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagccccagtccctgcccctccctccgtggtcgagaagaagcttgaaaagctctcagctatggttagtggggtttattcggatgataataaccttcagcttgaggccacacacaggtccgcaaaatgctctctaaagaggagagtccccccatcgaagaaagtatcaaaaacagggg

SEQ ID NO: 21854 - protein, 112 aa, Zea mays
  misc_feature: Ceres CLONE 1391280-F
  misc_feature (4)..(92): Pfam Name: IBB Pfam Description: Importin beta binding domain
MSLRPSERVEVRRNRYKVAVDAEEGRRRREDNMVEIRKSRREESLLKRRREGLQAPVPAPPSVVEKKLEKLSAMVSGVYSDDNNLQLEATHRSAKCSLKRRVPPSKKVSKTG

SEQ ID NO: 21855 - DNA, 642 bp, Zea mays
  misc_feature: Ceres CLONE 1391282-F
  misc_feature: Encodes the peptide sequence at SEQ ID NO. 21856
aaagctggagctccccgcggtggcggccgctctataactagtggatcccccgggctgcaggaattcgcacgagaccattacctagaacatcctaatcaaaaaacgttgacggccaccccgcccacagccgcgacaaactcttcctcagacccacgccacgtacgatgcctctctccccttcccctccgcccaacgccgccgccgccgccgccctacccctcctcctgctgctcgtctgcgccagcagcattgccgcgcagccgctggcgtcgtcgcaggccaaggcgctcctccgggtgcgccgcctgctgtactacccgccggcgctcgagccgctgcgcggggcgccggacccctgcgcgctgccgcccgcgccggccctcgcagtcccctgcgagggcggccagggcacggcgcctccccgcctgggagaccgcgacccggacgcggactggccccgccgccccgcccgtaccgctttctcctcgcgacgcgccgggccaccaccgctcaccaagctccagggcgctccgcggggcccctccgcaccgccggtccttcggccggcctggcggcgcccgctccccggggttgcccaaacctccccgccgggtcccacccgccggccgcgcatccaatatt

SEQ ID NO: 21856 - protein, 159 aa, Zea mays
  misc_feature: Ceres CLONE 1391282-F
MPLSPSPPPNAAAAAALPLLLLLVCASSIAAQPLASSQAKALLRVRRLLYYPPALEPLRGAPDPCALPPAPALAVPCEGGQGTAPPRLGDRDPDADWPRRPARTAFSSRRAGPPPLTKLQGAPRGPSAPPVLRPAWRRPLPGVAQTSPPGPTRRPRIQY

SEQ ID NO: 21857 - DNA, 655 bp, Zea mays
  misc_feature: Ceres CLONE 1391295-F
  misc_feature: Translation starting site: 540
  misc_feature (178)..(178): n is a, c, t, g, unknown, or other
  misc_feature (180)..(180): n is a, c, t, g, unknown, or other
  misc_feature (184)..(184): n is a, c, t, g, unknown, or other
  misc_feature (185)..(185): n is a, c, t, g, unknown, or other
  misc_feature (190)..(190): n is a, c, t, g, unknown, or other
  misc_feature (191)..(191): n is a, c, t, g, unknown, or other
  misc_feature (195)..(195): n is a, c, t, g, unknown, or other
  misc_feature (220)..(220): n is a, c, t, g, unknown, or other
aagctggagctcaccgcggtggcggccgctctagaactagtggatcccccgggctgcaggaattcgcacgagaccattacctagaacatcctaatcgaaaaaaagcgaaacgactccttcagttccgtcccgttcgtgacgacccccggtcccgggagggggagggggagggggaggnanaggnnaggtnntggnctccggaccggtccggccagccgcnaccgcaacagctgatgctgacccgggagccggcgacaacaagctcgtcttcgagacgccgctgcagccgcagcccgtgagggaggactacgtcgagaacgccgtcaagttcctctaccacccaaaggtcaggagctcccccgtcgtctacagacgatgcttcctcgagaataagggcctcaccacactggagatcgacgaggccctacgaagagtccctgatcctgaacccatcaatacggttaacagcttcttcacagctgcaggttggcagccagaatcaatcaggtgggccggaaaattatgggcccagcggatctatggacccaacaaccggtggcccttggcgtccgaccccggtttcagatgggaaccaggcatttcctcgctggagggttccttgcttggtttttgatgctaacaaggggtggccttt

SEQ ID NO: 21858 - DNA, 685 bp, Zea mays
  misc_feature: Ceres CLONE 1391303-F
  misc_feature: Translation starting site: 201
  misc_feature (454)..(454): n is a, c, t, g, unknown, or other
  misc_feature (475)..(475): n is a, c, t, g, unknown, or other
  misc_feature (501)..(501): n is a, c, t, g, unknown, or other
  misc_feature (616)..(616): n is a, c, t, g, unknown, or other
  misc_feature (623)..(623): n is a, c, t, g, unknown, or other
  misc_feature (625)..(625): n is a, c, t, g, unknown, or other
  misc_feature (642)..(642): n is a, c, t, g, unknown, or other
aaagctggagctccccgcggtggcggccgctctataactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctggttcgtgggcggtgtctgtgggcgcgaacatctccggcgggcacggnaaccctgccgtgaccttcggncgccttcgtgggcggcaacatccccntgttccgggggctcctggtactgggtggcgcaggctgctggggtccaccggtggcgtgcttcctgctccgcttctcgacgggcgggcaggccacgggcaccttcgggctgagggncgtgtcngnggtgggaagcgctgggngctggagatcgtgatgaccttccggctggtgtacacggtgacc

SEQ ID NO: 21859 - DNA, 930 bp, Zea mays
  misc_feature: Ceres CLONE 1391306-F
  misc_feature (16)..(16): n is a, c, t, g, unknown, or other
  misc_feature (726)..(726): n is a, c, t, g, unknown, or other
ttttttttaccccccntcccccccctttttccccttcaatattttttaggaacaatccaaaaatgaaactccacgcggtggcgcacgcctctttactagcggatcccccgggctgcgggaattcgcacgagagcattacctagaacagcctaatcgaaaaagatccaccaccccaccaaccaactactctcacagtctcacctcccgcctcctgcccccctccctctcgttctcttcctaaatggcggacgagtccaccaggccgccctcgccgccgcgcgactccggttgccccgcggcgagggaaactcccaccgctcccagcttgaccgcgacctacctcgagggaggtttcagggtactttctaggccaccctacctgtgtggaaagggggacccgacacagggagcctacgtcccaatcgaggggggaacctctaccacccgccatcagaggctaggagggaccgcgccaagggaaccaaattgggggggaagacgcgcggccccgcgaacgcccccccggcaaaaaaagcccccctctggggcaacaaactagccactagagatacggataaaacgaaatcaatatttatagggggcgctatcttcgagctcccgtggcacctatagatgagctacaaacaacactagaatatccatccctctatcggagagctaccccccaacacgaccgtcgccgcctcccacaatcgaaaatgaaangccgctgcaccaacccacacccccgcggcgcaaacaatgcactcgggaaaaaaccagacaacagagcgctaccaactcgccgacccgctcgctgcgcgcccccaaccattacaactgtactccctcccccaacaggacgagaaagaccactaggacgaaggggggcggagacagacaagggacctaacaggggcacgagactgc

SEQ ID NO: 21860 - DNA, 736 bp, Zea mays
  misc_feature: Ceres CLONE 1391308-F
  misc_feature: Encodes the peptide sequence at SEQ ID NO. 21861
  misc_feature (1)..(1): n is a, c, t, g, unknown, or other
  misc_feature (17)..(17): n is a, c, t, g, unknown, or other
naaaacaaaaaccccanaacccaaaaaacacctactggaaagctccgtgtcaaagctggagctccccgcggaggcggccgctttacaatagtggatcccccgggctgcaggaattcgcacgagaccattacctagaacatcctaatcgaaaagttcacctcccgccgccccctcgcgccgtcaaggcctccggaaccggtcgcaagcggcgtaggacccccgccgctacagagccctcgtccgtcgcacttcgccgccgcgtcggagtcatccagctcgtcgacgcctggcggggagatccccagagcgaggggaacctccacgacgcgagtacttctctagttcctgtcacaaaaaaaagatttgcaatctagcatatttatggaagcctttgctctggataaaatttgcgggtcagggagatcagcgctcaccacccaagaaagagtgatggaagcccaaagtagtacttgcttttcaaaagtcgtgggacctaacttatggtatggcgatcgcacaagacttacgcccaagccagaagaagctgcgcttggtttgtcacgtgcctgaggctctggcattccagcatacatttgccaccatgaaaaaatctaatgctgtcaagaagaagatggaatttatcaagacagtttcaataaagcgacatattatttcggccgccctgggcacctcacggcgtcgcgaaacccagaagttttttgcgcgccacggaaca

SEQ ID NO: 21861 - protein, 62 aa, Zea mays
  misc_feature: Ceres CLONE 1391308-F
MEAFALDKICGSGRSALTTQERVMEAQSSTCFSKVVGPNLWYGDRTRLTPKPEEAALGLSRA

SEQ ID NO: 21862 - DNA, 701 bp, Zea mays
  misc_feature: Ceres CLONE 1391310-F
  misc_feature: Encodes the peptide sequence at SEQ ID NO. 21863
  misc_feature (509)..(509): n is a, c, t, g, unknown, or other
  misc_feature (564)..(564): n is a, c, t, g, unknown, or other
cgcggtggcggccgctctataactagtggatcccccgggctgcaggaattcgcacgagaccattacctagaacatcctaatcgaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggcgacatggcccgcttcgcggacacgctgtcggacacctccccggtctcgcccgcgcagcgcttcgtgtcggaggacggcgtcatcaactcgcgcccgcgggtgctgctggngggcatctgcatcaacgccggcttctacacgcgtcccagcgacgactacgtgcgngccggtcattggcaaccgggcgcctccgagtccgcgtacagcccgcacgcacgccgggtactattcacattccccgcttctccccccccaaacacctccccaccgccctctttatccgctgttcaccctcaccctcg

SEQ ID NO: 21863 - protein, 189 aa, Zea mays
  misc_feature: Ceres CLONE 1391310-F
  misc_feature: SWISSPROT Homolog: EC 4.1.2.10 Mandelonitrile lyase
  misc_feature (126)..(126): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTSPVSPAQRFVSEDGVINSRPRVLLXGICINAGFYTRPSDDYVRAGHWQPGASESAYSPHARRVLFTFPASPPPNTSPPPSLSAVHPHP

SEQ ID NO: 21864 - DNA, 825 bp, Zea mays
  misc_feature: Ceres CLONE 1391313-F
caccgcggtggcggccgctctataactagtggatcccccgggctgcaggaattcgcacgagaccattacctagaacatcctaatcaaaaaaaactttagtctactcgtcctcggtcctcctcttctcgcagcagccagcagaccaatcgggacaagcaaactcccccgattagtttaagcagcccgggcccggcgacgaccagctccgttccgcgcggggatttaaacgcgcgaagcgagaaggcacgcagcaggcggcagcggcaagcaacgaacgcgatcgcgcgccgacgacgacgcgcggtgccggcgcctgggtggtggccgtgttgcggactccgctgcatcgtcttcggtcgggtcgtcgtcgttaatcatgggatgtccggcttccagggggtcgggagctcgacgttccccgtctgcccacgcggccgctagctgatttttggcccggctctcctccccctccacctcgcccccccgcccgaggcgggtagacgctgccccctgggccccaggatttgtacacccgaccgtatactctaacggtccacccgtcgctagccattctaaatccgcgcctcggggcgtagatctgttactcattgctgacataaggttcgttctccgcgccgccaggttagcgccattgcatcgcgagtccccaggccaccgctgttgttagctactatgactgtgtatatcttcgaatagcaatgggacggtagcctcgctcgttagagcagcgccgcagctatgtttaataccgcgacgctcgctcaccgttgcgcgccccggtggtgcggatctatgatggtctcg

SEQ ID NO: 21865 - DNA, 684 bp, Zea mays
  misc_feature: Ceres CLONE 1391317-F
  misc_feature: Encodes the peptide sequence at SEQ ID NO. 21866
aaagctggagctccccgcggtggcggccgctctagaactagtggatcccccgggctgcaggaattcgcacgagaccattacctagaacatcctaatcgaaaaaaaaaaagcaacttcacgcgagggagccgcgaccgcgagcgcctccgcatttcgaaccaaagggggcagaactgagagatcgagagaaataataaaaaaaatccgtcttcttgtggtcttctccaaaccctagcgcccccggccccggtctccgcccccccgcctgtttgccgtcgcggtcgcgccccatggcggggaagtcgcgaccgcccaagcggatcctcgagtcctataccatcaagggttcggacagagtcatcaagcctggcgattgcgtgctaatgagggcatctgatgcttcaaagccaccttatgtggcaagagttgaggcaattgaagcagcaggatctcgaggcaccaatgtgagagtacgagtgcggtggtattatcgaccagaggagtccataggtggtcggcggccatttcatggttccaaggaggttttcctctctgaccactatgatgtacaaagtgctgacaccattgaggggaaatgcaatgtccacagcttccgtagctatacaaagcttgattctgtcattgctgaggatttcttctgccgcttcgagtataaatcagcta

SEQ ID NO: 21866 - protein, 131 aa, Zea mays
  misc_feature: Ceres CLONE 1391317-F
  misc_feature (22)..(131): Pfam Name: BAH Pfam Description: BAH domain
MAGKSRPPKRILESYTIKGSDRVIKPGDCVLMRASDASKPPYVARVEAIEAAGSRGTNVRVRVRWYYRPEESIGGRRPFHGSKEVFLSDHYDVQSADTIEGKCNVHSFRSYTKLDSVIAEDFFCRFEYKSA

SEQ ID NO: 21867 - DNA, 774 bp, Zea mays
  misc_feature: Ceres CLONE 1391318-F
  misc_feature (38)..(38): n is a, c, t, g, unknown, or other
  misc_feature (41)..(41): n is a, c, t, g, unknown, or other
gtgggtggattgccaaccaccccccaccgctccctcanacnccggggggggtactcatcagcgctggcactccaccgcggtggcggccgtctttccaactagtggatcccccgggcctgcattaattcgcacgagaccattacctagaacatcctaatcgaaaaaccctgctgtctccctccctccttccttccttccccgtcactgcgcagcgcgagtgcgcagacagccagtcacacactcacactccctcgaccgctctcggccccgtccgcgtcgccgcaaggcgaggaggtaatggagttgggcgagaatgatgccggaggggacaccagggggtgccttcgcgcggatctacaacgacgctcagggaggagctgctcaccgacccgggcttccagttcacccaggagtcgcgccagcggatcagagcgcatgcactgaccacaatggtactcggaggtgagtgtaaccgcggcgtcctctgtggcccgacaggtaccagccgctcaaggccgactgacggtctgggccgagggagaaaacgcccccttgcgttgggccccaccgccgtggccgcacttggaccgccgtccaacgcaactcaacctcctgcgggtcgcacggcccctcgtggcctgcgctcctcaacactcagtcgaaggaccaactccttgctcgttggcctccaccgcctcctcagggcgcaccccgaatttgggctgcggcaaagcccgccctcttcgtccctcttccccccgccaataattatcc

SEQ ID NO: 21868 - DNA, 689 bp, Zea mays
  misc_feature: Ceres CLONE 1391319-F
  misc_feature: Translation starting site: 160
  misc_feature (509)..(509): n is a, c, t, g, unknown, or other
acccgcggtggcggccgctctagaactagtggatcccccgggctgcaggaattcgcacgagaccattacctagaacatcctaatcgaaaaatcagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagcggcgaccaaggggtggagggcggccgacctggggtacgtggccatcctcccgtcgctgctcctccgggcgctgcacaaccaggcgtggatcaccgcgtcccgcctgcagagcgcgcgcggcccggcggcaggtcgtggaccgcggcatcgagttcgagcaggtggaccgcgagcgcaactgggacgaccagatcctgctcagcggcatcctcctgtacttgggctccacctccctggccggggggncagcaccttgccggtggggtgcgcggcactccgcccagatcattacccctgctgacttccggcccccgttaagtactacctacaactttcgttccccatcttcttctaacatcacattccccccctctccttttttccttctctaacataacgcctctccgcttttgctcactccactcc

SEQ ID NO: 21869 - DNA, 712 bp, Zea mays
  misc_feature: Ceres CLONE 1391320-F
  misc_feature: Encodes the peptide sequence at SEQ ID NO. 21870
  misc_feature (475)..(475): n is a, c, t, g, unknown, or other
tccccgcggtggcggccgctctagaactagtggatcccccgggctgcaggaattcgcacgagaccattacctagaacatcctaatcgaaaagtaacaactcccccaatccgtcccgtcggccggacgagcagggcccaagggcccaccttaccatggcgaccgccactgccgcccccgtccccgccggcggccacccgtaccgccgcgcccgcactcgctgcggcccaccgcgcctgcaccgcctgcgcttcccggccgcagcagcagccgcttcgtcttccctgcccgccccgtcgtctatgctgccaccgctgccagatggaggcgggcggctggtggcggagctggtgtgcgcgttcaacgagctcacggagcggatgggggaggacctggcgacgtcctcctcgtcgagcctgctcttccgtgtgctgaagctggcgctccccgccctccgcgacgtggagggcggccggncactcgcacgcgcgctcgccgtcgccgcgaacctcgctgacctcccaaatactctgttcacttaaacaagtcaacatacttacatttccaaatgataacggacctctcttgaaacggaactttcctggctttcgaaaaccgcacattctctgccccctcagacatctccaagcctccccggttttagccttgaatcgctcaaatccagatgcgtgctacttcagcgccacatcatcg

SEQ ID NO: 21870 - protein, 128 aa, Zea mays
  misc_feature: Ceres CLONE 1391320-F
  misc_feature (108)..(108): Xaa is any aa, unknown, or other
MATATAAPVPAGGHPYRRARTRCGPPRLHRLRFPAAAAAASSSLPAPSSMLPPLPDGGGRLVAELVCAFNELTERMGEDLATSSSSSLLFRVLKLALPALRDVEGGRXLARALAVAANLADLPNTLFT

SEQ ID NO: 21871 - DNA, 630 bp, Zea mays
  misc_feature: Ceres CLONE 1391322-F
ccccgcggtggcggccgctctagaactagtggatcccccgggctgcagtaattcgcacgagaccattacctagaacatcctaatcaaaactccactgctctgctgctcctcgcgccgccgcagcgacgtaatggcttccgccgcggtgctccggaacgccggctcccggcgcctcttctcctaccctactctccgcgccgctgcgatatatgtaccttctgcgctacccgatgcgcccgcggcggcggcagcgccggcccagccgccaccgacggccgggaccctctgggcgaggtctatggccaccttcacgcgcacgaagccccatgtgaacgtcggcaccattgggcacgtcgatcacggcaaaaccacttctcactggctgccatttacccaaggtcctggccgaagcagggaaggcccaaggcggtgctttcgacgagatcgaaaggttccgggggaaaagcccgaggaatccccttgggaacggtccccgtcgagatgaaaacggtaaaaaggataaggtcccggtgatttgcccggcccccaattaagtcagaaagtggtcccgggacgtggcaaagggggggggggtttttgtgggggacccccggggggccaggcacaaat

SEQ ID NO: 21872 - DNA, 671 bp, Zea mays
  misc_feature: Ceres CLONE 1391323-F
  misc_feature: Encodes the peptide sequence at SEQ ID NO. 21873
aaagctggagctccccgcggtggcggccgctctacaactagtggatcccccgggctgcaggaattcgcacgagaccattacctagaacatcctaatcgaaaaaattcgccttcacctcggcgtttcctccttgaccgccaccgatgacgtcgtcttccggcgaggtagctcgtcggaagacctcacctggacttttccgacgcaccctccacacactctttaaccctccggaatggccgcctgcttctagctcgtcgacgccccaatctccgcttgcttcctcgacaggcccatccgcctcttctcgctctcgctacggctcctctgcctgttcgccatggcgatccgcatcaccgtctcctactccggctacgtggcgcggaacctcgccgcgtcgctcggccaccgcttctcctccgcctccgcctcgggcagccgcctcctccatgatggagactggcgccccttctgtatcttcacctccacccgccagcccgagcagcaccgaggtagcggcagcgaccgccatgacggacgagactacaaccacgcgaagccccaggccatcgacgccggagctcactcggtgctgctcacgcgtgcgtgcttatcgtgcaagtcggcgccgacgtctcttgccgtgtagatgctctcggtgcttgagcacagga

SEQ ID NO: 21873 - protein, 102 aa, Zea mays
  misc_feature: Ceres CLONE 1391323-F
MAIRITVSYSGYVARNLAASLGHRFSSASASGSRLLHDGDWRPFCIFTSTRQPEQHRGSGSDRHDGRDYNHAKPQAIDAGAHSVLLTRACLSCKSAPTSLAV

SEQ ID NO: 21874 - DNA, 744 bp, Zea mays
  misc_feature: Ceres CLONE 1391325-F
  misc_feature: Translation starting site: 222
  misc_feature: Pfam Name: Syntaxin Pfam Description: Syntaxin
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (19)..(19): n is a, c, t, g, unknown, or other
ggttgttcccnnncccccncctacacccccctcccccttatggaaataatgtgcaaagctggagctccccgcggtggcggccgctctccaactagaggatcccccgggctgcaggaattcgcacgagaccattacctagaacatcctaatcgaaaaaccttccgtcccccggcctccggtcgcctctctctttctctctcctcgctgagtcgccgccagccatgaacaacctcctcacggattcctttgagctcccccggcgggactcctcaagagatgcagaccttgagatgggaatgcctccagctgctgcttcccactacttaaaagatttcttgaagaaggtcgatgcaattgagagtttaattgccaagctgagcaatcgattgaatagagctaccgactgcgaatgaggaatccaaagcccgttgccaaggcaagttccatgaaagcaattaagcagcgggtggagaaagagattgatgaagtggggacccttgctcgtcaggcgaaaacaaaagttggtggattggacaaagacgacttatccaataggcgaaaacctgcatgtgccacagggtctgccgcgcacccatcccgagagcacactactgcagcagtgaacaaacaaattgaaggagcggatggatggcgttcccgaccttggacagaacccatcccggcacgagcaccgccccggccgcttgcaagaaacgcctttttccggccactcgcccccccccg

SEQ ID NO: 21875 - DNA, 659 bp, Zea mays
  misc_feature: Ceres CLONE 1391325-R
acaattgggtaccgggccccccctcgaggtcgacggtatcgataagcttttttttttttttttttaaccaaaaagccaaagctccatgttgcgtccactatcggtacaacaacaaatcacaaatcacccgcaaaaaaaaactgcacacatattacacaaacaggaaaaaaaggcaccaccacgctaggagcccttcttccatgggtggatgactgcgacgacaatgaccaccactatcaccagcagtatgataatgggatagcacatccccttcctcgaattcctctgcagattcttctcattctggagcgcgctcacaccttgctgtatgcgggtactggcgtccaaaacatgggtctccatgttgttgatacatgtctccttgcgcctcaacaacaactgccatgtccatgaatatctgttgcaactccagaaccttcctctctagatcccttacagcatcatgtctctcctgtatttcaccaacagtgtctagaaactggcctcttccctgatatcggataacatccttgaatatttgctcacttttaccaggctctatcaagtcatcaattgtctcttcgtcacgactattaccagttaactctaaaacccttctttcaacaacctcccgatactcttgcctgattgcttctcac

SEQ ID NO: 21876 - DNA, 771 bp, Zea mays
  misc_feature: Ceres CLONE 1391325-R2
aattgggtaccgggccccccctcgaggtcgacggtatcgataagctttttttttttttttgttaaccaaaatgccagagctccagttgcgtcgactataggtacaacaacaaatcacgaatcacccgcaaaaaaaaactgcacacatatgacacaaacaggaaaaaaaggcaccaccacgctaggtgcccttcttccatgggtggtatgactgcgacgacaatgaccaccactatgaccagcaggatgatgatgggatagcacatccacttccgcgaattcctctgcagattcttctcattctggagcgcgctcacaccttgctgtatgtggttagtggcgttccagacatgggtctcgatgttgttgataatgtctccttgcgcctcaactagaactgccatgtccatgaatatctggtgcaactccagaaccttcctctctagatccctgacagcatcatgtcgctactgtatttctccaacagtgtgctagtatcgggcctcttccctgatgtcggatagcatccttgaatatttgctcacttttacaaggctctaacaagtcatcaattgtctgctcgtcacgacgattagcagttacagttaaaacccttgcttcaacaaccaacccaatactcttgccgtgattgcttgctcacaagggactgaaagtcatgcatccacgtccttcaaattgcttttatcactgctcccattaggtttcgctctagttgaaccaggccagcgggcagaaacattataccagcata

SEQ ID NO: 21877 - DNA, 679 bp, Zea mays
  misc_feature: Ceres CLONE 1391331-F
  misc_feature: Encodes the peptide sequence at SEQ ID NO. 21878
  misc_feature (525)..(525): n is a, c, t, g, unknown, or other
cgctcagtactagtggatcccccgggctgcaggaattcgcacgagaccattacctagaacatcctaatcgaaaagaaaaggctagccaagaaaacgactgggcgcacgaggcttctgtgttctgtgacttctgtccctatccacacgaccccgacattccatgggcgactccggcggaccccaccaccaccgcccttcgccgccgcctctgctggacgccggcaagcgacggcgcatccccaacgtccgcctcgctggctccgtcccgctcccttcccacctgccccacccgcgccgcgtccccattgcccccgccaccaggtcccgcaaacccctccaacttcagcataacagcaaccagcatgaccacccctccgcggagccacccaataccctcctaaaacccttcgtcgacagcgggcgacgacgtcgtcttggccgccgcttttccccgcaaggtcagggccccggcttgagggactggtggtggggagctactgccacgatgtgctaatccggggcggncgcatagtgggggagacgctcggcggggctgcggccttcgtgtccaacgtgctcgacgctgcttcgccccagggcgccgcgctcaacgagacatccccctttggcgttgggcccaaggtggttcacgaattccattaacgcccgggggcggggg

SEQ ID NO: 21878 - protein, 117 aa, Zea mays
  misc_feature: Ceres CLONE 1391331-F
MGDSGGPHHHRPSPPPLLDAGKRRRIPNVRLAGSVPLPSHLPHPRRVPIAPATRSRKPLQLQHNSNQHDHPSAEPPNTLLKPFVDSGRRRRLGRRFSPQGQGPGLRDWWWGATATMC

SEQ ID NO: 21879 - DNA, 714 bp, Zea mays
  misc_feature: Ceres CLONE 1391334-F
  misc_feature: Encodes the peptide sequence at SEQ ID NO. 21880
  misc_feature (423)..(423): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (586)..(586): n is a, c, t, g, unknown, or other
  misc_feature (603)..(603): n is a, c, t, g, unknown, or other
  misc_feature (604)..(604): n is a, c, t, g, unknown, or other
  misc_feature (657)..(657): n is a, c, t, g, unknown, or other
aagctggagctccccgcggtggcggccgctctagaactagtggatcccccgggctgcaggaattcgcacgagaccattacctagaacatcctaatcgaaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggcgctccgctctacctctccctctccgcccggtggccgcgcactctgctcggattgctggtgagatgcccaaagcctttgtngatcttagatgatgttgtgcaacacaccctgactaatttgcacagtattcacaaaagcttactaattttggcaggccaaggctgagggaacaaattctcagaaagtgtactttatgatattttgagagaggtccaaggnnnctttgttgatgcaacatatcanacactcactagactcgnnagcaatggacgccctgtcccatacattttgcattctgcatcctgatatggggncaacaaaactcgctgccctgaacagtatggcacactgcttggccgcttttcctgcag

SEQ ID NO: 21880 - protein, 99 aa, Zea mays
  misc_feature: Ceres CLONE 1391334-F
MATSPPQNPSSGEPSDASSLAAAALEAPVRVWRSLVARFPPLPDSSSFLAGVSDLQLRYFGNSRPRRRRRSALPLPLRPVAAHSARIAGEMPKAFVDLR

SEQ ID NO: 21881 - DNA, 676 bp, Zea mays
  misc_feature: Ceres CLONE 1391336-F
  misc_feature: Encodes the peptide sequence at SEQ ID NO. 21882
  misc_feature (676)..(676): n is a, c, t, g, unknown, or other
aaagctggagctccccgcggtggcggccgctctagaactagtggatcccccgggctgcaggaattcgcacgagaccattacctagaacatcctaatcgaaaaaattagcatgaagttgtttttgctgaagagggtcgaacaaaagaaatgcttcactgagcaaaatatagcatttcgatcccgacaccccaaaatccctcagccctctggcctcggcggcgctcaaaccttcgccgtcccgccgtctccaaaaccctcttaccatggccgccgcgacaaccgcgggggccggagccgcgacgccgcagccgccacggcagtacaagctagctccgcagagcgagctgcgtgtggaggtgctccccgacgcgcccctccgagtgcgcctcgtcactggcaccgcagagatcttcggcaccgagctgcctccggagggctgggtccccgtccctccccgatccaagatcgccattttcacctggcacggcgcgacggtggaactggacggggtgagcgagagcgagtacacgtctgacgagactccaatggtaatttatgtcaacacgcacgccattctggatgcccgcagggcaagggcgagaacagccgcagctcaggggggcgataaggaggcatcacagggacctagagtgattgttgtggggccaacagattn

SEQ ID NO: 21882 - protein, 137 aa, Zea mays
  misc_feature: Ceres CLONE 1391336-F
MAAATTAGAGAATPQPPRQYKLAPQSELRVEVLPDAPLRVRLVTGTAEIFGTELPPEGWVPVPPRSKIAIFTWHGATVELDGVSESEYTSDETPMVIYVNTHAILDARRARARTAAAQGGDKEASQGPRVIVVGPTD

SEQ ID NO: 21883 - DNA, 892 bp, Zea mays
  misc_feature: Ceres CLONE 1391337-F
accccccgcctcctacatcccccccgcacccccaggacaacccccaaaactgccactccccgcggtggcggccgctctataactagtggatcccccgggctgcaggaattctcacgagaccattacctacaacatcatactggaataaagtgctcgaagcatcactgctaactgtgaattgccattctaaagtctctggaacattgcaagattgacttttgaattttctacagtgcatcccaaggatatcaacaaatgcagtgcaaatgagatgtgatggttgcaaagaggattctatagcgtcctcctgatctttgaaaatgtggccggtctcgcaaaagcaagtactttgaggtccgcctgcgagaaggtttcctctgcaccgcggatttgaccactctataccctgacctggtgcacatggccaactggattgtcctctcctgatggcagcaccaccccccccaccctagtatcctatccgcttggaattatcttgcgcactcacacctagctagcctccgcgtctattccgagactgggaaaccggtcaacgatgtgcaaagcacccctgcccatgcaggcatacccattcacttccaactttagagtgtactgacaggccaacacgcgtaatacaggcaaggttctaacctcaccgcgaggttctcgaaccgagctccatccctccatagtgacataccgggccctcactatcccgaccttcaccctcacacgccttctccaccctcccacgccgtaatacgaagctaacgaatatagcctcacggcgctcgcacgtcgccttgtgcttctcacccatgcacccacccctacgtacagcctcctctctcctcgaccacacacacgtttcacgcgtcgaaatccccgt

SEQ ID NO: 21884 - DNA, 702 bp, Zea mays
  misc_feature: Ceres CLONE 1391341-F
  misc_feature: Encodes the peptide sequence at SEQ ID NO. 21885
  misc_feature (525)..(525): n is a, c, t, g, unknown, or other
ggcggccgctctatacctagtggatcccccgggctgcaggaattcgcacgagaccattacctagaacatcctaatcgaaaaacacacggaagaagccactagctctccgctctcgcctctcggccttctccttgtgccgccgaacaccctcacaagagtcggcctctcgatttctcagtccagccgcagcagcccccttccctccctcctccatcaggtgttgcctcccgcagatccaagtcggaattcggtccttcgtccccaaaccaccaatccggttgcattctttgggtttgctcacagcgcacacaaagccattttactgctgggaatggtggctggcacttagcgtctccggctcttgagtgatctccaagtcctttggaatgctacagggaagtgaagtgatgggggagtgcgaggacggcaaggagtacaggtgctgggaggagctgctgccggacgcgctgggcctcatcttccgcaacctgccgctgcaggaggtgctcaccgtcctgccgcggntgtgcaagtcctgggggcgggtggtgggcggcccctactgctggcaggagatcgacatcgaggagtggagccagcgcagaggaaggcggagcagaacgcccgcatggtcaagctaccggggggccgcagcgccgggatcgtgcccgcggatccagcgcctccgtactggcattggag

SEQ ID NO: 21885 - protein, 98 aa, Zea mays
  misc_feature: Ceres CLONE 1391341-F
  misc_feature (40)..(40): Xaa is any aa, unknown, or other
MGECEDGKEYRCWEELLPDALGLIFRNLPLQEVLTVLPRXCKSWGRVVGGPYCWQEIDIEEWSQRRGRRSRTPAWSSYRGAAAPGSCPRIQRLRTGIG

SEQ ID NO: 21886 - DNA, 716 bp, Zea mays
  misc_feature: Ceres CLONE 1391342-F
  misc_feature: Encodes the peptide sequence at SEQ ID NO. 21887
gctctagtactagtggatcccccgggctgcaggaattcgcacgagaccattacctagaacatccttaatcgaaaaacaagtaaagcagcagcagcagaccttcttgacctagcaagcaatggggccgccgttcctcgccgtcgccgtcatcgtcgccttcctggccgccgccgcgcaggccgccgaccccttcgccttcttcgactgggacgtctcctacatcaccgcctcccctctcggcgtcccgcagcaggtcattgcagtcaacaagcagttcccaggccctatcatgaacgtcactaccaactataatgtggtcgtcaatgtgctcaacagcttagacgagcccctgctcatcacttgggatgggatccagcagcgcaagaattgctggcaggatggggttctcggcaccacctgccccataccgccaggttggaactggacctacaacttccaggtcaaggaccagattggcagcttcttctacttcccaccccttggtatgcagcgtgccgccggggggctcgtaggcattcactgttaacaaccgcggcgtccatctcggtccaattccatacccccggcgacccacgccgcgctcttcacacggggacggtcaagaatgcacctcacgccctccgcgcaatacacctctaccccgccgcgcgcttgtgcatacctcaaacttcttcttaacgcacactactactccg

SEQ ID NO: 21887 - protein, 142 aa, Zea mays
  misc_feature: Ceres CLONE 1391342-F
  misc_feature (31)..(140): Pfam Name: Cu-oxidase_3 Pfam Description: Multicopper oxidase
  misc_feature: SWISSPROT Homolog: EC 1.10.3.3 L-ascorbate oxidase
MGPPFLAVAVIVAFLAAAAQAADPFAFFDWDVSYITASPLGVPQQVIAVNKQFPGPIMNVTTNYNVVVNVLNSLDEPLLITWDGIQQRKNCWQDGVLGTTCPIPPGWNWTYNFQVKDQIGSFFYFPPLGMQRAAGGLVGIHC

SEQ ID NO: 21888 - DNA, 674 bp, Zea mays
  misc_feature: Ceres CLONE 1391350-F
  misc_feature: Encodes the peptide sequence at SEQ ID NO. 21889
  misc_feature (674)..(674): n is a, c, t, g, unknown, or other
aaagctggagctccccgcggtggcggccgctctagaactagtggatcccccgggctgcaggaattcgcacgagaccattacctagaacatcctaatcgaaaaagcaccagttgcttcacggcttcatcatcactccactagccagtcagctactggcctacagctagccgcctcctctcctctcatcccatcccatctcatctccgacaagcgaagcagagcactggcatgagcatggaccgcatggcgcggcgttccgtgtccttgctcctcgctctggctctcctggccgccgcggcgtcggcggactcgtggctgtacgagaagttcacgacggagggcaacgtgcgcgcggactacaacgcgcaggggcagcaggtgacgtctctgatcctgacgcagcagtccggcggcgccttcagctcgcggcagaagtacctgtacggggagttcagcatccagatgaggctgatcccgggcaactccgcgggcaccgtgacctccttctacctgtcgtcgggcgacgggcccgggcacgacgagatcgacatggagttcatgggcaacgccagcgggcagcccgtggtgctgaacaccaacgtgtgggccaacggcgacggcaagaaggagcaccagttctacctgtggttcgacccggccgccgacttccacan

SEQ ID NO: 21889 - protein, 148 aa, Zea mays
  misc_feature: Ceres CLONE 1391350-F
  misc_feature (30)..(148): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MSMDRMARRSVSLLLALALLAAAASADSWLYEKFTTEGNVRADYNAQGQQVTSLILTQQSGGAFSSRQKYLYGEFSIQMRLIPGNSAGTVTSFYLSSGDGPGHDEIDMEFMGNASGQPVVLNTNVWANGDGKKEHQFYLWFDPAADFH

SEQ ID NO: 21890 - DNA, 735 bp, Zea mays
  misc_feature: Ceres CLONE 1391351-F
  misc_feature (301)..(301): n is a, c, t, g, unknown, or other
  misc_feature (319)..(319): n is a, c, t, g, unknown, or other
gctctagaactagtggatcccccgggctgcaggaattcgcacgagaccattacctagaacatcctaatcgaaaaagtgccaccactcgccagctcgccacttcctcccgtctcctcccttgcagaggcggcgcgtaaaccccgatggccgcctctctcctccacgccgccgccgccgccgcctcgctcctgagctccacccagcacgcccgcgcgggtgccgccgcctttcaccccctcgcgtgtgccccatccctacgccttacgcgctcctcgttctcgaccaatcgccacctcgaganttcactcccggcgatctncggcagtcgccgtttcgcggggaggggggcaccccgggaccgccgcgttgtcgccgccctaccggggaagaaaccgagggtcagaggtgggggaagacagaaacgggaaaaaaaagcccgaggaaacccggaaaatttggaagaaagggtggagcaatcaaggctggggcccgggggaagcaccccccgcaaggggaggttttgggggccacccccaaggggggagagaggtcctgtgggacaacctctaaaagctggaaataccgggaaaaaaagccaaaaaatccctggccggggcaatctcaaaaatgggcggcagggacacaaaattctgtggagggcgcctatataaagttaaacctccgacacacaaacctacttaaaaatcattcaagacactacacccgcccacccgg

SEQ ID NO: 21891 - DNA, 802 bp, Zea mays
  misc_feature: Ceres CLONE 1391352-F
  misc_feature: Encodes the peptide sequence at SEQ ID NO. 21892
ccccgcggtggcggccgctcatacatagaggatcccccgggctgcaggaattcgcacgagaccattacctagaacatcctaatcgaaaaaaccaccgcacctagctcgggcatccatccactctcgtccccgtcccgtacttacctgactgagctcacacacacacgtacgatgccgaagccgtggaggccggtgctggcgtcggccaccaagtgctgcgcggtggaggacgcggcggtggagccggacggcctggtgcggtgccggccgcagcagccgtagctgtcgcagcgtctggcgtacttaaggagcctctcgtcggtgggcaacagaccggggtccgccaccgcccccaaggtggcgaacaaggccggtgtttgttgcgatgccccgaaactgcaacaagaatggaggttccccttaactgtccccccgtaagcctggtgacagccccccaggctgaccctcacttatttcagcaaacaatttaacgaaaaggctcgtcccccccctcccgggaggaattataaatccgagcgaaacgccccccccctccccgcggacctcttcctccgtctttcttcgcggccccgaggccacaaatatccccacctaatctccccccgaagtacgcgcctcttacgactcgctcaccccgtgccagaacaacatttaacccaccacaccctacttatacaccctcaccatgatgttatcacccccaccctccaccctatcactcaacccacctctaaattcttactcctctccaacccccaccctaaattcccttcaattcatc

SEQ ID NO: 21892 - protein, 36 aa, Zea mays
  misc_feature: Ceres CLONE 1391352-F
MPKPWRPVLASATKCCAVEDAAVEPDGLVRCRPQQP

SEQ ID NO: 21893 - DNA, 726 bp, Zea mays
  misc_feature: Ceres CLONE 1391356-R
ccaattgggtaccgggccccccctcgaggtcgacggtatcgataagcttttttttttttttttttcaggaattatcatgtgattcctttatcttccatataattaatacaccgcatcatcacaagcaagtgggggtcactatggcacattatgttctcataaataaactggcatgcgttccctagcacaatataatcgacttccctagggcgaccggatcgattcggtgcttttactcgatcttattgaggtgaagaatctactgaaccaccaactgtggccgtcaatattggttagtgccttcccttaccttcgcaaccctcgaacccccacagagatggttcgtccgcttctaagctgtggtgaaggggattgatctgcaggataacctcatctgctctcctaccaagcctctgccgaatacagggctatcctcgcatttactagaagatgactccagatccctgccacctaacccgccagaactcgcaatgacactccccccagtgaatttcctctcacgaaaacatccccgtgatctgctagtctgctcaccaccttcatcagccgtttctggtcgacagaatacccagctccgactgcgcgtaccacgctgcatgattactgactacctgggaagtccacaatgaccttgcgcatgactcgccttggtccccaaccaagctatggtcctttccccagcatctttttccagagtttctgctt

SEQ ID NO: 21894 - DNA, 703 bp, Zea mays
  misc_feature: Ceres CLONE 1391356-F
  misc_feature (336)..(336): n is a, c, t, g, unknown, or other
tcaccgcggtggcggccgctctataactagtggatcccccgggctgcaggaattcgcacgagaccattacctagaatcttatactaaaaaggtttcgtctcgaacgacgctctcctttccagtgtccaccaccgatcggctccccatatcgcccgcaacccccctcccctgcaagatgcgggtctcgatgctgcgcactagagtgtcgtggcaccactacagagccaagggctccatatccaagatactctcagcatctcctggtcctccaaaatgtggcatgcgctgccaccgccgacagcggcggcggcaccgtccccttctacccgtccgcgnagtacggcgccgccgcgcactgcgacggcacgctggacccggaggtctgcctgtcgaaactcgcggacatcccggacctacacagaagcggttccggacgcatctgggcggccgtgaacggaccgaggaaagggttgggtctaactcctagcaaatgttttactactctcgagcagcccccctgtgagctaggcgcgaaggggtgtttacacgtttcgcgaagcacgatcaacatagcgagcacacgtacaagaaggccattacaatcacttatcatccggaagcgcagcgcacccttccccgtatccatacgcactaacagatacagccatgagaaggaaacctcaaacccccacaagactgctca

SEQ ID NO: 21895 - DNA, 754 bp, Zea mays
  misc_feature: Ceres CLONE 1391359-F
  misc_feature (237)..(237): n is a, c, t, g, unknown, or other
  misc_feature (324)..(324): n is a, c, t, g, unknown, or other
  misc_feature (379)..(379): n is a, c, t, g, unknown, or other
  misc_feature (437)..(437): n is a, c, t, g, unknown, or other
  misc_feature (461)..(461): n is a, c, t, g, unknown, or other
  misc_feature (462)..(462): n is a, c, t, g, unknown, or other
  misc_feature (484)..(484): n is a, c, t, g, unknown, or other
  misc_feature (611)..(611): n is a, c, t, g, unknown, or other
  misc_feature (613)..(613): n is a, c, t, g, unknown, or other
ccccgcggtggcggccgctctagaactagtggatcccccgggctgcaggaattcgcacgagaccattacctagaacatcctaatcgaaaagttccgcttcgtcccagcctccagttcttcctttcctccctagtgatcggccaaatggtactcagattgggccccgattccgcctttccattccatcgcgaagaacgccgccgaaatgccacgcctccccgataaccatcaggaggnagctcggcgggccgtcttgctccactgcttctcaacattgcgctaccctccccccccccaagaaactggccgaatgaggttcgaggnaccgaaccggcgacgccgcgcgccgcccgctgtcggaggcgcccccccaaaagantgggagtttttctaacaagattctccgaggggccccctctgcgggggggacccccaanccggcagtggggggcctcgagggnnctacggggagggcgtgtttggncgcccgaaagttcggggtttgggaaaaaaaaaagaagggccaacgcgctgaccccggcagctggattcaggggaaaaaaaacaaggggggctccctggggaagttgcccgggtccaagaactcaggntnccccccggggggcctctccggaaaaaacggacgtgtgcgcgcgctccgcccctgtttcatcgaggccgggataaagggttccctctctttcgcccacctgtcctccatctttctatcgatctctccaacatctcccccccc

SEQ ID NO: 21896 - DNA, 758 bp, Zea mays
  misc_feature: Ceres CLONE 1391362-F
  misc_feature: Encodes the peptide sequence at SEQ ID NO. 21897
  misc_feature (1)..(1): n is a, c, t, g, unknown, or other
  misc_feature (2)..(2): n is a, c, t, g, unknown, or other
  misc_feature (42)..(42): n is a, c, t, g, unknown, or other
  misc_feature (43)..(43): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (54)..(54): n is a, c, t, g, unknown, or other
nngggggggggccccccccccccccccgtcccccctgcctcnntccnnnnaaancccagagctggagctccccgcggtggcggccgctttcacaatagtggatcccccgggctgcatgaattcgcacgagaccattacctagaacatcctaatcgaaaaacacacatattattgagaccaactagcaacatagaaagcacaatagtgtaccaacagatggcagctaaaatattttgcctccttatgctccttggtctttctgcaagtgctgctacggcgaccattttcccacaatgctcacaagctcctatagcttcccttcttcccccgtacctctcgccaacggtgtcttcggtatgtgaaaacccaattcttcgaccctacaggatccaacaggcaatcgcagctggcatcttacctttgtcacccttgttcctccaacaatcatcagccctattacagcagttacctttggcgcatttattgccacaaaacatcagggcacaacaactacaaaaacttgtggtagcaaaacttggtgcccactcaccagcaaacaggaaggttcccttccatttcaaccaaattagctggagttgaaactctgctttcttaatttgggaaaaaacaaccacctaaccatttcagccccaggtattcctggctggcccaaccccccccgccaattttttcctttcccatttccaaacccaaacgggaaagagggattttgtaaacccccccccctgggataaaaa

SEQ ID NO: 21897 - protein, 127 aa, Zea mays
  misc_feature: Ceres CLONE 1391362-F
MAAKIFCLLMLLGLSASAATATIFPQCSQAPIASLLPPYLSPTVSSVCENPILRPYRIQQAIAAGILPLSPLFLQQSSALLQQLPLAHLLPQNIRAQQLQKLVVAKLGAHSPANRKVPFHFNQISWS

SEQ ID NO: 21898 - DNA, 712 bp, Zea mays
  misc_feature: Ceres CLONE 1391366-F
  misc_feature: Encodes the peptide sequence at SEQ ID NO. 21899
  misc_feature (299)..(299): n is a, c, t, g, unknown, or other
gctctataactagtggatcccccgggctgcaggaattcgcacgagaccattacctagaacatcctaatcaaaaaaaaaaacatcactccctcgcgaaccccaagaactgcagcgacggcaatggcgatggcggcggagggcgcggcgagcgagccagagctggtgtcgatcccggcgacgccgcacggtctgtcgacgccggagggcgcggccacgccgaccggagcgggcgggggcggcggcggcaggagcaagggctccgggaccccagggcgtcgcgtggtggaggtcctgcgcgngtacctggaggacgtgggccacctcacgcgcctcgacccgagcgacgcctggctgcccgtcaccgagagccgcgtcggcaactccccccacgccggtttcctctctcctcgcccccggcttcagataaccagtcttttctcctcagggtcgccttcgcggaaccttgatcggtacgtagcccaccctctgcttccgcccacgcgccacttcccgccaccgccccgtgttgcggcccccatttgtacttgtttttttttggcaggggcgggccactcccatgcttaccagcgttcatctgcgactcgtccgtcctatcccgcgtctcgcctccctctctactgagacttacttcccgcctgttgtcgcggcacccttcatttacaattttctcttccttggtcttattgtctat

SEQ ID NO: 21899 - protein, 173 aa, Zea mays
  misc_feature: Ceres CLONE 1391366-F
  misc_feature (60)..(60): Xaa is any aa, unknown, or other
MAMAAEGAASEPELVSIPATPHGLSTPEGAATPTGAGGGGGGRSKGSGTPGRRVVEVLRXYLEDVGHLTRLDPSDAWLPVTESRVGNSPHAGFLSPRPRLQITSLFSSGSPSRNLDRYVAHPLLPPTRHFPPPPRVAAPICTCFFLAGAGHSHAYQRSSATRPSYPASRLPLY

SEQ ID NO: 21900 - DNA, 703 bp, Zea mays
  misc_feature: Ceres CLONE 1391369-F
  misc_feature: Encodes the peptide sequence at SEQ ID NO. 21901
cgcgggggcggccgctctataactaggggatcccccgggttgcaggatttcgcacgagaccattacctagaacatcctaatcgaaaaaagaagctttacagtgaacgagtgagtatgtgcggcatacttgctgtgctcgggtgcgccgacgaggccaagggcagcagcaagaggtcccgggtgctggagctgtcgcggcggctgaagcaccggggccccgactggagcggcctccggcaggtgggcgactgctacctctctcaccagcgcctcgccatcatcgacccggcctctggcgaccagcccctctacaacgaggaccagtcggtggtcgtcgccgtcaacggcgagatctacaaccacctggacctcaggagccgcctcgccggcgcaggccacagcttcaggaccggcagcgactgcgaggtcatcgcgcacctgtacgaggagcatggagaagagttcgtggacatgctggacggcgtcttctccttcgtgctgctgtacactcgccatgtcgaccgcgcggataagtatcttcttcatgtctgcctccgacccccgacggtgcgatgcccctctacatcgcatgcggactcacttattacacctcctctctaccccacccacgcctcctcttgcataggctccgctgaccttcctaggatctcagtacgttcggtttgcgtatctaaggcgtccg

SEQ ID NO: 21901 - protein, 196 aa, Zea mays
  misc_feature: Ceres CLONE 1391369-F
  misc_feature (2)..(158): Pfam Name: GATase_2 Pfam Description: Glutamine amidotransferases class-II
  misc_feature: SWISSPROT Homolog: EC 6.3.5.4 Asparagine synthase (glutamine-hydrolyzing)
MCGILAVLGCADEAKGSSKRSRVLELSRRLKHRGPDWSGLRQVGDCYLSHQRLAIIDPASGDQPLYNEDQSVVVAVNGEIYNHLDLRSRLAGAGHSFRTGSDCEVIAHLYEEHGEEFVDMLDGVFSFVLLYTRHVDRADKYLLHVCLRPPTVRCPSTSHADSLITPPLYPTHASSCIGSADLPRISVRSVCVSKAS

SEQ ID NO: 21902 - DNA, 701 bp, Zea mays
  misc_feature: Ceres CLONE 1391370-F
  misc_feature: Encodes the peptide sequence at SEQ ID NO. 21903
  misc_feature (385)..(385): n is a, c, t, g, unknown, or other
  misc_feature (452)..(452): n is a, c, t, g, unknown, or other
  misc_feature (520)..(520): n is a, c, t, g, unknown, or other
  misc_feature (521)..(521): n is a, c, t, g, unknown, or other
  misc_feature (548)..(548): n is a, c, t, g, unknown, or other
cgctctagaactagtggatcccccgggctgcaggaattcgcacgagaccattacctagaacatcctaatcaaaatcaagctagctaggtaactgtgcaattagatgagtcagtagataagctgttccgtcttagcttatctaccgatcgagctcgcggtaatggcgatgatggtatggaataacactcgaccccgcaagctgtcgctgccatgccgcacccgtactttccaagccttaatactaagcacagcagtcttcctggctgcttccacggccgtcgtcgtcgggaaggagccacaaccaccgtcctcctccggcggcgtgtgtcactaccgcttcgagctcacccacgtagatgccaacctcaaccttaccagcgacgangttgatgcgtcgtgcctatgacaggagccgcctccgcgcggcgagcttggccgcctactcggacggncgacacgaagggcgcgttagcattcctgacgcctcgtacatcatcacgttttacttgggcaacagcgnnccgaggcaccaatctcggccgtcgtgnacaccggcagcgacataatttggacgaccgagaaaggagggacccggcccaagacaagggccatggtgccttgctgcaaccccaggggcaagcaggcccccactggggttgcgaacaaacgaactcaggcccaaacccgaaaggagacaaggg

SEQ ID NO: 21903 - protein, 81 aa, Zea mays
  misc_feature: Ceres CLONE 1391370-F
  misc_feature (75)..(75): Xaa is any aa, unknown, or other
MAMMVWNNTRPRKLSLPCRTRTFQALILSTAVFLAASTAVVVGKEPQPPSSSGGVCHYRFELTHVDANLNLTSDXVDASCL

SEQ ID NO: 21904 - DNA, 720 bp, Zea mays
  misc_feature: Ceres CLONE 1391371-F
  misc_feature: Encodes the peptide sequence at SEQ ID NO. 21905
tcaccgcggtggcggccgctctagaactagtggatcccccgggctgcaggaattcgcacgagaccattacctagaacatcctaatcgaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccggtctcgcccgcgcagagcttcgtgtcgcaggaagacgtcatccaactcgcgaccgcagatgctggatgacagtaccacgccccaacgcccggttcaaaatataaaccatcaaccacaccagcgccgccttctaataaactccctcatcccatcttacgcgccttctgtctcctcaatacttgtgactccccctgttctatatcaccatctataccgacccctgattttttccctctttttcccactccacctcaaccccttcccccacgtccatg

SEQ ID NO: 21905 - protein, 125 aa, Zea mays
  misc_feature: Ceres CLONE 1391371-F
  misc_feature: SWISSPROT Homolog: EC 4.1.2.10 Mandelonitrile lyase
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTSPVSPAQSFVSQEDVIQLATADAG

SEQ ID NO: 21906 - DNA, 692 bp, Zea mays
  misc_feature: Ceres CLONE 1391374-F
  misc_feature (220)..(220): n is a, c, t, g, unknown, or other
  misc_feature (221)..(221): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (230)..(230): n is a, c, t, g, unknown, or other
  misc_feature (232)..(232): n is a, c, t, g, unknown, or other
  misc_feature (233)..(233): n is a, c, t, g, unknown, or other
  misc_feature (235)..(235): n is a, c, t, g, unknown, or other
  misc_feature (240)..(240): n is a, c, t, g, unknown, or other
  misc_feature (242)..(242): n is a, c, t, g, unknown, or other
  misc_feature (244)..(244): n is a, c, t, g, unknown, or other
  misc_feature (246)..(246): n is a, c, t, g, unknown, or other
  misc_feature (252)..(252): n is a, c, t, g, unknown, or other
  misc_feature (258)..(258): n is a, c, t, g, unknown, or other
  misc_feature (261)..(261): n is a, c, t, g, unknown, or other
  misc_feature (264)..(264): n is a, c, t, g, unknown, or other
  misc_feature (267)..(267): n is a, c, t, g, unknown, or other
  misc_feature (322)..(322): n is a, c, t, g, unknown, or other
  misc_feature (384)..(384): n is a, c, t, g, unknown, or other
  misc_feature (408)..(408): n is a, c, t, g, unknown, or other
  misc_feature (409)..(409): n is a, c, t, g, unknown, or other
  misc_feature (440)..(440): n is a, c, t, g, unknown, or other
  misc_feature (530)..(530): n is a, c, t, g, unknown, or other
  misc_feature (597)..(597): n is a, c, t, g, unknown, or other
cgcggtggcggccgctctagaactagtggatcccccgggctgcaggaattcgcacgagaccattacctagaacatcctaatcgaaaaaacccaacccaacgacgcagctagcgcgcatctccgatctgcactgcaccttcgtctccgaagaacgtcgatcgtactcgtacaccatgaaggcagtcgtcgcggcgacgatgcttctggctggtgctggtgnncnnnnngangnngncgagngnanancaccgngatganganggncancaccaccagcgacaccgcggccagagccggcaccgcgcacagcggcggaccccgncgagacgcgcggaagaacccaccggcgacgcacacacagggcgcggaaaggagaaacgccanaggaagcaccgccacgacggaccnngcaaccagcccccgcccccaggaacaagacncagcccccgcaacgcgcacgggcagaccccaccgacgaaaaaaccccgcccccccagggcacccgaccaacaacgcagagcggacgccgngaaacagccggggcgcgaccgccgggcggcagagccacccaccaccacccccgcccacgacgcaccngagcccgaccgaaaaaaaacacacacacaaacgcacaccacgacgacgccccgcacccaaccaccgaggcgggcgcaacgacacgagccgccacc

SEQ ID NO: 21907 - DNA, 717 bp, Zea mays
  misc_feature: Ceres CLONE 1391377-F
  misc_feature: Encodes the peptide sequence at SEQ ID NO. 21908
  misc_feature (316)..(316): n is a, c, t, g, unknown, or other
gctctagaactagtggatcccccgggctgcaggaattcgcacgagaccattacctagtacatcctaatcgaaaaacctgccacatctggccatctctcagtctcacacgcgctgccatggacggatccatgtggtgcgctgccaactacgtgcctctgacgccgctcagcttcctggagcgcgccgcggtcgtgtacggcgaccgcgcggccgtcgtttgcggcgataggcggttctcgtggcgcgagacgagggagcggtgcctcgccggggcagccgctctcgctcgtctcggcgttggccgccgtgacggggncgcggccctcctcctctccgtgccgccccggctcccggctcctttctccgtttcttcttttgttcccccccccctctccctccctttccctcccccctgccgcccgcgggtgctgccctgcccctcccgttctcgtcttccttgctctcgtcccttcccgcccctgtgggccttttcctttccttcttcccctcctccccgccccggggtcgtcccttctctcctcttcctcgccgggcgccggtgtgtcttctcttccccttttttctgtttgcccgcttccgcctcgccccccccccccttctccccgcgttctctgtctttgttgttctctcgcccccccctgcctttctctcccttctcccgccccgctcgctccttccttcctctcccccttcctt

SEQ ID NO: 21908 - protein, 200 aa, Zea mays
  misc_feature: Ceres CLONE 1391377-F
  misc_feature (67)..(67): Xaa is any aa, unknown, or other
MDGSMWCAANYVPLTPLSFLERAAVVYGDRAAVVCGDRRFSWRETRERCLAGAAALARLGVGRRDGXAALLLSVPPRLPAPFSVSSFVPPPLSLPFPPPCRPRVLPCPSRSRLPCSRPFPPLWAFSFPSSPPPRPGVVPSLLFLAGRRCVFSSPFFCLPASASPPPPFSPRSLSLLFSRPPLPFSPFSRPARSFLPLPLP

SEQ ID NO: 21909 - DNA, 710 bp, Zea mays
  misc_feature: Ceres CLONE 1391381-F
  misc_feature: Encodes the peptide sequence at SEQ ID NO. 21910
  misc_feature (349)..(349): n is a, c, t, g, unknown, or other
  misc_feature (355)..(355): n is a, c, t, g, unknown, or other
gctctataactagtggatcccccgggctgcaggaattcgcacgagaccattacctagaacatcttaatcgaaaaataaactagacgagaagagagagagagggagagaggggaaagttgattctctctctgacccgcccactccctccttccctgctccggtcgcactccgtcgttcctccgcgcacgtacgtacagcagccagacacgagatcgagtggtacagggcccgccagaaacctcacgagctagctggttcctgatcggcggcctgtgccgcgcgccgatccacgcatggcgccgccgctcctgcccgcgcgcttcgtcgccgcctccgtcgcgctgctcgncgtcgncttctcctcctctctaacgcgtccgtcaggtgcatacgatccgctccgatccgacggggacataacatcaagtgggacgggatacaggggactgggatgggtatggggcggcgttttcttataaactaccggaggaccgcccttcccgggggccgggggggagttaagggtgggtgggggcaaaaaagggggggttcggggccataaccgcgcgtccaaccccccacaaaagggaactgtgctccggtaaaggggccgggctcccccccccgtgtggtgggggggccccggggggtgttgtattccgcgccgtcatctccccgaagtcgctcaatcgcacactttttgcttattg

SEQ ID NO: 21910 - protein, 61 aa, Zea mays
  misc_feature: Ceres CLONE 1391381-F
  misc_feature (19)..(19): Xaa is any aa, unknown, or other
  misc_feature (21)..(21): Xaa is any aa, unknown, or other
MAPPLLPARFVAASVALLXVXFSSSLTRPSGAYDPLRSDGDITSSGTGYRGLGWVWGGVFL

SEQ ID NO: 21911 - DNA, 709 bp, Zea mays
  misc_feature: Ceres CLONE 1391382-F
  misc_feature: Encodes the peptide sequence at SEQ ID NO. 21912
cgctctagttctagtggatcccccgggctgcaggaattcgcacgagaccattacctagaacatcctaatcaaaagcggtttgtggtcgccggacttctgctgcttgatcggaccaggctagcgacgtacgcccctatgccgcgcgcgtcatgggacggcctccgagtctgcgccgagatctgtctcgggcacgggggggcgccgctgtagctgctgccgtcgagacgactgctttccgacgaccaccgatcagcgaccactgggcgagacgccgcagctagctgcgctttgaagcatggtgcgtgttgaacaagttactgcagaagggcctgaaactaatcagcatgatgagcagcgctccatacgtttacatgcattttctgatctatcacacgtccctgcagccacttttatttatctcttagaggactgctatggatatggtacgaacaaagcaacctcaaagtttaagatcctcatgcagctggtaaaagtggcattgcataatggtccacagccaggcccggttacatatgttgcccagggcatgcaaattggacctttggtggggaaaactaattctggaagggttcagcccggtggtggcatccgctttaccgggctggcagtctgtgggaacttgctaggagaaaatcggtgtgggtgtaagctctctgcctgcttgtggtctttgtgctcctttatacaa

SEQ ID NO: 21912 - protein, 138 aa, Zea mays
  misc_feature: Ceres CLONE 1391382-F
MVRVEQVTAEGPETNQHDEQRSIRLHAFSDLSHVPAATFIYLLEDCYGYGTNKATSKFKILMQLVKVALHNGPQPGPVTYVAQGMQIGPLVGKTNSGRVQPGGGIRFTGLAVCGNLLGENRCGCKLSACLWSLCSFIQ

SEQ ID NO: 21913 - DNA, 740 bp, Zea mays
  misc_feature: Ceres CLONE 1391383-F
  misc_feature: Encodes the peptide sequence at SEQ ID NO. 21914
  misc_feature (243)..(243): n is a, c, t, g, unknown, or other
  misc_feature (525)..(525): n is a, c, t, g, unknown, or other
  misc_feature (727)..(727): n is a, c, t, g, unknown, or other
tcacccgcggtggcggccggctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccnacgaggagatcttcctccgcgagcttatctccaactcttccgatgcgctggacaagatcaaggtcgagagtctcactgacaagagcagctcgatgcgcagcctgaacttttcatccacttgccccaaaaaaggcagaaaaagttttccattatggaaggggaattcggatggccaatccgaacttggcaaaaccccgggaacctccccagggccgggaaaaaagagattttgggaaacccttggcgcccggtggggggccccattttggccacttcccgccntttttttacttcccccccccccgcgcgaaaagaggggtcgggcaccccccccaccccttggtagggttttgggggtggggccccccgggggggggttctcttttttttttctccacccccccgaggttcctctcgtgccacaaacaaaccacacccccttttaacaaacgcaattggtagctccagctagcgctcgcccctnctgccttgcaaaa

SEQ ID NO: 21914 - protein, 175 aa, Zea mays
  misc_feature: Ceres CLONE 1391383-F
  misc_feature (28)..(28): Xaa is any aa, unknown, or other
  misc_feature (122)..(122): Xaa is any aa, unknown, or other
MASETETFAFQAEINQLLSLIINTFYSXEEIFLRELISNSSDALDKIKVESLTDKSSSMRSLNFSSTCPKKGRKSFPLWKGNSDGQSELGKTPGTSPGPGKKRFWETLGARWGAPFWPLPAXFLLPPPPREKRGRAPPPPLGRVLGVGPPGGGFSFFFLHPPEVPLVPQTNHTPF

SEQ ID NO: 21915 - DNA, 721 bp, Zea mays
  misc_feature: Ceres CLONE 1391387-F
  misc_feature: Encodes the peptide sequence at SEQ ID NO. 21916
  misc_feature (361)..(361): n is a, c, t, g, unknown, or other
  misc_feature (378)..(378): n is a, c, t, g, unknown, or other
  misc_feature (381)..(381): n is a, c, t, g, unknown, or other
  misc_feature (382)..(382): n is a, c, t, g, unknown, or other
  misc_feature (409)..(409): n is a, c, t, g, unknown, or other
  misc_feature (448)..(448): n is a, c, t, g, unknown, or other
  misc_feature (721)..(721): n is a, c, t, g, unknown, or other
aagctggagctccccgcggtggcggccgctctagaactagtggatcccccgggctgcagcaattcgcacgagaccattacctagaacatcctaatcgaaaaaccgcatacaccgctgcccgcgcgcagccgcgcaggtgcatctgcgccgccgccggcccgccgcacccgcacgtctccttatacccatccggccatctacacacggcagtccacgctcgtggcaccgcactcactccgaatcctgaagcaacaaacaccagaagcgcaccaactccccaaccaccggagaccgcaccccagcaaaggatgtcatctgactccacggccgccgtgacggtggacggcagcgcgcttgcggngcgcgcgctggccgcgncgnncacgcggcacatgttcggggtggtggncatccccgccacctccctcgcgtcccgtgccgccgcggncggggtccgcttcctctctttgcgcaccgagcagtgcgggttgtacacagccgccaccaagaccgtcattgggggatccccaggagacccactgaaccgtccccggaagaagatgcgtgcacaggttcgtgtggccgaaactacactcgcagccccctgtcgcccctctctatgttacgccggcctctgttataagatatgcgccctccccccccccactttcggtgtgttatgcgacgaacgcctcgcaatataccatcttctccctaccgn

SEQ ID NO: 21916 - protein, 137 aa, Zea mays
  misc_feature: Ceres CLONE 1391387-F
  misc_feature: SWISSPROT Homolog: EC 4.1.1.8 Oxalyl-CoA decarboxylase
  misc_feature (18)..(18): Xaa is any aa, unknown, or other
  misc_feature (24)..(24): Xaa is any aa, unknown, or other
  misc_feature (25)..(25): Xaa is any aa, unknown, or other
  misc_feature (34)..(34): Xaa is any aa, unknown, or other
  misc_feature (47)..(47): Xaa is any aa, unknown, or other
MSSDSTAAVTVDGSALAXRALAAXXTRHMFGVVXIPATSLASRAAAXGVRFLSLRTEQCGLYTAATKTVIGGSPGDPLNRPRKKMRAQVRVAETTLAAPCRPSLCYAGLCYKICALPPPTFGVLCDERLAIYHLLPT

SEQ ID NO: 21917 - DNA, 712 bp, Zea mays
  misc_feature: Ceres CLONE 1391388-F
tggagctccccgcggtggcggccgctctagaactagtggatcccccgggctgcaggaattcgcacgagaccattacctagaacatcctaatcgaaaaagacaaccaaatgaaacctcccggagcagcataggatatgcgctggagtgctccttccagagctcgtccggctcacggatgcgcgtcgtgtacccccacgccctgatcgtcgtcatcgggcggccgcctgcacgtcgtgcaactccgctcggcgagagtcggctctcagcgtatgtcgtcacgtgaagatctgccctactcctgagagatctgcgtccgctcgcgatgtcgtgacgatatggaagcgctgctcgttgtgtttcaggtgaattttgcccgcagttcatgacagatgcagcgaatatgctgcagcgcgtcggggcaggcggctcacggagaggtggcgatgttttgctcaggctactctggcatgcttggtgctggagcgttgccacatgggcgtcgacgaggtgagctggtttattatttcaacagcggcatatgcaacagcttgtagctgctactgaatgacaacttgatcagcacttgactttgcttaatagtacgcgcaagatcctcctgcaaggtggtcagtgtacaacttacagctgagactgattcgtgatgaagttgatgctcaaattatgctgcaaccacaaacagagcatagtgagc

SEQ ID NO: 21918 - DNA, 1033 bp, Zea mays
  misc_feature: Ceres CLONE 1391388-R
tcgattgtatcgataagcttttttttttttgtttttattttttattaaaaaagcatagtgaccacacaaatcattaagcaatccatcaaatatgaactgacagctaagtcaacccagtataaactaacctacaaaaaggataagaattaagtaatgataaactaaaaccgaaaagatactttgacatgaccatcatggcgtcatacaccaaaaaaactcaggctgagaaactctgcaacttccgcaagcgcttcacagcaaatgaaggcggtttcttaaaaaccttcttttcgaattttccctttggctaagcctccttcaatggggtcggtgttatggaacctggctggacccccttttgtagggggtttcctcttggagaccccaaggggggacccctcaaaactggggggtggaaaaggatttaaaggtttccaaaataaaataattagttgaagggaagacccgcacccttttttcaccacctcatcgtcccagatgttttggggagaaaagagattaacctttacgcggcccacccagtgtccctgtaagaaaagattttaccagagaaggggtttttatgaagcagagtatttgtgagaaggcgcttcccgcctctctacttgtggcgccacctttatcccaccaaattaagaaatgtgagtgtcgtcctcctacggtggggaagagatctcactgggggagggtggtcgggcgcgaccctctttttttgttggtgacgaagagacgtcctctgtttgagttcgaacgcaccatgatttcatagaaagtacgttgttactagaaggggtggacgattcttctgaaaacgtggtaatgggaaagagtgaaaggttcacatgctaagaggcacgtatacagatgtcgtgtgggggaaggagcctgtcttggggggaggaggggtataaattcgcctcaagtaaagcatacgtgtggttgatagggaacgcacatcgaatgggagcgtcgtggggatgagtgttgaggcggcacttgcgggcggcaggcg

SEQ ID NO: 21919 - DNA, 695 bp, Zea mays
  misc_feature: Ceres CLONE 1391389-F
  misc_feature: Encodes the peptide sequence at SEQ ID NO. 21920
  misc_feature (599)..(599): n is a, c, t, g, unknown, or other
  misc_feature (601)..(601): n is a, c, t, g, unknown, or other
  misc_feature (620)..(620): n is a, c, t, g, unknown, or other
  misc_feature (664)..(664): n is a, c, t, g, unknown, or other
tccccgcggtggcggccgctctagaactagtggatcccccgggctgcaggaattcgcacgagaccattacctagaacatcctaaaaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacaccttcccggtctcgcccgcgcagcgcttcgtgtcggaggacggcgtcatcaactcgcgcccgcgggtgctgagcgtcggcagctgcatcaacgccggcttctacacgcgggccagcgacgactacgtgcgggggcgtcggggtgggaactgggcgccgccgntncggcgtaccggcgggctgnagcccgcggccccgccccgggcgccgctgggccccccgcagggnccccggcctctttctccggcccttcctcccc

SEQ ID NO: 21920 - protein, 186 aa, Zea mays
  misc_feature: Ceres CLONE 1391389-F
  misc_feature: SWISSPROT Homolog: EC 4.1.2.10 Mandelonitrile lyase
  misc_feature (155)..(155): Xaa is any aa, unknown, or other
  misc_feature (162)..(162): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTFPVSPAQRFVSEDGVINSRPRVLSVGSCINAGFYTRASDDYVRGRRGGNWAPPXRRTGGLXPAAPPRAPLGPPQGPRPLSPALPP

SEQ ID NO: 21921 - DNA, 700 bp, Zea mays
  misc_feature: Ceres CLONE 1391392-F
  misc_feature: Encodes the peptide sequence at SEQ ID NO. 21922
  misc_feature (462)..(462): n is a, c, t, g, unknown, or other
ccccgcggtggcggccgctctagaactagtggatcccccgggctgcaggaattcgcacgagaccattacctagaacatcctaatcgaaaaaaggaaaaaagaaaaatggcgcagctggtggagacgtacgcgtgctcgccggccacggaacgcggccgtggaatcctcctggccggggaccccaagacagacacgatcgcctactgcaccggccgcagcgttatcatccgccgcctcgatgcgcctctcgacgcttgggcctaccccgaccacgcctaccccacgaccgtcgcccgcttctcccccaacggcgagtgggtcgcctccgccgacgcctccggctgcgtccgcgtctggggccgctacggtgaccgcgctctcaaggccgagtttcggcccctctccggacgcgtcgacgacctccgctggtcccccgacggcctacgcatcgtcgtctctggngacggcaagggcaagtccttcgtccgcgcatttgtgtgggactctggcagcactgttggtgaatttgatgggcactcaaagagggttctgagctgggacttcaaaccaacacgtccatttcgcattgtgacatgtggggaaaattttctggctaacttctatggacgaccccccttccaatttaagcattccataaggcgacactcaaatttttgtaaatgctatccgccatggcctg

SEQ ID NO: 21922 - protein, 198 aa, Zea mays
  misc_feature: Ceres CLONE 1391392-F
MAQLVETYACSPATERGRGILLAGDPKTDTIAYCTGRSVIIRRLDAPLDAWAYPDHAYPTTVARFSPNGEWVASADASGCVRVWGRYGDRALKAEFRPLSGRVDDLRWSPDGLRIVVSGDGKGKSFVRAFVWDSGSTVGEFDGHSKRVLSWDFKPTRPFRIVTCGENFLANFYGRPPFQFKHSIRRHSNFCKCYPPWP

SEQ ID NO: 21923 - DNA, 708 bp, Zea mays
  misc_feature: Ceres CLONE 1391393-F
  misc_feature: Encodes the peptide sequence at SEQ ID NO. 21924
  misc_feature (633)..(633): n is a, c, t, g, unknown, or other
tccccgcggtggcggccgctctagaactagtggatcccccgggctgcaggaattcgcacgagaccattacctagaacatcctaatcgaaaaccgcacacctctgacctccctccgtccatctcatcatcatctttgtccctctcgcgcaattcgccgaagacaccgcgcgcgcctcgcctcccagcgacggccgcctcgacggacaatgctggcgatgaaatgagcgtggaggaggaggtgtagcgcggtcagcagtacctgctctacgaggcgctcgaccggatcctctcctcggcggtctcctccacctctgcctcggacgatgatggcggagaccgtccgcgccaccgccgcagctgcgatgcgccagccgcagcggccctcgacctgtgaacctcccagccgggtgccgatcatgagcgccggcgccgactgatccatctcatggcgctcactggtgatctgtcactcgtggctacgaaaagtgattctgccgaaggcgaagaagccactgaaccgccccctccttataaaaaagaatgcgagaaacggaatgtgtacttgccttcctatccaaatgtatcccactactccaccgttgagcttttggccctcgagcctagtagtgcttntctacttcatacgcccccccgtcggtgaaccccagacgccagcgagggatcggaggtgaggactcccggctggcc

SEQ ID NO: 21924 - protein, 71 aa, Zea mays
  misc_feature: Ceres CLONE 1391393-F
  misc_feature (63)..(63): Xaa is any aa, unknown, or other
MALTGDLSLVATKSDSAEGEEATEPPPPYKKECEKRNVYLPSYPNVSHYSTVELLALEPSSAXLLHTPPRR

SEQ ID NO: 21925 - DNA, 663 bp, Zea mays
  misc_feature: Ceres CLONE 1391394-F
  misc_feature: Translation starting site: 125
  misc_feature: SWISSPROT Homolog: EC 2.3.1.92 Sinapoylglucose--malate O-sinapoyltransferase
  misc_feature (373)..(373): n is a, c, t, g, unknown, or other
  misc_feature (396)..(396): n is a, c, t, g, unknown, or other
  misc_feature (443)..(443): n is a, c, t, g, unknown, or other
  misc_feature (447)..(447): n is a, c, t, g, unknown, or other
aaagctggagctccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttccacctcgaaacagggtatgtggaggtggacgaggacgccggcgcggagctcttctactacttcgtccgggccgagtccggcgccgacgacagcgacaccccgttcgtcctccggatccccggcggncaacgctgctccgccttcagcgncctcgcctacgagataggtcccatcatggtcgtcgtggagccctacnacgncagcttgccgcgcctgcgctacacccaaactcgtggacaaaggtgcgcatattctttttgtggattcgccagtgggggcggggttttccttctccagagatgcaaagctacacggctggagcggtatcaccacgctgactttggcgaagtcctccacaatgggttcacgacccatctgagtccatgcaaatccttctacattcgaggaaaacctag

SEQ ID NO: 21926 - DNA, 669 bp, Zea mays
  misc_feature: Ceres CLONE 1391395-F
  misc_feature: Encodes the peptide sequence at SEQ ID NO. 21927
aaagctggagctccccgcggtggcggccgctctagaactagtggatcccccgggctgcaggaattcgcacgagaccattacctagaacatcctaatcgaaaagttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcgaagtagggtgtaaagttttgtatatgatgccaggcatggatgaaccccttcttggcaatggtcttaagaccagcgggaaaagagagagcctggtagtggccgaggtcagaaaacagatgtaccttgctgggccactcatcgctgcatggatcctacagaacattgtccagatgatatctatcatgtttgccggtcaccttggtgaggttgccctctccagtggcctcattggcacctcctttggaggggttactggcttcagcttatttgctgggatggcgaagaactttggaaaccctggggggggaaaacggtccggggaaaaggaaaattaatttcttgggattcacaaagaaaaggggaaaccctgggggccccccctaaacagcccttggggggtgcgaatatttggccaaaaaccgggg

SEQ ID NO: 21927 - protein, 99 aa, Zea mays
  misc_feature: Ceres CLONE 1391395-F
MDEPLLGNGLKTSGKRESLVVAEVRKQMYLAGPLIAAWILQNIVQMISIMFAGHLGEVALSSGLIGTSFGGVTGFSLFAGMAKNFGNPGGGKRSGEKEN

SEQ ID NO: 21928 - DNA, 644 bp, Zea mays
  misc_feature: Ceres CLONE 1391398-F
  misc_feature (242)..(242): n is a, c, t, g, unknown, or other
  misc_feature (357)..(357): n is a, c, t, g, unknown, or other
aaagctggagctccccgcggtggcggccgctctagaactagtggatcccccgggctgcaggaattcgcacgagaccattacctagaacatcctaatcgaaaaaatcaacaaactactacaaagccacttcctgctctcgctccgccgccgccgcctccctccccagtcgatcaccaaacctcagtccaaactccaaacccccgccgcatcagaaaaaaaaccctaagccatggacgccgcgncgctggagtcgctcatcctggaccctcacgccatcgaggtgtgaagctgggctccttcacgctcaagtcccggatcaaatcgcccatctacctcgaactccgggggggtcgtttncccacccggggcctgggtcttccggcgggggccttggtcctttaaaggggtcccggcaaaggggcccctaagggtctggtttggggggggtccccaaaacccgggggtcccccattggggcgggggggcttctttcctgtaaaaggggttataatcccccatgtgttattgggcccctaaaggggggggtaaaaggccccccgggcccccccccaaagtcccttggggggggccctcttttaccccccgggggaaaccccccctcccattaaaagaagccccccccc

SEQ ID NO: 21929 - DNA, 663 bp, Zea mays
  misc_feature: Ceres CLONE 1391402-F
  misc_feature: Translation starting site: 155
tggagctccccgcggtggcggccgctctagaactagtggatcccccgggctgcaggaattcgcacgagaccattacctagaacatcctaatcgaaaaaagataacaatcaacaaacaacaagcccgcgcgagactgttctttctccatttcccaatggccgccgccgccgccgtcttctttccctccaccccgaatcctcggcaccgcctcgccgccgccgcccgccgccctccacccagcttcaccggcgccaccgacgccgtgccgctaccggaggacgaggactccagcgacgacgatgccgacgacgacggcgcgccacgcaggagcgggcgcagggaccggcgccgcgcggtgcgcgtcgcgtggaagaagctagtccggtggtcccgctcctggcgccgccgcaaccgcagcgacgtcctcgagaccacgcgcaaggtggtggttctccggggcgggtcgttcgggacgggcatggccgctcacgtggcggccaagaggccgatctcgaggtggccatgccctcagggacgacaacatctgccgggtcatcaacaacgcacatgtcaattggcagtacttatcagaacacagattgccagaaaatatcgtcgcaacaactagtggctgctgatgctttaacaagagctgatttctgc

SEQ ID NO: 21930 - DNA, 642 bp, Zea mays
  misc_feature: Ceres CLONE 1391405-F
  misc_feature: Encodes the peptide sequence at SEQ ID NO. 21931
  misc_feature (312)..(312): n is a, c, t, g, unknown, or other
aagctggagctcaccgcggtggcggccgctctagaactagtggatcccccgggctgcaggaattcgcacgagaccattacctagaacatcctaatcaaaaaaggtcgagcctagggttagggtttcgtccctccggccccgattcgaaccaatccgcctcggcctccgccgcgccatggccgccggctccatcgtggtggacttcccttccatgggcgccgccctctgcttccccagcctcgattcactcctccgcgactccgcctcgggcttcctcgctgccgtctccaacgccccagcccccggcgcagnccgacctcaccaaactttcacccgcgtctttctcgccgcgtccctcagcggcccaaacccggaaacccaccgggttttgagaggggtggggggggttttttccgggtttttcttttccgaaagggggccaagaaaacccggtcccggggtccagatcctttccggtttttacgggcctctcccccggggacccccaaaagcgtttggcctttttcccccccgggggttttcagaattttctccccccccaaaaagggggggggagggaaaaaaacccccccctgggggggggggcgccccccaaaaaaaaaaaaatgttggggggaaagc

SEQ ID NO: 21931 - protein, 155 aa, Zea mays
  misc_feature: Ceres CLONE 1391405-F
  misc_feature (46)..(46): Xaa is any aa, unknown, or other
MAAGSIVVDFPSMGAALCFPSLDSLLRDSASGFLAAVSNAPAPGAXRPHQTFTRVFLAASLSGPNPETHRVLRGVGGVFSGFFFSERGPRKPGPGVQILSGFYGPLPRGPPKAFGLFPPRGFSEFSPPPKRGGEGKKPPPGGGGAPQKKKNVGGK

SEQ ID NO: 21932 - DNA, 719 bp, Zea mays
  misc_feature: Ceres CLONE 1391406-F
  misc_feature: Encodes the peptide sequence at SEQ ID NO. 21933
  misc_feature (299)..(299): n is a, c, t, g, unknown, or other
tggagctccccgcggtggcggccgctctagaactagtggatcccccgggctgcaggaattcgcacgagaccattacctagaacatcctaatcgaaaacttccgtccttggcaaccaggcccaggcatcgtttcaccgctattcctcctgccccatctcctcccgatccatccgagcccaaaccctagtccagccagatctccgccgccgccggcgagagcacggcatcagatccgccgcgatggcgttccgccgcatcttatccacagcggtgcgcccgcgctcggccatcgccgcggnagcggccgggaacgcgcgcgaggcctccacggccggcgccgcggcgcccggggtgttaccccccaacgcgaccccgggggggggtcccggggatgcccaacgatcgcatcgcccaaacccgtaaccgccgggttccgggggttggaaaaccaaaacccggggttttcctccgttatggaagccccggggcggcccaagcggaaaaaaaggggtttttttggggggcccggaaaaccgggtaccacgcttgcccaaaggggtggggggggggaaaaaaaaatctcccccccccgcggcgagaataagggggggggggggggacaagggggggcccaaagaaaaaaaaaagagggggggcgggcgggcccgtttttttaacaaaaccttgttttctaaggaaaaaaaaaaaaccccccccct

SEQ ID NO: 21933 - protein, 60 aa, Zea mays
  misc_feature: Ceres CLONE 1391406-F
  misc_feature (20)..(20): Xaa is any aa, unknown, or other
MAFRRILSTAVRPRSAIAAXAAGNAREASTAGAAAPGVLPPNATPGGGPGDAQRSHRPNP

SEQ ID NO: 21934 - DNA, 681 bp, Zea mays
  misc_feature: Ceres CLONE 1391408-F
  misc_feature: Encodes the peptide sequence at SEQ ID NO. 21935
  misc_feature (582)..(582): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgtaaaaaaatagtgcggtgcgcccagccctgtcggctcggctgcctccgcctccgctccgcgccgcgcatataaccggaccccagttccgtgacggcctcagtcagtccccgaggaggaggaacagctaggtgcggaaaggcagctctcagtctcacactctgccaatcccagcctgagttctgctctgctctgcttctagccatggtggcctcgcggatcttgctcccgctgctgctctccctcttcctatgctcgcattgctgtaccggagcggcggcggcgaagcggcagctgctgcaggcgcagtcgcaggtgaagttcgacttctccccgttcctgatcgagtacaagaacgggcgcgtgaagcggctgatgggcacccaacgtggtggtccgcgtcgtcggacgccgctgacgggcgtccctttcccgcgacgtgaccatcgaaggctttcaacgggcgttccccgcgcgtttctaccntcccgagcttccgcgcaagggggcccggggtggcccgtgctcgtctactttcaccggggggcgggttttggggggggganccccggggttccaggcccc

SEQ ID NO: 21935 - protein, 127 aa, Zea mays
  misc_feature: Ceres CLONE 1391408-F
  misc_feature (121)..(121): Xaa is any aa, unknown, or other
MVASRILLPLLLSLFLCSHCCTGAAAAKRQLLQAQSQVKFDFSPFLIEYKNGRVKRLMGTQRGGPRRRTPLTGVPFPRRDHRRLSTGVPRAFLPSRASAQGGPGWPVLVYFHRGAGFGGGXPGVPGP

SEQ ID NO: 21936 - DNA, 617 bp, Zea mays
  misc_feature: Ceres CLONE 1391410-F
  misc_feature: Encodes the peptide sequence at SEQ ID NO. 21937
cgctcagaactagtggatcccccgggctgcaggaattcgcacgagaccattacctagaacatcctaatcgaaaaaaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaaagcacctctcgatgacgagcgccttacccggcggttcctcagcagcccgcagctgtcgctcaaggcgctcccgctgctctctttcctgctcccctccgcgccgctctccaccgccgacaggacctggatggacgagtacctcctcgaggccaagcaagcgctcgggtacccgttcgcgccctcggaaacgctcggcgaaggcgatgactgccccgcgcgtcatttccatgtggttgtctacctcgcgttccagaatctggacccctctagcgg

SEQ ID NO: 21937 - protein, 48 aa, Zea mays
  misc_feature: Ceres CLONE 1391410-F
MDEYLLEAKQALGYPFAPSETLGEGDDCPARHFHVVVYLAFQNLDPSS

SEQ ID NO: 21938 - DNA, 766 bp, Zea mays
  misc_feature: Ceres CLONE 1391411-F
  misc_feature: Encodes the peptide sequence at SEQ ID NO. 21939
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (11)..(11): n is a, c, t, g, unknown, or other
  misc_feature (21)..(21): n is a, c, t, g, unknown, or other
  misc_feature (24)..(24): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (36)..(36): n is a, c, t, g, unknown, or other
nnncccccccncccccccccnctncccaannnnagnaagtgtccactaaacaaagctggtgctccccgcggtggcggccgctctagaactagtggatcccccgggctgcaggaattcgcacgagaccattacctagaacatcctaatcgaaaaatagcctctcctcgcaccccctcaagaactgtacccatcacgcgccgccatcgattgaccttgaccgacccgaccacccatcacgcttcttgttgccgccgctgttgcttgccgatacgcggtggctgcgctcgccgccggggaagaggggtcgcgggctgcgcgcctccagtctttcttcgcctccgtgctctcgggcctcttcggccaggccgaccaggacgaggaccaagagatggcctcgcgcaaccacaacgccgccgctccggagcttcaccatcacaaccgagccggtgttcccgttcttgaaaagaccaaggccgggcccgcccgacctgacgctctgaaccgggcgaccccctctcggcgaaatcggcaacctcggtcagggcccgccccagccaccgggcaacccgaaggaaggagggcaaaccgcccccatcactaagaagcttcccgcggctcaccttctaaaaaaaaagcgccaggaaaaaggcccgcaaatcaagtaatggccgaaatcccctggcctgcgaaagaaatgccccccgaaggtacgaacacggcaaggcttccctggaataaacaaaaaacccctgccgggcccgggagg

SEQ ID NO: 21939 - protein, 70 aa, Zea mays
  misc_feature: Ceres CLONE 1391411-F
MASRNHNAAAPELHHHNRAGVPVLEKTKAGPARPDALNRATPSRRNRQPRSGPAPATGQPEGRRANRPHH

SEQ ID NO: 21940 - DNA, 799 bp, Zea mays
  misc_feature: Ceres CLONE 1391412-F
  misc_feature: Encodes the peptide sequence at SEQ ID NO. 21941
  misc_feature (13)..(13): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
tcccctccttttncccccccctccccnnnnnncaaagataatttttttaaaactgcgactccccgcggtggcggccgctctataactagtggatcccccgggctgcaggaattcgcacgagaccattacctagaacatcctaatcaaaaatctgttcccctttccctcctgcgcacccgtcttctcctccccgcgtcaaaccccagcacaaaaagcaaccgcccgccgcctcctcgttcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggcccaggaggacaatgccggcaactacgtcaaggcgttccctctctacatgaacgcgctcgagtactttcaaaccccacctcaagtacgaggaaaaaccccaagattcagggaggccatcaccgcccaagtttcaccgagtacctcccgcccgcgcccgaggaagatcccgggccgattcctccgatgcagggccggcgcaaggccctgggggcccaaaggtgggacaaacccaatctggtccgcacggcgccccccaaaaacaaggggcaaaggaacgggggaacgggagggaaaacggaagggggaatgacttcccgaaccagtcccaaaacttggaaggggggggggttctaaattcccggccaattcattcacccgaaaaaaacccccaacattttaaggggggcaaccggc

SEQ ID NO: 21941 - protein, 119 aa, Zea mays
  misc_feature: Ceres CLONE 1391412-F
  misc_feature (5)..(74): Pfam Name: MIT Pfam Description: MIT (microtubule interacting and transport) domain
MYSNFKEQAIEYVKQAAQEDNAGNYVKAFPLYMNALEYFQTPPQVRGKTPRFREAITAQVSPSTSRPRPRKIPGRFLRCRAGARPWGPKGGTNPIWSARRPPKTRGKGTGEREGKRKGE

SEQ ID NO: 21942 - DNA, 681 bp, Zea mays
  misc_feature: Ceres CLONE 1391413-F
  misc_feature: Encodes the peptide sequence at SEQ ID NO. 21943
  misc_feature (315)..(315): n is a, c, t, g, unknown, or other
  misc_feature (590)..(590): n is a, c, t, g, unknown, or other
tggagctccccgcggtggcggccgctctataactagtggatcccccgggctgcaggaattcgcacgagaccattacctagaacatcctaatcgaaaaacagcgaaccacccatggccctcgccaccactgccgtctccctccaccttttcctcacccggcccgcctccgtgctccgcgtaggccgcggcctcccatgcctcctcctccgagccacttcgtccacctccgcctccccggacttcaacatcaccttcgcggagcccgcgccgtccaaaaaggccccgtccgcgcagccgctggtcccgtggatcgtnccgcgggaggacggcaagccccgcctcagcacctccccgccgccggacgtaatccaggccatcgcgctcgcggaggcggaggccaagaaggccgccaagaaggaaaccctcagggcaaaaatgggcgcagttggccgccgccgccgcggttgcttccaatgccagcgttcagggcaaaggaaagaaagcccgccccgaccgtgcccgcccaagttctcaaggagggccgggaaggttttacaatgaaatatccagggagcgggagccgcaacggnttcgccaagggtctttgccccccccaagaagggccctcaaggaaggacccgggggggagctcatcttcccaggggaaaggggactggcaaa

SEQ ID NO: 21943 - protein, 149 aa, Zea mays
  misc_feature: Ceres CLONE 1391413-F
MALATTAVSLHLFLTRPASVLRVGRGLPCLLLRATSSTSASPDFNITFAEPAPSKKAPSAQPLVPWIVPREDGKPRLSTSPPPDVIQAIALAEAEAKKAAKKETLRAKMGAVGRRRRGCFQCQRSGQRKESPPRPCPPKFSRRAGKVLQ

SEQ ID NO: 21944 - DNA, 817 bp, Zea mays
  misc_feature: Ceres CLONE 1391418-F
  misc_feature: Encodes the peptide sequence at SEQ ID NO. 21945
  misc_feature (13)..(13): n is a, c, t, g, unknown, or other
  misc_feature (16)..(16): n is a, c, t, g, unknown, or other
  misc_feature (29)..(29): n is a, c, t, g, unknown, or other
  misc_feature (30)..(30): n is a, c, t, g, unknown, or other
ttttttttctccnttntttcttttttttnntttttctttttcgccaaccgcagagctggagctccccgcggtggcggccgctctagaactagtggatcccccgggctgcaggaattcgcacgagaccattacctagaatcctaatcgaaaatccactgtaccggagctccaccacgtcctccggcaagaaacagatgaaagacagcgacgacgagggcgccggcgatggcgtcaaccgcccgcacccgtccaacaaccttccactgccggctccacactccgacccgaacctccagttctcgggtgggacggacgatgagtcctcgaaccgggacagcagctcctctgccaccggcggcgcgagcccggggtactactccgactacccgtccagtttcaggggcgagggctcgcccgtacaacatgtcccccctggaaaccaaaccatggcgtctcccctgctcgcaccaaccgcgaaggccgccgggctttcggagggggcccccgccccccaatggggcccgggggacccacgcaccaacacgctccgcttcgggcagaggagagaaaggcccccctttcgaagtctgttggtcgatataaaggagaaaaaatgttatgaaaaatctgttattgatcgccattaacaaacctccccccctcgctgtgcgcctccgcccgaccacccccccgggagaggcataaaaagaagtgaaaataaaatacctgctgggataaaagatacatctcactcttccacggaataatgttaataatattgcggacggccactaacaacacatccattatactctgg

SEQ ID NO: 21945 - protein, 150 aa, Zea mays
  misc_feature: Ceres CLONE 1391418-F
MKDSDDEGAGDGVNRPHPSNNLPLPAPHSDPNLQFSGGTDDESSNRDSSSSATGGASPGYYSDYPSSFRGEGSPVQHVPPGNQTMASPLLAPTAKAAGLSEGAPAPQWGPGDPRTNTLRFGQRRERPPFRSLLVDIKEKKCYEKSVIDRH

SEQ ID NO: 21946 - DNA, 671 bp, Zea mays
  misc_feature: Ceres CLONE 1391420-F
  misc_feature: Encodes the peptide sequence at SEQ ID NO. 21947
  misc_feature (474)..(474): n is a, c, t, g, unknown, or other
  misc_feature (475)..(475): n is a, c, t, g, unknown, or other
  misc_feature (524)..(524): n is a, c, t, g, unknown, or other
  misc_feature (539)..(539): n is a, c, t, g, unknown, or other
  misc_feature (627)..(627): n is a, c, t, g, unknown, or other
  misc_feature (632)..(632): n is a, c, t, g, unknown, or other
  misc_feature (671)..(671): n is a, c, t, g, unknown, or other
tccccgcggtggcggccgctctataactagtggatcccccgggctgcaggaattcgcacgagaccattacctagaacacctaatcgaaaagccccggtggcaggcggctccgttggggggtgagtctagctccgtctgttgcgccggaataacgcggcgggtgctacctccggccctcgggttccatggggaggaacggtagcgtgaggcgctcggcgttttcgggcgccgcgggtgctgccgcggggccgccgtccttctctgtgaatcccgccgactaccggttgatggaggaggtggggtacggtgcgcacgccgtcgtgtaccgcgcgatcttcctcccgactaagggtgttgtcgcggtcaagtgcctggatctcgatcagctcaataacaacatcgatgaaatacaaagggaggctcaaataatgagcttgatagaccatcctaatgtcatcagggcttactgctcannttgtgtggagcacagcctctgggtgataatgccattcatgacaggaggntctttgttacacttnaatgagatctcataccaggaaggttttgatgagccgatcattggctccattctcaagaaactcttagggctctggattactttcacgncaggncaaatacatcgtgatgtcaggctggtatatccttatcgn

SEQ ID NO: 21947 - protein, 162 aa, Zea mays
  misc_feature: Ceres CLONE 1391420-F
  misc_feature: SWISSPROT Homolog: EC 2.7.11.1 Non-specific serine/threonine protein kinase
  misc_feature (97)..(97): Xaa is any aa, unknown, or other
  misc_feature (118)..(118): Xaa is any aa, unknown, or other
  misc_feature (148)..(148): Xaa is any aa, unknown, or other
MGRNGSVRRSAFSGAAGAAAGPPSFSVNPADYRLMEEVGYGAHAVVYRAIFLPTKGVVAVKCLDLDQLNNNIDEIQREAQIMSLIDHPNVIRAYCSXCVEHSLWVIMPFMTGGSLLHXNEISYQEGFDEPIIGSILKKLLGLWITFTXGQIHRDVRLVYPYR

SEQ ID NO: 21948 - DNA, 776 bp, Zea mays
  misc_feature: Ceres CLONE 1391422-F
  misc_feature: Encodes the peptide sequence at SEQ ID NO. 21949
  misc_feature (28)..(28): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (38)..(38): n is a, c, t, g, unknown, or other
  misc_feature (76)..(76): n is a, c, t, g, unknown, or other
  misc_feature (774)..(774): n is a, c, t, g, unknown, or other
  misc_feature (776)..(776): n is a, c, t, g, unknown, or other
ttttttcttttcttcccccttcttcttnggnnnggtcnggggcgtaaaagtaaaaactggagctccccgcggtggngggccgctctttcaatagtggatcccccgggctgcaggaattcgcacgagaccattacctagaacatcctaatcaaaaagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagcggcgaccaaggggtggagggcggccgacctggggtacgtggccatcctcccgtcgctgctcctccgggcgctgcacaaccaggcgtggatcaccgcgtcccgcctgcagagcgcgcgcggccggcggcaggtcgtggaccgcggcatcgagttcgagcaggtggaccgcgagcgcaactgggacgaccagatcctgctcagcggcatcctcctgtacctgggctcaccctaccccgggcgggggggggcagaaccctgccggctgtgggaggcgcggaacggcccccactgcttcattcgcccctggttggaaggccggaccccggtcggaggattcggtttaactaatcttgggctgggcaccgggggcggggtgggaccccaccccaccttgcccctctatagctccgcccggctctagcgcacgtccccacacccaacgcgccatgncn

SEQ ID NO: 21949 - protein, 174 aa, Zea mays
  misc_feature: Ceres CLONE 1391422-F
MATNPGLFTEWPWKKLGNFKYLLLAPWVAHGGYQAATKGWRAADLGYVAILPSLLLRALHNQAWITASRLQSARGRRQVVDRGIEFEQVDRERNWDDQILLSGILLYLGSPYPGRGGAEPCRLWEARNGPHCFIRPWLEGRTPVGGFGLTNLGLGTGGGVGPHPTLPLYSSARL

SEQ ID NO: 21950 - DNA, 775 bp, Zea mays
  misc_feature: Ceres CLONE 1391423-F
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (775)..(775): n is a, c, t, g, unknown, or other
tttttcctctccccttctcccccccccnnnnnntnnnaagaccccnnnnctaaaagctggagctccacgcggtggcggccgctctagaactagtggatcccccgggctgcaggaattcgcacgagaccattacctagaacatcctaatcgaaaaaccaaaatgtaagaaaacgcacgccccggcgctggccgctagtcaccccaaagctccgcctccgcaccttctctcactcgcccagccgcggctatggcggccaccacatccacggcggcggcggcagtatccttctccctcccctcaccaccgcactgccgcggggcccggcgccgccgcgcgccttccctcctccgtgccgcctccaccgccgcgcccccctcccccgacctctccatccagctctcgccccgcgcgtccccgcccgcgtctaccaacggggccgccaccgcgcttggacccccccgtgtccgcctccttttgcccgtgaaccgcgccgaaggacctggaggcccgaggcccgggcgaatggcccggggccgcttggcgccaaaagccaaccggccccgaagctcccttcgccgccccgcttaaggctcccggccccccttcaaggggggcgcctccgggaccaggggaaggggggtgggcccaagtttggcgttcgtttggggggtggaaaggcccccactggggacaaaccggaaaaagggtaaaccccttcatcccggagaagcgagcgcccccccccaaggagcgcgcggcaacgcacgccccacn

SEQ ID NO: 21951 - DNA, 654 bp, Zea mays
  misc_feature: Ceres CLONE 1391424-F
  misc_feature: Encodes the peptide sequence at SEQ ID NO. 21952
  misc_feature (557)..(557): n is a, c, t, g, unknown, or other
  misc_feature (567)..(567): n is a, c, t, g, unknown, or other
tccccgcggtggcggccgctctagaactagtggatcccccgggctgcaggaattcgcacgagaccattacctagaacatcctaatcgaaaacttcccctgcacaggctgtcgtccacaatgcccgcgccgctgatactacccacagtcgcgcgcgagctggcagagctcctcgtcgccctctccgccgcccgcgcgctcccaaaaggacagcagctccacggccatctcctcaaggctggacacgtccccgccaccgcctcctcccacgcgctgctcgcgcaccacctccttacgttctacgcgcgctgcgcgctccctgacctctccctccgtgccttccttgacctccccgcgccgccccttcccgctgcatggtcttccctcatctcctccttcgctcagaacggcctcgccgccactgccttcgacactttccgccgcatggctcgccgcgggcgtccctggcaccgaccgctccatccctttgggtgcaaaggccgttgccgctgccgagaccttgtcgcgccctccgttctcccctcacgcgctccacggncttgctgccnagactcccgtcggctggcgacgtgttttgtggctccggcgattgtccacatgtatgccaagtgcgcccaccttgcagacccccgcgg

SEQ ID NO: 21952 - protein, 178 aa, Zea mays
  misc_feature: Ceres CLONE 1391424-F
  misc_feature (147)..(147): Xaa is any aa, unknown, or other
  misc_feature (150)..(150): Xaa is any aa, unknown, or other
MPAPLILPTVARELAELLVALSAARALPKGQQLHGHLLKAGHVPATASSHALLAHHLLTFYARCALPDLSLRAFLDLPAPPLPAAWSSLISSFAQNGLAATAFDTFRRMARRGRPWHRPLHPFGCKGRCRCRDLVAPSVLPSRAPRXCCXDSRRLATCFVAPAIVHMYAKCAHLADPR

SEQ ID NO: 21953 - DNA, 785 bp, Zea mays
  misc_feature: Ceres CLONE 1391431-F
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (15)..(15): n is a, c, t, g, unknown, or other
  misc_feature (22)..(22): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (36)..(36): n is a, c, t, g, unknown, or other
  misc_feature (775)..(775): n is a, c, t, g, unknown, or other
ccccccnnncccccnccccccncccccntnngggtnagttgaattttttcaaagctggagctccccgcggtggcggccgctctataatagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccgccgccggcaagctgccgtacagctaccccggccaagaggaacgccggaaagctggtgaagagcgtcagccggggggaagccgcgcacgttccgccctgggccctcggggggggcttcctcgtccgtcacctggggcctaacttccccccggccaaggttcgacccccatccacaatcgcccatgaacaagtccgacccggtcttcagtaaatggggcctgggccttcaaaatccggcttcacttgggaaaaggggggacccgcccgtccggccgaacacctctccaacggcctccaaggggaggggatttaaaaattggggcccgccgatgtccccatggcccccaaagaaagcggtaancgaagcgccc

SEQ ID NO: 21954 - DNA, 676 bp, Zea mays
  misc_feature: Ceres CLONE 1391432-F
  misc_feature: Encodes the peptide sequence at SEQ ID NO. 21955
  misc_feature (298)..(298): n is a, c, t, g, unknown, or other
  misc_feature (340)..(340): n is a, c, t, g, unknown, or other
tccccgcggtggcggccgctctagaactagtggatcccccgggctgcaggaattcgcacgagaccattacctagaacatcctaatcgaaaaatctagtcgccgcccccgctcaccgattgtcctctgctgtggagcgagcaagcagcggcgaagcgatggaggaggagatcagaaaggagttccagagtaacggcttctccatcggaggagccggccccgaggacgccgcccagatcctctccacgctgctgacctactgcatcaactacaagatgagccccgcggatctcgtctcanactgggaggtctactacctcaataggcaattggatggcttanagctcgaaagctcgtatcttgatggttttctgtcacaccttcaaaatgaagttaaagacaggataataaaagaagaagctaaccttcacatttactccagtaacgatgttgacatgctcttaagcaattcacatgtagatgaagcagcattccatgacataccaggctatgaacaggaaaaggcacctggaagatcatctatctctgagttaactcctcggggcagtgacagaccatcattccagcagagtggccaaacaaatcctgatcgtattaccccttttgcaaccgagtaaataatttaccccaacagtatgttctcatgcttataaacgg

SEQ ID NO: 21955 - protein, 159 aa, Zea mays
  misc_feature: Ceres CLONE 1391432-F
  misc_feature (48)..(48): Xaa is any aa, unknown, or other
  misc_feature (62)..(62): Xaa is any aa, unknown, or other
MEEEIRKEFQSNGFSIGGAGPEDAAQILSTLLTYCINYKMSPADLVSXWEVYYLNRQLDGLXLESSYLDGFLSHLQNEVKDRIIKEEANLHIYSSNDVDMLLSNSHVDEAAFHDIPGYEQEKAPGRSSISELTPRGSDRPSFQQSGQTNPDRITPFATE

SEQ ID NO: 21956 - DNA, 676 bp, Zea mays
  misc_feature: Ceres CLONE 1391433-F
  misc_feature: Encodes the peptide sequence at SEQ ID NO. 21957
  misc_feature (397)..(397): n is a, c, t, g, unknown, or other
  misc_feature (507)..(507): n is a, c, t, g, unknown, or other
  misc_feature (508)..(508): n is a, c, t, g, unknown, or other
  misc_feature (539)..(539): n is a, c, t, g, unknown, or other
  misc_feature (589)..(589): n is a, c, t, g, unknown, or other
  misc_feature (605)..(605): n is a, c, t, g, unknown, or other
  misc_feature (618)..(618): n is a, c, t, g, unknown, or other
tccccgcggtggcggccgctctataactagtggatcccccgggctgcaggaattcgcacgagaccattacctagaacatcctaatcgaaaacttgtgaacatcgcagtgctgtagcctccttcgtcttgagcgagcatggagatgtcagccatggaggaagccctccccaaggcgatggagaggaggaagggaggcctcagaaccattccgttcatcatcttaaacgagatattcgagaaggtggccacgttcgggctgtcggccaacatgatcctgtacctcaccgagcggtatctcatgaccaacgcctttgccaccgtcgtcctctacttctggcatgccttctccaacttcctgcccatcttaggcgccgtgctcgccgacgcccgcctcggncggttccgggtcatcaccctcggctcctgcgttagcctcttcgggatgtgcctgctgtggctgacggcgatcctttccggtgtacaagaacaccccggagtgcgcgccgnngcggccggtaaaggtgcgccggtgctgccgntggcagctgccgctcctctttcacgtcgtcgcgttcatgtcccctcgggntcgggcggcatccggncctgcacgctggncgttcgggggccgacagctgggacaagcgggacaacagcgccaataaacgtgaggacg

SEQ ID NO: 21957 - protein, 180 aa, Zea mays
  misc_feature: Ceres CLONE 1391433-F
  misc_feature (124)..(124): Xaa is any aa, unknown, or other
  misc_feature (135)..(135): Xaa is any aa, unknown, or other
  misc_feature (157)..(157): Xaa is any aa, unknown, or other
  misc_feature (161)..(161): Xaa is any aa, unknown, or other
MEMSAMEEALPKAMERRKGGLRTIPFIILNEIFEKVATFGLSANMILYLTERYLMTNAFATVVLYFWHAFSNFLPILGAVLADARLGRFRVITLGSCVSLFGMCLLWLTAILSGVQEHPGVRAXAAGKGAPVLPXAAAAPLSRRRVHVPSGSGGIRXCTLXVRGPTAGTSGTTAPINVRT

SEQ ID NO: 21958 - DNA, 625 bp, Zea mays
  misc_feature: Ceres CLONE 1391434-F
  misc_feature (392)..(392): n is a, c, t, g, unknown, or other
  misc_feature (457)..(457): n is a, c, t, g, unknown, or other
  misc_feature (460)..(460): n is a, c, t, g, unknown, or other
aagctggagctccccgcggtggcggccgctctataactagtggatcccccgggctgcaggaattcgcacgagaccattacctagaacatcctaatcgaaaagtttctagttctagggtttaaagagctcgccgagcccgtcgtgcgccggcccagcaagagcccactactttccgccgtcgccatcgccggcgccgacctctccgtctccgcgcgcggcaatggcattctccttcgcctcgccgccagcttcgaaccccttccagacgccggctgcgtcgaatcccttccagacgccagctgcgtccaatccctttcagacgccggcggcgccgaatccgtttcagacaccgactccggccacctcacaggcgccgtccctatcgccctcgnccgttcagttcagctcccagccgcagccgcagcagcagccacagcagcagcaggtgggcgccggnggntgcaacctcagcagccgcagccacagcatcagaagctgatgctgtacacgacggatatgaaacccgctgggtaacacaccaaggggaaggagctgcacgccgagtcgcaaaagggtttgcttccgatcgaggacaagatacgggactaccgagacgagggggagg

SEQ ID NO: 21959 - DNA, 655 bp, Zea mays
  misc_feature: Ceres CLONE 1391441-F
  misc_feature: Encodes the peptide sequence at SEQ ID NO. 21960
  misc_feature (548)..(548): n is a, c, t, g, unknown, or other
tccccgcggtggcggccgctctagaactagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcaatccgagcacgcagctagtagggaaagtatccgagaaaagttgcagattttgctgggggcaacggagcgagaacaagttactgcagaaggaaagggcaaaggtggggaggcgccggagatgagggatgctatcagctctgatggattatttgaaatcttgctcgggtccggcatcaccggctgggcgtccccgcaaagggatcgatgcccacggcccngcagacgggctcctgtggtacaagggacgcgggcaggtcgtcgatggtgagttctccatggccgtggtccaggcccataacctattggagggacatagcagtttgaa

SEQ ID NO: 21960 - protein, 66 aa, Zea mays
  misc_feature: Ceres CLONE 1391441-F
MLSALMDYLKSCSGPASPAGRPRKGIDAHGPADGLLWYKGRGQVVDGEFSMAVVQAHNLLEGHSSL

SEQ ID NO: 21961 - DNA, 692 bp, Zea mays
  misc_feature: Ceres CLONE 1391445-F
  misc_feature: Encodes the peptide sequence at SEQ ID NO. 21962
  misc_feature (383)..(383): n is a, c, t, g, unknown, or other
  misc_feature (456)..(456): n is a, c, t, g, unknown, or other
  misc_feature (535)..(535): n is a, c, t, g, unknown, or other
  misc_feature (536)..(536): n is a, c, t, g, unknown, or other
  misc_feature (675)..(675): n is a, c, t, g, unknown, or other
aaagctggagctccccgcggtggcggccgctctagaactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccaccgccccccgatgagatccagctcgcgaagcagcgcgcgcaggagatcgcggcgcgnatctttaacgccgcagaggccaagcgtcctcgcgtcgacaacggcgacgatgacagcggcggcttcggtgtangcctgggcagcactggtgccggtggccgcatcggcggcggaggactcggcttctcgtcctctgccggtggtgggcacgnngcttctatccccacattatcttctcagagcagcgcacctcagtactcctcttatggtggatatcagggtacaagcaaaaagatgaaattccaaatgggaagggtgttgttatcatttggaaagcccgggaacctaatanggatatccaacttcaat

SEQ ID NO: 21962 - protein, 167 aa, Zea mays
  misc_feature: Ceres CLONE 1391445-F
  misc_feature (89)..(89): Xaa is any aa, unknown, or other
  misc_feature (115)..(115): Xaa is any aa, unknown, or other
  misc_feature (162)..(162): Xaa is any aa, unknown, or other
MADDHYSSKRKYDDPSPPPRRTGFSSGPPPASPLAGGAPSYNSVPPPPDEIQLAKQRAQEIAARIFNAAEAKRPRVDNGDDDSGGFGVXLGSTGAGGRIGGGGLGFSSSAGGGHXASIPTLSSQSSAPQYSSYGGYQGTSKKMKFQMGRVLLSFGKPGNLIXISNFN

SEQ ID NO: 21963 - DNA, 659 bp, Zea mays
  misc_feature: Ceres CLONE 1391446-F
  misc_feature: Encodes the peptide sequence at SEQ ID NO. 21964
  misc_feature (451)..(451): n is a, c, t, g, unknown, or other
  misc_feature (452)..(452): n is a, c, t, g, unknown, or other
  misc_feature (477)..(477): n is a, c, t, g, unknown, or other
  misc_feature (507)..(507): n is a, c, t, g, unknown, or other
  misc_feature (530)..(530): n is a, c, t, g, unknown, or other
  misc_feature (619)..(619): n is a, c, t, g, unknown, or other
ggagctccccgcggtggcggccgctctataactagtggatcccccgggctgcaggaattcgcacgagaccattacctagaacatcctaatcaaaaaaggtcgagcctagggttagggtttcgtccctccggccccgattcgaaccaatccgcctcggcctccgccgcgccatggccgccggctccatcgtggtggacttcccttccatgggcgccgccctctgcttccccagcctcgattcactcctccgcgactccgcctcgggcttcctcgctgccgtctccaacgccccagcccccggcgcagccgacctcaccaactttcaccgcgtcttctcgcgcgtcctcagcgcctacccggacccaccgctcgaggctgtctggttcttctccgcgctctccttccacgaccgtcccgacgacctccgctccctgctccagctccctctcgnncttcacgcctcctcgccgggaccgncaagccgcttgccctttctcgccctgtcgnttccgagctcttccacgccgacnagccgcgcagggagaccgagaccctcgttgagggccgtctcagctacatcagcatctgcagaaacgctctgcccctcttcggacgtggnggcaacgcaaacgctgggagctgctgccggcctttgggga

SEQ ID NO: 21964 - protein, 163 aa, Zea mays
  misc_feature: Ceres CLONE 1391446-F
  misc_feature (94)..(94): Xaa is any aa, unknown, or other
  misc_feature (103)..(103): Xaa is any aa, unknown, or other
  misc_feature (113)..(113): Xaa is any aa, unknown, or other
  misc_feature (150)..(150): Xaa is any aa, unknown, or other
MAAGSIVVDFPSMGAALCFPSLDSLLRDSASGFLAAVSNAPAPGAADLTNFHRVFSRVLSAYPDPPLEAVWFFSALSFHDRPDDLRSLLQLPLXLHASSPGPXSRLPFLALSXPSSSTPTSRAGRPRPSLRAVSATSASAETLCPSSDVXATQTLGAAAGLWG

SEQ ID NO: 21965 - DNA, 668 bp, Zea mays
  misc_feature: Ceres CLONE 1391447-F
  misc_feature: Encodes the peptide sequence at SEQ ID NO. 21966
tccccgcggtggcggccgctctatcaatagtggatcccccgggctgcaggaattcgcacgagaccattacctagaacatcctaatcgaaaaaacgacttcctgcagtcctgcgctgcgcccctcctttccgcctccacgctgccgacgtccaccacacagcacggtcgagtcacccgatccctccatggcggcggcggtggcggcggtcgcggctgccacgacggcggaggacgaggcgcgcctgctgcgtctggaggagcaggcggagcacggcggcggcggcgcctgggactacctctgcctcgcccgccggctccgcgcccgccgccccgcccacgtcctccgcgtcggcctcgctctcctcaacaacgcctccgctcgctccggtctcgcctcagaacagtggacgctctacgagcaggtggccacggcggccatggattgccagcgtctcgatgtggcaaaggactgtattggagtcctttcaaagcaatttcctggcagcacccgggttgcccggctagaagctcttctgtttgaagcgaaaagtgaatgggctgaagctgaaagagcttacccggaaatcctggaaatcaattcattttgaccagatggtccaaaagagggaaaaattgctattgcaaaaagaacaatggtaatatgtcgg

SEQ ID NO: 21966 - protein, 140 aa, Zea mays
  misc_feature: Ceres CLONE 1391447-F
MAAAVAAVAAATTAEDEARLLRLEEQAEHGGGGAWDYLCLARRLRARRPAHVLRVGLALLNNASARSGLASEQWTLYEQVATAAMDCQRLDVAKDCIGVLSKQFPGSTRVARLEALLFEAKSEWAEAERAYPEILEINSF

SEQ ID NO: 21967 - DNA, 602 bp, Zea mays
  misc_feature: Ceres CLONE 1391449-F
  misc_feature: Encodes the peptide sequence at SEQ ID NO. 21968
  misc_feature (65)..(65): n is a, c, t, g, unknown, or other
  misc_feature (319)..(319): n is a, c, t, g, unknown, or other
  misc_feature (320)..(320): n is a, c, t, g, unknown, or other
ggagctccccgcggtggcggccgctctagaactagtggatcccccgggctgcaggaattcgcacngagaccattacctagaacatcctaaaaaaaaaggaattctgccttcttctctcatcttcctgctcaacatcagtagcagctttagctgtagcagcgccaccggccaccgccacgccatggccaccacgttgcacaagcccctgggggcgatcaccgttgacgacctcgccgcggcggcgcctgggtcggacgccaccgcgctccacgcagcgctccggcgcgcgctcgactcgcacggacccaccgaagtgtgnngcgagctctgccggtccgtgctctgtccgtctgtccccttcgccgtccaccggatgctctactacggttgcttcgccgggttcccgtctcccaccgcgcgcctggacgcccgacccccaggagggtgtcttgaacaatgtcggccggggccctcaagccgcgtggtaaggacttccatcggcgaacgcgaacaaggattccattcaccaggttttccagaacctccaaaaggttctccaaagaaaaatcccaaagggtaacggaaaaatgggtatttggagg

SEQ ID NO: 21968 - protein, 132 aa, Zea mays
  misc_feature: Ceres CLONE 1391449-F
  misc_feature (46)..(46): Xaa is any aa, unknown, or other
  misc_feature (47)..(47): Xaa is any aa, unknown, or other
MATTLHKPLGAITVDDLAAAAPGSDATALHAALRRALDSHGPTEVXXELCRSVLCPSVPFAVHRMLYYGCFAGFPSPTARLDARPPGGCLEQCRPGPSSRVVRTSIGEREQGFHSPGFPEPPKGSPKKNPKG

SEQ ID NO: 21969 - DNA, 819 bp, Zea mays
  misc_feature: Ceres CLONE 1391450-F
  misc_feature: Encodes the peptide sequence at SEQ ID NO. 21970
  misc_feature (1)..(1): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
nttttttcccccctttccnnnntgtttttttctcttttctttttcatcaggggcctaaagctgtagctccccgcggtggcggccgctctagaatagtggatcccccgggctgcaggaattcgcacgagaccattacctagaacatcctaatcgaaaatcatccgtttctgtcagttccttttctaaaagaaaaaatacagtcgcatctcgcctccagcagggtgagttcgcctcggcagggtgtggcataccatggagagctcgtcgccgtcagtgccgttcccgctgctgcaggcgccggtcgagagcacctaccgcgcctgcaccatcccctaccgtttcccctccgacaacccgggcagggccaccccctgtcgaggaaccaatgggatttggacctccttttctcaaactcctggttccccgtccttttcaaacagggcggggggggaagaaaagaaccccccacggtaaacccgggaaggcgcccccccccgaaaaaggggggaacaaaaacttcccccgcccccaagggggtaacccgcccttccaaattgggcttttgtgaaaaaaagagtttttaaaaaaaaaaaaaaaattccccggggcggaaaggcccctggggaacgggacccacccccacaaaatgtggggaaaacacttttttttttgtgtggagggcttttcccgggggggctcatagacaaccccgagagaggcacgtggggggatttttttaggggggaaattccctcttcaaataaaaggccaacaaggcttttggaatgaaaaaaattggccccacggcttctacttttc

SEQ ID NO: 21970 - protein, 73 aa, Zea mays
  misc_feature: Ceres CLONE 1391450-F
MESSSPSVPFPLLQAPVESTYRACTIPYRFPSDNPGRATPCRGTNGIWTSFSQTPGSPSFSNRAGGEEKNPPR

SEQ ID NO: 21971 - DNA, 667 bp, Zea mays
  misc_feature: Ceres CLONE 1391451-F
  misc_feature: Encodes the peptide sequence at SEQ ID NO. 21972
gctctccaactagtggatcccccgggctgcaggaattcgcacgagaccattacctagaacatcctaatcgaaaaagagctccaatggccgccgctctcccgcactcccgcctccacctcccgctccacacgcccagtcccacctcccgccgccgcccctgcccccgttcccgccgccgccttccctccttcgtcgccgtctcgcgcctccagaacaccaccgccgcgacccacccggtcctcccgcccccggttccgccccccctccgccgcgctcctcgccgccgagggcgcctccctcgcgccgcgccgagagcaccgcttcccaggctcggtctcctcccaacaagcaccgcctctgcctctaacgaggcggagtacgccgtcctgcttcgcgccctccaggtgcgccgcgccgtcgccgccgagttgctccgtgccccgctcggcgggggaaaggtcggcggcctgaactaaatcaagaacctcacggggcggaatggggcccgtttgggaaccccgtttgttgccaaagccccaacaaataaaggggacccgccctggactcccccaaaatgtccttcaaacgcccggggaaaaaggggaaacaccaagaaatcccgccctttggggaattttgccaaggggttcaaagggaaacatcccaa

SEQ ID NO: 21972 - protein, 130 aa, Zea mays
  misc_feature: Ceres CLONE 1391451-F
MAAALPHSRLHLPLHTPSPTSRRRPCPRSRRRLPSFVAVSRLQNTTAATHPVLPPPVPPPLRRAPRRRGRLPRAAPRAPLPRLGLLPTSTASASNEAEYAVLLRALQVRRAVAAELLRAPLGGGKVGGLN

SEQ ID NO: 21973 - DNA, 634 bp, Zea mays
  misc_feature: Ceres CLONE 1391452-F
  misc_feature: Encodes the peptide sequence at SEQ ID NO. 21974
  misc_feature (296)..(296): n is a, c, t, g, unknown, or other
tccccgcggtggcggccgctctataactagtggatcccccgggctgcaggaattcgcacgagaccattacctagaacatctaatcgaaaactccactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcacaggaagcatcccggaggtcgcggtaacgccggtggcatgcaccaccaccgcatcctcttcgancagtaccatcccggctacttcggtaaggtcggcatgcgctacttcccacagctccgcaacagttctactgccccgcgttcaacatcgagcgcctctggtcgatggtgccccgcgaaaaggcggcggaagccggcggcaacaagcccccgagatcgacgtcccgcattcggctacttccagggtgtcgggaaagggggggtgccgccaagcccttcgtcggtaaggcaagctcttctccaggtccccgaaaaaaaatcaggcccgccggggggccgtcgtgtcagaagtttggggaggggagccccccgaccggggggtgcccccaggaaggaacaatg

SEQ ID NO: 21974 - protein, 158 aa, Zea mays
  misc_feature: Ceres CLONE 1391452-F
  misc_feature (46)..(46): Xaa is any aa, unknown, or other
MTTRFKKNRKKRGHVSAGHGRIGKHRKHPGGRGNAGGMHHHRILFXQYHPGYFGKVGMRYFPQLRNSSTAPRSTSSASGRWCPAKRRRKPAATSPRDRRPAFGYFQGVGKGGVPPSPSSVRQALLQVPEKKSGPPGGRRVRSLGRGAPRPGGAPRKEQ

SEQ ID NO: 21975 - DNA, 639 bp, Zea mays
  misc_feature: Ceres CLONE 1391459-F
  misc_feature: Encodes the peptide sequence at SEQ ID NO. 21976
gctctacaactagtggatcccccgggctgcaggaattcgcacgagaccattacctagaacatcctaatcgaaaaaggtcgacgcatcttcgcctccgctcaacgctcgcccacgcccgccgcccccccaccgatccacgagaaaccttctcgcctccgcgggacgattcgccagggagagcaaaggtagcagaggcgccatggacgctgccaagtcggtgacgccgggcgccgtgtcctacatcctggcgcacccgtctacgggctccaatggcgccgtgtcggatctcgtcgttcaggtcctcgatctcaagtccatcggcatgggcagccggttcagtttcacggcaaccgatgggaacgacaaaatcaaggcgatgctccccacttactttgcgtcggaggtcactccggcaatctgaagaatttcggtctcatccgcatcctcgactacacttgcaactccgtcaaaggcacgctgacaaagtcctgattgtccgcaaatgcgagactgtgtgcgaagcgctcgacgccgagatcaacgcggaggccaagaaagaggatcctcccagtgtggtgaagcctaaagacgagggctccagcgtggctgagggaaccaattctcccccactcgtggtga

SEQ ID NO: 21976 - protein, 73 aa, Zea mays
  misc_feature: Ceres CLONE 1391459-F
  misc_feature (6)..(71): Pfam Name: Rep-A_N Pfam Description: Replication factor-A protein 1, N-terminal domain
MDAAKSVTPGAVSYILAHPSTGSNGAVSDLVVQVLDLKSIGMGSRFSFTATDGNDKIKAMLPTYFASEVTPAI

SEQ ID NO: 21977 - DNA, 667 bp, Zea mays
  misc_feature: Ceres CLONE 1391460-F
  misc_feature: Encodes the peptide sequence at SEQ ID NO. 21978
  misc_feature (558)..(558): n is a, c, t, g, unknown, or other
tcaccgcggtggcggccgctctataactagtggatcccccgggctgcaggaattcgcacgagaccattacctagaacatcctaatcgaaaagacaaacagcctgcgctccccttctttcccgttcggctcacagcgaagaaggaagccggttagggtttccacctcctttcccctcctctccttcagcgacgaccgcaggccacaccctcgatatccttcccctcggacccggaggcgagcagcagcctccagcgcctgccacgcctgcccgtctcgttattgggaggattcgccatgtctgacatggagtccgtcgcagctcttatgaactcgacaagctccaagatacagcagcttcaggaggcatttgctgagcttgagagccagagcacggtttccatgaaccctcagtggaagcatcttgaagaccactttcgtggtcttgaacagtccctcaagaaaaagtttgacgagctaaaagagcaggagaaggagttccaggagactgtcgcaaaatcagagcagattctggagcagcgggaggcagctgttgtggncaaaggactgacctcttttgagaaagtgcaggagaaagagggagctgcattagctatgatctttagcaagtccagcttttccttaacttggttctacatcaacccatgg

SEQ ID NO: 21978 - protein, 124 aa, Zea mays
  misc_feature: Ceres CLONE 1391460-F
  misc_feature (88)..(88): Xaa is any aa, unknown, or other
MSDMESVAALMNSTSSKIQQLQEAFAELESQSTVSMNPQWKHLEDHFRGLEQSLKKKFDELKEQEKEFQETVAKSEQILEQREAAVVXKGLTSFEKVQEKEGAALAMIFSKSSFSLTWFYINPW

SEQ ID NO: 21979 - DNA, 830 bp, Zea mays
  misc_feature: Ceres CLONE 1391465-F
  misc_feature: Encodes the peptide sequence at SEQ ID NO. 21980
  misc_feature (20)..(20): n is a, c, t, g, unknown, or other
  misc_feature (38)..(38): n is a, c, t, g, unknown, or other
ttggccccccccctccctcnttgtcacccctgccgttntgggcctttcttataactggcgctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccggcgagcttatctccaacttctgccgatgcgctggacaagatcagggttcgagagtctcactgacaagaacaagctcgatgcgcagcctggagcttttcctccccccttgtcccaagacaagggccacgaaaaacgctcctccattcatcgaacagggggattccggaatggacaaggtccgaaccttggccaacaaccctcgggtacccatccgccaaggttccggggaaccaagggaggttccttggaaaaacccctttgcttgcccggccgcttgatagggcccacattgattgggcccagtttccccggggtcggggtttttttagtccggggctaaccctcggccgcacagaataaaaggtttgggccgggacccccccagggcacaacggttggctcttcccatgtctccgggtgggagaaacccccacaaggacgggggcggcgcccgcaccccttgtgtcaatccccagtgaaacacgctctgggggcagacacgattttcg

SEQ ID NO: 21980 - protein, 146 aa, Zea mays
  misc_feature: Ceres CLONE 1391465-F
MASETETFAFQAEINQLLSLIINTFYSNKEIFLRRAYLQLLPMRWTRSGFESLTDKNKLDAQPGAFPPPLSQDKGHEKRSSIHRTGGFRNGQGPNLGQQPSGTHPPRFRGTKGGSLEKPLCLPGRLIGPTLIGPSFPGVGVFLVRG

SEQ ID NO: 21981 - DNA, 633 bp, Zea mays
  misc_feature: Ceres CLONE 1391467-F
  misc_feature (633)..(633): n is a, c, t, g, unknown, or other
gctcttaactagtggatcccccgggctgcaggaattcgcacgagaccattacctagaacatcctaatcgaaaaagtcggtctctctcactctctcttgtctccaagtttgtaaccctagccgccaagcttgaagctccagccgtgctcgtgtagggccgcaggccatccgggctccggcttccagcatctaccaggcgtccttagaatacggtgcagcgagcagcaagtcgccgagcagccgagccaccgccgaacacagggcgccgccgagcagccgagccgccgccgagcgccgagtcttctctcagtgacttcgggacagacgacaaactttctccacacataccgcgccactccgccactcactgtgctgacggatggggtgtgctccccgtcacttcccggagcttctctcacgactcactctcacttcggcgcggtctcctaccttcggatcacctctccacgtccacatcgagcccaggggggtggacgctcggtcggaccaattcggcggggactacctccgcaagaggcacgacaagtagcccgccttcggcgggcccccaggtgattggttgggaagacggagaagatgccctggtcccccatcgagggccgaaggggggccn

SEQ ID NO: 21982 - DNA, 774 bp, Zea mays
  misc_feature: Ceres CLONE 1391468-F
  misc_feature: Encodes the peptide sequence at SEQ ID NO. 21983
  misc_feature (17)..(17): n is a, c, t, g, unknown, or other
  misc_feature (19)..(19): n is a, c, t, g, unknown, or other
gggttcccccccccccncntcccccccccccctccctcagatggtccttctttcaaaactggcgctccccgcggtggcggccgctttacaatagtggatcccccgggctgcaggaattcgcacgagaccattacctagaacatcctaatcgaaaaatgaccgactagcccatggtctctctccgctccgacgcgcccgacccaccaccacatccctcatggctgcccgcgccgacatcgactcctcggcacttccgccgtccgagtcatccaaaggcaagggcaagatggacaaggaggaggaggacgaggcgaagggcgcggagaagatgtgcggcatctgctatctcgacggccggcgggccatccgcggcgagctcgactgctgcgcccatttcttttgctttgtctgcatcatggcttgcggccgcgtcgagtcccgctgtcccttctgcagggcccgctttcacaccatccgccgcccgccccgtcgccggccggttccccgaggagcgaaatcgtctccgatcccagaggggcacccgggaaccccatcccccagggcaaaggggagcaccaaaagggggggggaagacccttacggggaaacccattatggccccggtttggcgaagcttccaagcggaggaaaagcgggccgctcacccccgggggagcttcggcgcaccaccatgtccccacccccttcacggtgggcccccccggggggaccccccccggccccccaaacgccccccccaccgcggcccgcccc

SEQ ID NO: 21983 - protein, 185 aa, Zea mays
  misc_feature: Ceres CLONE 1391468-F
MAARADIDSSALPPSESSKGKGKMDKEEEDEAKGAEKMCGICYLDGRRAIRGELDCCAHFFCFVCIMACGRVESRCPFCRARFHTIRRPPRRRPVPRGAKSSPIPEGHPGTPSPRAKGSTKRGGEDPYGETHYGPGLAKLPSGGKAGRSPPGELRRTTMSPPPSRWAPPGGPPPAPQTPPPPRPA

SEQ ID NO: 21984 - DNA, 725 bp, Zea mays
  misc_feature: Ceres CLONE 1391469-F
  misc_feature: Encodes the peptide sequence at SEQ ID NO. 21985
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
tggtttttctctctttctcttatccacttttcccggctgggtagagnnnnnnnnaaaagtggagctcaccgcgggggcggccgcttttcaatagtggatcccccgggctgcagtaattcgcacgagaccattacctagaacatcctaatcgaaaattttcgcctcccctcggcatctcagtttctttgccaccgctcgcactagcgcgcgcgcctttctcgtcctgagttctcgtctcagcaccgcaccaccgtagacgactgcgcgcgaggacctacgaagctacgagtccatcacgctggtgctgctagctcatcaacaccatcatgctagagaaccaaaagcaagcggaggttctctggccgcggctggtggccaacaagttcttccggaagacctcgggcagccacgctttcgtcgccgacttcccggccgccgatgacgatgacgacatcgtctctggaacggaggccgacggcgtgtggcgggtgcagccccgacgcggacggccagcgttgcagtgaagcgggcggcgcccccacgaggggcaacaagaccctaaaggtacaagctggttcgcgggacacgggagaaacggggacggagggggcccgcccccgggtagggtttggaaacctggccaagcctaggctcggcccggcgcgtccacacgccaaacgaccccacaacacaaaattgggacccctcgggaagcaattagacag

SEQ ID NO: 21985 - protein, 65 aa, Zea mays
  misc_feature: Ceres CLONE 1391469-F
MLENQKQAEVLWPRLVANKFFRKTSGSHAFVADFPAADDDDDIVSGTEADGVWRVQPRRGRPALQ

SEQ ID NO: 21986 - DNA, 639 bp, Zea mays
  misc_feature: Ceres CLONE 1391471-F
  misc_feature: Encodes the peptide sequence at SEQ ID NO. 21987
aaagctggagctccccgcggtggcggccgctctagaactagtggatcccccgggctgcaggaattcgcacgagaccattacctagaacatcctaatcgaaaaagcacaagaacactcctagctagctgaagatctcgagtgcaacgcaacgttggcgcttggcggccagtagtagcagctaatttagcgtcgctccttcctagacgagagatcgagaaaccatggccaagctccaagtcactcctggcgccgcgttcaccgagtgcaatgaactcaacttccagggcctgtacctgtaccacacgcccctgggcccccaggccacccaagctgcgatcgtagagagcaagggcaagatcggcatcggtgcccacggtggttacaactgggcagtgtatgacgggccagggccagccgctaagctcgtcggcccgtgggcagggtttgccaatcctagccggaaactgggtcactcattcacccctggggtcgagggataaaagagttcagggggtcccacccttgaaaggggggggcataacgggtgaaatggggggggggggtttttttttttggcccccccggccatttttgttatgggaaacggctcccccccccaaaaaacccccccggggggag

SEQ ID NO: 21987 - protein, 92 aa, Zea mays
  misc_feature: Ceres CLONE 1391471-F
MAKLQVTPGAAFTECNELNFQGLYLYHTPLGPQATQAAIVESKGKIGIGAHGGYNWAVYDGPGPAAKLVGPWAGFANPSRKLGHSFTPGVEG

SEQ ID NO: 21988 - DNA, 670 bp, Zea mays
  misc_feature: Ceres CLONE 1391474-F
  misc_feature: Encodes the peptide sequence at SEQ ID NO. 21989
  misc_feature (436)..(436): n is a, c, t, g, unknown, or other
  misc_feature (670)..(670): n is a, c, t, g, unknown, or other
tccccgcggtggcggccgctctagaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacaaggaggaggaggacgaggcgaagggcgcggagaagatgtgcggcatctgctatctcgacggccggcgggccatccgcggcgagctcgactgctgcgcccatttcttttgctttgtctgcatcatggcttggggccgcgcgaagtcccgctgtcccttctgcagggcccgcttccacaccatccgccgcccgcccgtcgccggccggntccccgacgagcgaatcgtctcgatccaagagcgcaaccaggtacaccatcctcagggcaacgggagcagcatagtgggcggagatcccttacgtgaaccccatatgcaccgtttgcagaagctccagcgatgactagctgctgctactctgcgagctctgcaactcagctgcaacacctactgtgccgggcttgccgaccccgggccaaaggaaacacggcgcaccgcaaacn

SEQ ID NO: 21989 - protein, 138 aa, Zea mays
  misc_feature: Ceres CLONE 1391474-F
  misc_feature (95)..(95): Xaa is any aa, unknown, or other
MAALADIDSSALPPSESSKGKGKMDKEEEDEAKGAEKMCGICYLDGRRAIRGELDCCAHFFCFVCIMAWGRAKSRCPFCRARFHTIRRPPVAGRXPDERIVSIQERNQVHHPQGNGSSIVGGDPLREPHMHRLQKLQR

SEQ ID NO: 21990 - DNA, 610 bp, Zea mays
  misc_feature: Ceres CLONE 1391475-F
  misc_feature (364)..(364): n is a, c, t, g, unknown, or other
  misc_feature (441)..(441): n is a, c, t, g, unknown, or other
  misc_feature (442)..(442): n is a, c, t, g, unknown, or other
  misc_feature (458)..(458): n is a, c, t, g, unknown, or other
  misc_feature (572)..(572): n is a, c, t, g, unknown, or other
tccccgcggtggcggccgctctagaactagtggatcccccgggctgcaggaattcgcacgagaccattacctagaacatcctaatcgaaaactagcttcccactccgctcggccaccagctttgaccgcctcccctcccctccgctcctgttcttccataccccactcccccgcaggagcggcgcggcggcggcaaaggcaaaggcaagatgttcgggcgcgcgccgaagaaagcgacaacaccaagtactacgagatcctcggggtgcccaagtcggcgtcccaggacgacctcaagaagcctaccgcaaggccgctatcaagaaccaccccgacaagggcggtgaccccgagaaagtcaggnagctcgcacaagcctatgaggttttgagtgatccagagaaacgtgagatttatgatcagtatgggtgagatgccctnnaagaagaatgggtggngggtggatcccatggctgacccatttgacatttctcatcattcttggaccctcttttggggaggggtggtgggaagcacaggggaaaaaagcaaagggggggaaaaaaaggaancccctccctaaaggttccccgggaagaattttacaagg

SEQ ID NO: 21991 - DNA, 771 bp, Zea mays
  misc_feature: Ceres CLONE 1391476-F
  misc_feature: Encodes the peptide sequence at SEQ ID NO. 21992
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
ttttcactttcccccccccnnangtgaggaacaaaaaaacccgcccccggccagggggggggctccaccgcgggggcggccgctctcccaatagaggatcccccgggctgcagtaattcccacgagaccattacctagaacatcctaatcgaaaaacagcgaaccacccatggccctcgccaccactgccgtctccctccaccttttcctcacccggcccgcctccgtgctccgcgtaggccgcggcctcccatgcctcctcctccgagccacttcgtccacctccgcctccccggacttcaacatcaccttcgcggagcccgcgccgtccaaaaaggccccgtccgcgcagccgctggtcccgtggatcgtccgcggggaggacggcaagccccgcctcagcacctccccgccgccggacgtaatccaggccatcgcgctcgcggaggcggaggccaagaaggccgccaagaaggaaacccctcaagggccagaaatggggcgcagttgccgccgccgccgcggctgcttccaatgccagcgtcaagggcaaaggaaaaggaagcccgccccaaccgtgcccgccccaagtttcccaaggtaagccaggaagtttttaaaatgaaaaaatcaagggaaccggaaagcccccaacggactcgacaaagggccctatgcccgccccccaagaagcgggccatccaagaaagggacccagggggggggagcttctttcattcccaaggggtaaaaggcgctcctgcgatccta

SEQ ID NO: 21992 - protein, 144 aa, Zea mays
  misc_feature: Ceres CLONE 1391476-F
MALATTAVSLHLFLTRPASVLRVGRGLPCLLLRATSSTSASPDFNITFAEPAPSKKAPSAQPLVPWIVRGEDGKPRLSTSPPPDVIQAIALAEAEAKKAAKKETPQGPEMGRSCRRRRGCFQCQRQGQRKRKPAPTVPAPSFPR

SEQ ID NO: 21993 - DNA, 748 bp, Zea mays
  misc_feature: Ceres CLONE 1391479-F
  misc_feature: SWISSPROT Homolog: EC 2.4.1.121 Indole-3-acetate beta-glucosyltransferase
  misc_feature (6)..(6): n is a, c, t, g, unknown, or other
  misc_feature (13)..(13): n is a, c, t, g, unknown, or other
  misc_feature (14)..(14): n is a, c, t, g, unknown, or other
  misc_feature (28)..(28): n is a, c, t, g, unknown, or other
  misc_feature (29)..(29): n is a, c, t, g, unknown, or other
  misc_feature (35)..(35): n is a, c, t, g, unknown, or other
  misc_feature (36)..(36): n is a, c, t, g, unknown, or other
gtcctncccctcnntttttttttcaccnngggggnnccctgccactattcaaattgcgactccccgcggtggcggccgctctataactagtggatcccccgggctgcaggaattcgcacgagaccattacctagaacatcctaatcgaaaaaagaagaacatcgccattgcagcaagtctgtatgatctgtgacagctgtcgatagaattatcacacacattcgttattcgttgaactaaaaccatggcgaggccgtccgaccaaagcggcgtccacgtcctcctgctcccattccccacgcagggccacatcaacccgctgctccagttcggcaagcggctcgccggccgcgctggcgtccggtgcacgctcgcggcgacccgcttcgtcgtcagctcgacgaagccgaccccgagctcggtccacgtcgccgtgatctccgacggctgcgaagagggcggcccccgcgaggtggaaggaatgggcgcgcgctacctcgagcgcctcaagggggccggtcccagacgctggacgaggtcctcgggccgaagtcggccctggggccgcccggggaccggggggatcaaccaccgctccccccctggggggcaagggcggggcccccaccaacggcccacccagcgcggcccccccacacaccacaaaacacgggggagggcggggcggcaaaacgtcccacattcctggcggcccacggcgacgccaacccgccgcccgccgccacga

SEQ ID NO: 21994 - DNA, 662 bp, Zea mays
  misc_feature: Ceres CLONE 1391481-F
  misc_feature (611)..(611): n is a, c, t, g, unknown, or other
ccccgcggtggcggccgctctatcatagtggatcccccgggctgcaggaattcgcacgagaccattacctagaacatcctaatcgaaaaagggaggggaatcttcgtagagcactaggcagcgacggagtcagcgcagcttcgtctccttccttccttcccctttcgctggccgctggccgtcggcaccatcacctacggccacgggcgcagcgcggcgccgctccgtaccgggtccgcgggcctctcgccagggggacccgataagcctccgctgctctgctcggctgctcttaccgtctctcccgtccacggtccacttagctagaaacacacaacaaacaaggagaaatcgcaaggaggagcagcgcctgccgccgcgccgtatccagcgaggcagcccccccgccccgatctgccggcccgacacgctgggatcttcctttccttagccgaccggtcaacgccgcagatattctccttccctgcggctctggaggtttccgtaaacccgtcaccccccctccttctattccttgcaggtatcgacgatcagacggagcagttgcttcaatctcgacttcgacctccatctgcgttgaacccatttgnattttggaagaagggggggtgctttgcttggattgcacagcatctgcatca

SEQ ID NO: 21995 - DNA, 734 bp, Zea mays
  misc_feature: Ceres CLONE 1391490-F
  misc_feature: Encodes the peptide sequence at SEQ ID NO. 21996
  misc_feature (299)..(299): n is a, c, t, g, unknown, or other
  misc_feature (335)..(335): n is a, c, t, g, unknown, or other
ggagctccccgcggtggcggccgctctagaactagtggatcccccgggctgcaggaattcgcacgagaccattacctagaacatcctaatcgaaaactaccgagttttccttccccacctccccgccccacccgtcgccgaatcggagtcccgctcgcgtccacccttgccagagctcaagagctacctcctggtccggttggacagatcccttcgggcgctgcgtccaccgggattcaggcaaagtggtgtaacataagatgcaagggggaagaggtgggaggcagggtttgttcggntttggggaccctttttgttgtttttcgcggctttgnacagccagggaacataatgtcccggtttctttggtggcgcaaatccctttgatgacccttttctcacaaacccctttggtggcatgatgcaacctaggttctcacccccttttcagcgggatgatgcgacctagctccttgaacccctttggaagcaggatgcaaccaacttgggttgaatccaagatgtttgcagcccatggaaatcccatggggggcgctttttggaaacccaaaacatctcaaatccaagggttggacaatggcccgggtgtttatttccaaaaaccctttgaaaatcggggggcctaaaggggcccatttataaagagggttttttttccaagtggccgggttataagccgggggggggtttaaaaaattgcccccaaaaaggtg

SEQ ID NO: 21996 - protein, 63 aa, Zea mays
  misc_feature: Ceres CLONE 1391490-F
MMRPSSLNPFGSRMQPTWVESKMFAAHGNPMGGAFWKPKTSQIQGLDNGPGVYFQKPFENRGA

SEQ ID NO: 21997 - DNA, 724 bp, Zea mays
  misc_feature: Ceres CLONE 1391491-F
  misc_feature: Encodes the peptide sequence at SEQ ID NO. 21998
  misc_feature (244)..(244): n is a, c, t, g, unknown, or other
  misc_feature (367)..(367): n is a, c, t, g, unknown, or other
ggagctccccgcggtggcggccgctctataactagtggatcccccgggctgcaggaattcgcacgagaccattacctagaacatcctaatcgaaaaatatctttttctccccaagaaaaaaaaggcggcgagagcataagaagaaaaaaaacacacacacacacacacaaagcgcacttttcaaatcgacaaaggggaaaggttcgcttcttgtggcatcttgctttccttcgagtgccatggncgatccggcggaggagaacgttgtctcgccgccaccgacccctgcggccccagcgtgggcgcctcagacccgcccctgcagcctgctgctgacagcgcctcaacggagaagtgtctgctccgncgccgaagtaaggccccggggattcagcttcttggagaggacactcccgggccaattcccttgggggcggaaacctgctgacgttcttgtatggaaaaacaagaaacttctgctgttggataaggcggggcacctggcatctgggttcttgtccaaaaggcttgattaacccctccctggcccggaaaacccatgaccggattgggggggttgcccaccttaattcgggggggccaaagcacccacctttctaaaaaaaagccccccggatatacccccaagggggggatttcgggaacccttggggggaatggttcccgggaaaaaaagaaaaaaacaaaaaagaggtttttcttg

SEQ ID NO: 21998 - protein, 98 aa, Zea mays
  misc_feature: Ceres CLONE 1391491-F
  misc_feature (2)..(2): Xaa is any aa, unknown, or other
  misc_feature (43)..(43): Xaa is any aa, unknown, or other
MXDPAEENVVSPPPTPAAPAWAPQTRPCSLLLTAPQRRSVCSXAEVRPRGFSFLERTLPGQFPWGRKPADVLVWKNKKLLLLDKAGHLASGFLSKRLD

SEQ ID NO: 21999 - DNA, 665 bp, Zea mays
  misc_feature: Ceres CLONE 1391494-F
  misc_feature: Encodes the peptide sequence at SEQ ID NO. 22000
  misc_feature (286)..(286): n is a, c, t, g, unknown, or other
  misc_feature (287)..(287): n is a, c, t, g, unknown, or other
  misc_feature (290)..(290): n is a, c, t, g, unknown, or other
tccccgcggtggcggccgctctatcaatagtggatcccccgggctgcaggaattcgcacgagaccattacctaaaacatcctaatcgaaaaatccaattcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggnncgncgtgaagcgcatctcggggctcatctacgaggagacccgcggcgtgctcaagatcttcctggagaacgtcatccgcgacgccgccccaccacgcccgatggccgccgtaaggtcgctgctccgctcgtcggcctcccttcttcgcgccgcccccgacctcgcgagatcctcggctaccacgcgtccgtctcttcggcgcgcattggctgctcctcctcgcctcctcaaggtcgccgatcgagtcttagcttctgcgaggagtcactttctgcctctgcacaccgccaccgtccggttcgccaatgacgtccatgttccacgctcctgacctatgtcttttattgtcttaccccttctatatactgacgaagtacc

SEQ ID NO: 22000 - protein, 151 aa, Zea mays
  misc_feature: Ceres CLONE 1391494-F
  misc_feature (42)..(42): Xaa is any aa, unknown, or other
  misc_feature (43)..(43): Xaa is any aa, unknown, or other
MSGRGKGGKGLGKGGAKRHRKVLRDNIQGITKPAIRRLARRXXVKRISGLIYEETRGVLKIFLENVIRDAAPPRPMAAVRSLLRSSASLLRAAPDLARSSATTRPSLRRALAAPPRLLKVADRVLASARSHFLPLHTATVRFANDVHVPRS

SEQ ID NO: 22001 - DNA, 703 bp, Zea mays
  misc_feature: Ceres CLONE 1391495-F
  misc_feature: Translation starting site: 321
gctctattactagtggatcccccgggctgcaggaattcgcacgagaccattacctagaacatcctaatcgaaaaaactcgcctcgacgcgcctctgaaagttcggagccgccggcccgtccgcctccctctccgcctcccgtccccaaggccaatagttttcaagtggcaatgggcggaccaggctaacccaacccactgtccttcataagctcggtggccagttccacctgcgctcgatcatctctgaaggtgtacgggcccgtaacatatgccccatctgtctcatcttatgaaaggagatttgccacaaggaactacatgacccagagcctttggggcccttcaatgtctgttaacggtggcatcaatggtcccagtgaagcagaccccgctctgtggctaatgctccctgctgaacaaaggaggcaagaacttcctgattgatttcatgatgggcggggttccagctgctgcttcaaaactgctgctgctccccatccaagggagggaagctgcttattcaacaaccaaaatgagatgatcaacgccgggaaggctatcacagcccggacaaggcttattggttagctgcttcaaaaccgaccattaaagggtggaaaggttttcctcttcccttgggggagcggtaaacccctcgctaaaagttaatcccagtaacttcccccttacccagggttttg

SEQ ID NO: 22002 - DNA, 716 bp, Zea mays
  misc_feature: Ceres CLONE 1391506-F
  misc_feature: Translation starting site: 487
  misc_feature: Pfam Name: DUF1191 Pfam Description: Protein of unknown function (DUF1191)
ccccgcggtggcggccgctcttttctaaaggatcccccgggctgcaggaattcccacgagaccattacctagaacatcctaatcgaaaagttctgacttcacctgctttggcgcttgatcagctccgagccccgagtactgactccctccactgttatggacatcttcttgatccgcgcctgactcctccggctgctgctggagttcttcgccgccggcgccacctctccgggggaggcacagtcgcacccaccgtcgcccgacagacatacccgacgcggtattgcaggactacacgtaccgggacttcctgcgcccccgcaccggcattgtctacaacgccacgctcccggacaacctcaccggtattgccgcctccgcggtccacctgagcatgggcacccctccgacgcaaagtcttcacgggatacatacagattcgcgttccccacggacatccctagtgacacccgtacaacgaagcggatggggctcgtgatccacgtcctcagctactggagcgaccactattacccactcccccgagacacctacctgacaccgatgatcggcctgctgttctacgacgccagaaatctttccggccgcgcgcctgagcgttttcaatgtcatcgtcagcccaagcctcaactttaaggggggctttcgaccataactgaaaagtggttttccgaattgctcttggatgaacgaag

SEQ ID NO: 22003 - DNA, 746 bp, Zea mays
  misc_feature: Ceres CLONE 1391508-F
  misc_feature: Encodes the peptide sequence at SEQ ID NO. 22004
  misc_feature (352)..(352): n is a, c, t, g, unknown, or other
  misc_feature (402)..(402): n is a, c, t, g, unknown, or other
aaaactggagctccccgcggtggcggccgctctattactagtggatcccccgggctgcaggaattcgcacgagaccattacctagaacatcctaatcgaaaaacttacctggagagaaatttgctattttgccactctcaattttggctgcctgttattataccatcccgtgtctatgactagtgggaccgtctgtgtctatgatttatgggttcgatggtatattggcgaagcccacaaatgataatggcaaaattgtcaatggcctaggccagtgactctcattgcacttggacggtaggccagtgactctcattgcacttggagggtacgctgacttaccatctccccnagggtacgctgacttaccatctcccccagtgggagagtggacgtcataantttgtgtagaggggtcataatttgtccagttgactctcattgcacttggaaggtacgctgacttaccatctcccccagtgggagagtggacgtcataattttgtaccatctcccccagtgggaaagggaccgcaatattttgggttaaactaaccattcctcccaggggaaaaagggccgcataatttggtgtaaaaggccctaaattttggttaaaggcccgggggccccctgcaaaaacaaaaattaaaatttttttgcgcgggaaaaaaaggacttttaaaccggatttttaacccctccacccgggggggtaaaattttggaaaataaaaatttttaaag

SEQ ID NO: 22004 - protein, 60 aa, Zea mays
  misc_feature: Ceres CLONE 1391508-F
KTGAPRGGGRSITSGSPGLQEFARDHYLEHPNRKTYLERNLLFCHSQFWLPVIIPSRVYD

SEQ ID NO: 22005 - DNA, 688 bp, Zea mays
  misc_feature: Ceres CLONE 1391509-F
  misc_feature (267)..(267): n is a, c, t, g, unknown, or other
  misc_feature (320)..(320): n is a, c, t, g, unknown, or other
tccccgcggtggcggccgctctagaactagtggatcccccgggctgcaggaattcgcacgagaccattacctagaacatcctaatcaaaaaacagatccctctccactgtctcaccctttctctctcctcgaccctcccgacgcggcaaagcaaaaacacaaggaggagaggagggagagaaggaagaaggcgaggccaaaaatcccctccccctccccaaatcctagcccaataatctctcaatcaggggattctttagtctgatncagtcggaggattcggcagggcgcagccatgaacgagaaggcgtccgtctccnaggggagctcacgcaagcacaagagatattggaaagccttctacggcatcctgaaataaagaatgcccaaactgcaagccaaagggcccccgaggggaaagggggatcctaggaatctttaaggggaggaatggtccgggaattaaaaaaacccgggggggcactattttaagggaaaattgccccccggaaaaagggtggcaaaaaaaatgtggtttttttctctcgggggagacaaaaaaaaataatttttggggagaacgggcccccccaacaagggggggggggaaaaaaaaatttcccccaaaaaaaggagaaaaggggggcccccaaggggaaacccaacctcgcccgcggggggggggaga

SEQ ID NO: 22006 - DNA, 707 bp, Zea mays
  misc_feature: Ceres CLONE 1391512-F
  misc_feature: Translation starting site: 148
  misc_feature: SWISSPROT Homolog: EC 3.4.25.1 Proteasome endopeptidase complex
  misc_feature (367)..(367): n is a, c, t, g, unknown, or other
  misc_feature (440)..(440): n is a, c, t, g, unknown, or other
  misc_feature (441)..(441): n is a, c, t, g, unknown, or other
  misc_feature (454)..(454): n is a, c, t, g, unknown, or other
  misc_feature (577)..(577): n is a, c, t, g, unknown, or other
  misc_feature (597)..(597): n is a, c, t, g, unknown, or other
  misc_feature (674)..(674): n is a, c, t, g, unknown, or other
gctctagaactagtggatcccccgggctgcaggaattcgcacgagaccattacctagaacatcctaatcgaaaacacttcccgtgtttctaactccggtggctccaccaccagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaggctctgcacaagaacctagctngcagagaattgctataccaacaccagcataacaaaaaggatgagctgccctgccatggcacagctcctctccnnatacctgtactancagcgcttcttcccatattacgccttcaatgtgctcggtgggcttgacagcgaggggaaaggggtgtgttttcacctatgatgcagtaggttcctacgagagaactggttatagtgctcaggnaactgaatctactttgattnatgcagtcctggacaatcactaaaatcaccaagtcctctattgcttccctgccaggatgctgtcacaccattgtcgnagtcagaggccatcgatctagttaaggatgtgt

SEQ ID NO: 22007 - DNA, 712 bp, Zea mays
  misc_feature: Ceres CLONE 1391513-F
  misc_feature: Encodes the peptide sequence at SEQ ID NO. 22008
  misc_feature (382)..(382): n is a, c, t, g, unknown, or other
  misc_feature (399)..(399): n is a, c, t, g, unknown, or other
  misc_feature (465)..(465): n is a, c, t, g, unknown, or other
  misc_feature (466)..(466): n is a, c, t, g, unknown, or other
  misc_feature (524)..(524): n is a, c, t, g, unknown, or other
  misc_feature (526)..(526): n is a, c, t, g, unknown, or other
  misc_feature (547)..(547): n is a, c, t, g, unknown, or other
  misc_feature (608)..(608): n is a, c, t, g, unknown, or other
  misc_feature (648)..(648): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaagtgttcgagtccatcttcttgtgccatccaacccctcgtccgtagatcgatcgctgctacgcgcctgcatgctgacggttcggcgccgctgatgcgatgaagctctcgtagcccgacgttagcgagaagacgggatcgcacaagtactgaggtctcggccaggtgtcgatttggttcaaccgagggagcacctgtgcattgctataacaacaatgctggatcgggttgccatgtcagctgaggattctgccctggctgaagattttgcaggtgaagaggntctccccggtctcattncagtcgggaaggcctgtgcagtttgcaaagaaggcatccgatcattggatgcctcgtggaaacctnngaaatgtgaccatgtcatctgcattgcctgctttctgcagtatgcacctgagactgangncactggactgcccaagtgcgncgtgccatcttggtgatcttttgtgcatacagagacacatcagggcaccaatggtgctcgntgcacttcgatctcgattgagacctggaccggaaaggaannaaaccctaggtagtagtacaatcaagagcttgtcaatgctctcgaggggcgagacaatatcag

SEQ ID NO: 22008 - protein, 82 aa, Zea mays
  misc_feature: Ceres CLONE 1391513-F
  misc_feature (23)..(23): Xaa is any aa, unknown, or other
  misc_feature (29)..(29): Xaa is any aa, unknown, or other
  misc_feature (51)..(51): Xaa is any aa, unknown, or other
  misc_feature (70)..(70): Xaa is any aa, unknown, or other
  misc_feature (71)..(71): Xaa is any aa, unknown, or other
  misc_feature (78)..(78): Xaa is any aa, unknown, or other
MLDRVAMSAEDSALAEDFAGEEXLPGLIXVGKACAVCKEGIRSLDASWKPXKCDHVICIACFLQYAPETXXTGLPKCXVPSW

SEQ ID NO: 22009 - DNA, 732 bp, Zea mays
  misc_feature: Ceres CLONE 1391514-F
  misc_feature: Translation starting site: 212
  misc_feature: SWISSPROT Homolog: EC 2.7.11.1 Non-specific serine/threonine protein kinase
  misc_feature (491)..(491): n is a, c, t, g, unknown, or other
  misc_feature (547)..(547): n is a, c, t, g, unknown, or other
aagctggagctccccgcggtggcggccgctctagaactagtggatcccccgggctgcaggaattcgcacgagaccattacctagaacatcctaatcgaaaaatccctttccccaacccccgaagccgagccagcgaaccaccccgcccgctgccgcaagcaagcaagcagccaagcagtgtgaactgaccgaccgttccgtccagcccaccatggaggcgccgccggtaccggagcccatggatctggacgcgccccctcccgccgctgccgacgccgcagccgcggcgccggttccccctgccgtcagcgacaagaagaaggaaggggaagggggagacactgttacgggccacatcatctccaccaccatcggtgggaagaacggcgagccgaagcggaccatcagttacatggcagaacgtgtcgtgggtacgggctcatttgggatcgtcttcccagctaaagtgttggagactggagagacctcgncattaagaaggtgctgcaggatcggcgttacaagaaccggagctgcaacttatgcntggcatggagcaccccaaagtcatctggctgaaggactgtttctttcaaaaaggagaagggacgagtggtttcaaacccttgcatggaatttgcccccaaaacccggaaccgggtcttgagaacttacggaacgcgaaaccaaggatggcttttattcaccggaaggttaaagggacaccttttt

SEQ ID NO: 22010 - DNA, 736 bp, Zea mays
  misc_feature: Ceres CLONE 1391519-F
  misc_feature: Encodes the peptide sequence at SEQ ID NO. 22011
  misc_feature (517)..(517): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (612)..(612): n is a, c, t, g, unknown, or other
  misc_feature (623)..(623): n is a, c, t, g, unknown, or other
  misc_feature (630)..(630): n is a, c, t, g, unknown, or other
  misc_feature (631)..(631): n is a, c, t, g, unknown, or other
  misc_feature (695)..(695): n is a, c, t, g, unknown, or other
  misc_feature (696)..(696): n is a, c, t, g, unknown, or other
cgctcattactagtggatcccccgggctgcaggaattcgcacgagaccattacctagaacatcctaatcgaaaaatcaccaccatctcacttcatataccactccctaggaggacccagcaacacacacagccgagctttgcttaggcaagatgaacaggaagccaggagactgggactgcagggcgtgccagcacctcaacttcagccgccgagacatatgccagcgctgcagcgagccacgtggagttgctgatcgtggcgccggaggaagaagaagcaactacgccagcttcggggccggggggcctctcccttcggggggggttttggcgttggtgggttcggaaccccggccgggggattggaatgggccctgggggggggaaaaaatttcccaagccgtccaaggggtttaaggggtccccccaaaaaaggagaaccccttttaaaacagggcctttggggtttttaaaggaaaatgtcccccccccacgggttatccttctccaaaaggngctttttgtgtttgttttnnntttccccaaaaaaacaacaccccctgtaaaaacccaaaaagggggggnnnngtgcgccccccccccccagcctngcaggcgccgnccccccnncccccccacactctccccacaaaggtgggttttttgtggaaaaaccccccgagattttttggtnntttttttaaacaaaaaaaaaaaaaaaccggcggggggggg

SEQ ID NO: 22011 - protein, 88 aa, Zea mays
  misc_feature: Ceres CLONE 1391519-F
MNRKPGDWDCRACQHLNFSRRDICQRCSEPRGVADRGAGGRRSNYASFGAGGPLPSGGVLALVGSEPRPGDWNGPWGGEKISQAVQGV

SEQ ID NO: 22012 - DNA, 666 bp, Zea mays
  misc_feature: Ceres CLONE 1391520-F
cgcggtggcggccgctctataatagtggatcccccgggctgcaggaattcgcacgagaccattacctagaacatcctaatcaaaaaactctcgctttcttctgtctcgcctcgccctcgcctttgttgatcttttcctttctcgcgttcccctcgccttcctcttcctcccccacacccaccggtcgccgcccccgtcgccccggcctcctcggtccagagacgagggggtccgcgccgttccgacgccacaccgcaaccgcatcacatcaccgcctgctcccaccgtccatccgccctccctcgatcgcgctccccggatcgctggtacctccgcgcgcggctccgacctcatcttcctccatcgactggcatcggcagcggcggcgtgttcccggccaccttcgaaaggtaaatcatcggcagactttttggagctgtgttgggggggaccggggggaaaagccagttactgaaaaggctacattttcggttgccaagggatgcggaaaggaatcaatttccctgacttctccggggccggggggggccaggatggggggggggaatttggggggaaatttgggggaatggccttctaccaaaaattagggggggggcccaaatggggggggggacagccccaaacgggtggaaaccagtgggg

SEQ ID NO: 22013 - DNA, 694 bp, Zea mays
  misc_feature: Ceres CLONE 1391524-F
  misc_feature: Encodes the peptide sequence at SEQ ID NO. 22014
  misc_feature (462)..(462): n is a, c, t, g, unknown, or other
  misc_feature (570)..(570): n is a, c, t, g, unknown, or other
  misc_feature (639)..(639): n is a, c, t, g, unknown, or other
gctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccggnaggggcgagtgccggcgccagtgcctgcgccgccacgagggccagccgtgggagacccaggagtgcatgaggcggtgccgccgccgcggactggccgtcgacatggangcaagagtacggtcgcggcagcgagagcgcgggaagtggccgggagaggtgcgagcgccaccaccgcgnggacttggtgggagaggcagcgctgcctgatgatgaaaaaaaacccgggagggga

SEQ ID NO: 22014 - protein, 160 aa, Zea mays
  misc_feature: Ceres CLONE 1391524-F
  misc_feature (128)..(128): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETQECMRRCRRRGLAVDMXARVRSRQRERGKWPGEVRAPPPRGLGGRGSAA

SEQ ID NO: 22015 - DNA, 723 bp, Zea mays
  misc_feature: Ceres CLONE 1391529-F
  misc_feature (575)..(575): n is a, c, t, g, unknown, or other
  misc_feature (603)..(603): n is a, c, t, g, unknown, or other
  misc_feature (622)..(622): n is a, c, t, g, unknown, or other
  misc_feature (623)..(623): n is a, c, t, g, unknown, or other
  misc_feature (702)..(702): n is a, c, t, g, unknown, or other
ggagctcaccgcggtggcggccgctctagaactagtggatcccccgggctgcaggaattcgcacgagaccattacctagaacatcctaatcgaaaaattcctctcctcttctctccccgcgcccctccctctcccccaaaaccctaacccatcgtcgaccggtccccgctctcgtggcgccggcaagatgaccctcctcgcagccatcaccaaccccgccgccgactcccgctccggctccagcgagagggctcaccctatcgtgctcaccccgggtgtcacgccgccgccgccgccatcctccacgcttcccaccccaataccgtcttccacctggtcgctctccccagccgaccccaccctcgccaccgccgcttcctacctcgcggcctcgcttgcctcctgctcctccctcccgcagctccgcgcccttctcaccacctttatcaccactctgtcacaatccctcgcactcccaaccccgccggcggccctccccgccgccatccgcgctgtcgccccttacttccccgccgcaatcgcctcccttgtggcctccaaggcggtaagcctcngccggcacgacatcctccttgctctcgnggaatcccgcctcctcccnngcaccgccacggaactcatctcgtcgctctgcgacaacgaccgggtcgaccttgtctgcgtcttgctcccgcaggccgncgacatacgttccctcgagat

SEQ ID NO: 22016 - DNA, 685 bp, Zea mays
  misc_feature: Ceres CLONE 1391532-F
  misc_feature: Translation starting site: 295
  misc_feature: SWISSPROT Homolog: EC 2.4.1.207 Xyloglucan:xyloglucosyl transferase
cgctctttactagtggatcccccgggctgcaggaattcgcacgagaccattacctagaacatcctaatcgaaaaaagttccatatccaacacacacagcaacgctcgctcgacactgtcactaactagttgatctactagagggcggatatagagctgcctgcaatccgccgctgagaagggaggatcgaaaccgacgatgaggccggttgctcctgtctttctgtcaccgaccgtgacctgtctggagctggcgaacaccgctcatgacgctaacttctaccaggacacatagatgacctgcgtcgatgcccgcgctaaggtagcgcacggcgaacgcgggctggacctgacgctggaccgcacgtccggctccgtgttccagactcagagcgagtacctgttctataagatcgacatgcagatcgagctggtgccaggcaactccgtggcacggtcaccaccttctacctgtcgtcccagggcgacgcgcacgacgagatcgacttccagttcctgatcaacgtgagcggagagccctacacgctgcacaccaacgtgttcacgcgcggacaggactagcgggagcagcagttccgcctctgggtcgaccctacactgccttctacacctactgcatcctgaggacccgcagcacgtgatcttcgcgagaacggcacttcgag

SEQ ID NO: 22017 - DNA, 707 bp, Zea mays
  misc_feature: Ceres CLONE 1391536-F
  misc_feature: Encodes the peptide sequence at SEQ ID NO. 22018
  misc_feature (606)..(606): n is a, c, t, g, unknown, or other
cgctctattctagtggatcccccgggctgcaggaattcgcacgagaccattacctagaacatcctaatcgaaaaagttcgtggagtggagtcaccacagaatcaaagaaaagctttcccccgatcctctcgcggacaccagcgatgggttcccgctacgaggtggaggtcaccgtcggctccgcccgggacctcaagaacgtcaactggcgcaacggcgacctcaagccctacgccgtggtgtggatcgactccggcagcaagtgctcgacccgcgtcgacctcgacaacggcgagagcccggcgtgggacgagaagctgctcgtcccgctcccgcccacctcccggctcgacgacgccgtcctctacgtcgacgtcgtccacgccaacgccgcccagggtgtcaagccgctcgtcggctccgcgcgcctcccgctccgcgatgtcctcgatgacgccgtactcgcaggaaaggtcctcttgtagcctccgcctcaatggcccctcggaccgccccctcgttagcctcgacgtccgagatttcgatctagcaagcgttccaggtactacaacccccaaacacttactggatccccgcgaactaggnctaacttgggctgcgtgttacccattgacccactacgaaccgtccagctgctggctggccggcggttacttgtgtctccggacgtgcataaccgtcttgcg

SEQ ID NO: 22018 - protein, 113 aa, Zea mays
  misc_feature: Ceres CLONE 1391536-F
  misc_feature (7)..(95): Pfam Name: C2 Pfam Description: C2 domain
  misc_feature: SWISSPROT Homolog: EC 3.1.4.4 Phospholipase D
MGSRYEVEVTVGSARDLKNVNWRNGDLKPYAVVWIDSGSKCSTRVDLDNGESPAWDEKLLVPLPPTSRLDDAVLYVDVVHANAAQGVKPLVGSARLPLRDVLDDAVLAGKVLL

SEQ ID NO: 22019 - DNA, 720 bp, Zea mays
  misc_feature: Ceres CLONE 1391537-F
  misc_feature: Translation starting site: 208
  misc_feature: SWISSPROT Homolog: EC 2.7.1.4 Fructokinase
ccccgcggtggcggccgctctattctagtggatcccccgggctgcaggaattcgcacgagaccattacctagaacatcctaatcgaaaaaccgcagacgtagcacattcggctcgtcttatccttcgccaccagcccgtctctctcttctctctgtctctcttctcgtagccacgtccacctcgcatcagatagcaagcgcgaccaaatggcgcctctaggagacggcggagctgctgccgcgtcggcgtccaacaccctggtggtgtcgtacgccgagatgctgatcgacttcgacccagacgtgaccgcgttgtctctgctcgagtcgtacgaatgcgtctagctcccaggcgaagctcctgccaacggaggctgcgacatcgataagctcggaggatcctccgccttcttcagatcgtctgcggacgacgagttctgggtacatgttggcgaaaatcctgtaccagaacacgggaaggcttcgggatgactgtatcaacaagcacgcgagcacggtgctggccttcgggaccctcaagcaggacgggtaggacgagttattgttctacaggaaaccgagagcgtacatgctgctgacgaaagtgggactttttcctgggaccgaagagggcacccagggtgttccagtaggggtcattctcgctaatttttgagtcggggcccatcgggggccctggactcgcaggggccaacctcc

SEQ ID NO: 22020 - DNA, 772 bp, Zea mays
  misc_feature: Ceres CLONE 1391540-F
  misc_feature: Encodes the peptide sequence at SEQ ID NO. 22021
ccccgcggtggcggccgctctattccagtggatcccccgggctgcaggaattcgcacgagaccattacctagaacatcctaatcgaaaaaaaaaccccgacgcgtccccacctccgtcgccgatgacaccgcgtgccccgcagcttcggcatcacccgccgcacctcctcctcgccgaggctgtcgcctcctggcaccccttccacaagaagccctgtctcacggaccgctccacggctcccccctcctcggcccgcctccctgatgcggagactccgacgcctgccctctcggggggcggtagcggcggatccttccggtggttcgggctccgcaagcggcgccgccgcggtccggcctcgcggtccgtgtccgggcgcaacagcgaccgccggagatccgggacgggctccgacttccattttcacgggcggcgcccggtgtgggggggggcggcggccccactggctccaaggggaaaaaggtggccccccaatgtccgaaaagtgggaaagaaggaacatgcccaagggcaacggattcccccccccccccctgttgggggggtttggttccgggaaaggggggggtccccctctttccggggagaaaacaccccccccttttttgaaaatagggaaccaccctcgggccccggggaaaaggggggtgtgtttatttgaaaaaaaacccccaaaaagagggggtggggggggggcgccccttttttttggggggggggttttttgaaaaataaacaaaaaaaaaccgg

SEQ ID NO: 22021 - protein, 186 aa, Zea mays
  misc_feature: Ceres CLONE 1391540-F
MTPRAPQLRHHPPHLLLAEAVASWHPFHKKPCLTDRSTAPPSSARLPDAETPTPALSGGGSGGSFRWFGLRKRRRRGPASRSVSGRNSDRRRSGTGSDFHFHGRRPVWGGAAAPLAPRGKRWPPNVRKVGKKEHAQGQRIPPPPPVGGVWFRERGGSPSFRGENTPPFFENREPPSGPGEKGGVFI

SEQ ID NO: 22022 - DNA, 764 bp, Zea mays
  misc_feature: Ceres CLONE 1391543-F
  misc_feature (311)..(311): n is a, c, t, g, unknown, or other
  misc_feature (336)..(336): n is a, c, t, g, unknown, or other
  misc_feature (362)..(362): n is a, c, t, g, unknown, or other
  misc_feature (371)..(371): n is a, c, t, g, unknown, or other
  misc_feature (373)..(373): n is a, c, t, g, unknown, or other
  misc_feature (376)..(376): n is a, c, t, g, unknown, or other
  misc_feature (378)..(378): n is a, c, t, g, unknown, or other
  misc_feature (379)..(379): n is a, c, t, g, unknown, or other
aagctggagctccccgcggtggcggccgctctataactagtggatcccccgggctgcaggaattcgcacgagaccattacctagaacatcctaatccaaaaaggccctagcaacaaatccgtatcccgagtccggcgacggcagtatccgagctcgcactcgcgcacccgtccatcgcatcgcatctgtcctcccatcccctcagcgccaccgcaccgcaatcacacgcgcgccacccgcgatgacgccggcggcggcgatctccggctccagcagccacgtcgtcgtctcctccgcccgcctcaggcagncgttcacgctccctcccgcgcacgnttggccaaatcgccgcgccgcctcgnccgtgaccngncgngnngtcgcggtcgccgccgtgtcaagccccgttgtgtccgccgccgcggggaaggatgccaaacgggctcctaagaattcctttcaatcattgatttttgacaggatacattatgggaaattccttaaccaagcctccggggtaagggcttggataaagcttggggacaaagagctcccaacgggtcaaagggaaaaacaggggcttgttttttgcccacccacaaagagggccccgggttttttttggaaagggttttttttttttggggggggagggttttttttttggggccccggaaatttccccggggggaaacgggggggaaccccgggggggggcaaaaaaaactttttgcggtaaaagacaccttttgggggggggggtg

SEQ ID NO: 22023 - DNA, 667 bp, Zea mays
  misc_feature: Ceres CLONE 1391547-F
  misc_feature: Translation starting site: 149
  misc_feature: SWISSPROT Homolog: EC 1.2.1.3 Aldehyde dehydrogenase (NAD(+))
  misc_feature (243)..(243): n is a, c, t, g, unknown, or other
  misc_feature (359)..(359): n is a, c, t, g, unknown, or other
  misc_feature (489)..(489): n is a, c, t, g, unknown, or other
  misc_feature (500)..(500): n is a, c, t, g, unknown, or other
  misc_feature (533)..(533): n is a, c, t, g, unknown, or other
tccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcgnctcaggtcccaccgtcacctccacgagcccgaccaacaatcaggtcatcgcagaggtcgtggaggcgtccgtgcacgactacgaggagggcatgcgcgcctgcttcgatgccgccnagacatggatggcgattcctgctccaagcgaggagagatcgttagggcaatcggtgatgcactgagagcaaagctccatcaccttggcaggcttgtgtcacttgagatggggaaaattctccctgaaggnatcggtgaggntcaggaaatcatcgacatgtggtgatatgctgnggggctaagtcgcaaactaaatggatccatataccatctggacgaccaaccatatgatggaggggagtgtgcatcccccttggagggtgggggtgttatacggcatttaattttccctggggtggggcttgggg

SEQ ID NO: 22024 - DNA, 688 bp, Zea mays
  misc_feature: Ceres CLONE 1391550-F
  misc_feature: Encodes the peptide sequence at SEQ ID NO. 22025
  misc_feature (304)..(304): n is a, c, t, g, unknown, or other
  misc_feature (309)..(309): n is a, c, t, g, unknown, or other
aaagctggagctccccgcggtggcggccgctctagaactagtggatcccccgggctgcaggaattcgcacgagacattacctagaacatcctaatcgaaaaattcatcagacggactcacagctcgcagcacctgcaccacttgacaaccagccagctagctaaccaaccggcggagccaagaacaagcaagagacaacttgccccgtccaggcagcatgtgcaactccaacgtcaagtccgcgggcgtcgcccagatcgacggccgcccggtgctgcagccggcgggcaacccgcgtggcggngccgnacgccgcccgcccgctcaagaaagccctgcacaagtccttctccatggcgcccttctacgacaacaatggcacggtgcccgcccgtcccgcccctgccgagaacaccgtgggggggccggggccgccttctctggtgcctcctagaaagcgggcccgggccccgggggccgggggggaaacaaaggggggggggccgggcccggaaaaaaccccggtccaaggcaataaacccgcgccccggcttcccgtcgcactattcccacccccaaaacttagacccccatccacaacacccccctgacacggacaccaatggcccccccaccacacaaccccgcagcaagtggccccgctgcacgaacgcccaaatgcgtgtcc

SEQ ID NO: 22025 - protein, 85 aa, Zea mays
  misc_feature: Ceres CLONE 1391550-F
MAPFYDNNGTVPARPAPAENTVGGPGPPSLVPPRKRARAPGAGGETKGGGPGPEKTPVQGNKPAPRLPVALFPPPKLRPPSTTPP

SEQ ID NO: 22026 - DNA, 673 bp, Zea mays
  misc_feature: Ceres CLONE 1391551-F
  misc_feature: Encodes the peptide sequence at SEQ ID NO. 22027
  misc_feature (328)..(328): n is a, c, t, g, unknown, or other
  misc_feature (350)..(350): n is a, c, t, g, unknown, or other
  misc_feature (370)..(370): n is a, c, t, g, unknown, or other
  misc_feature (371)..(371): n is a, c, t, g, unknown, or other
  misc_feature (418)..(418): n is a, c, t, g, unknown, or other
  misc_feature (460)..(460): n is a, c, t, g, unknown, or other
  misc_feature (474)..(474): n is a, c, t, g, unknown, or other
  misc_feature (493)..(493): n is a, c, t, g, unknown, or other
  misc_feature (561)..(561): n is a, c, t, g, unknown, or other
ggagctccccgcggtggcggccgctctagaactagtggatcccccgggctgcaggaattcgcacgagaccattacctagaacatcctaatcgaaaaaaaaaggcactgctcatcgatccgccactacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctggtcaaggagggtcgccgnatctcccgcgccttccgcctcnacgtcgcgctccgtcgccgnnctcgcgggggggacgtctccgccttcctcgccttcgcggctaccgcngtctccgaagccctacgacgctcactggcctgtggcccaggnagatgatattgganatggatgttgatgctgcanctccagcaactcagatttcaatcaaacatgggtctccctgagattgaaatatattgctacttgctcgnactgattttccttaatgatcataaaaaatatgatgaggctaaggcatgcgcaggtgtgagcattgctcgcctgaagatctaaccggaaaaactggtggtggtttggcatcag

SEQ ID NO: 22027 - protein, 95 aa, Zea mays
  misc_feature: Ceres CLONE 1391551-F
  misc_feature (58)..(58): Xaa is any aa, unknown, or other
  misc_feature (65)..(65): Xaa is any aa, unknown, or other
MTEDVQMNDSEPQPAASAPAVGAPALSTLHHLKEIASVIEAGSLVKEGRRISRAFRLXVALRRRXRGGDVSAFLAFAATAVSEALRRSLACGPGR

SEQ ID NO: 22028 - DNA, 509 bp, Zea mays
  misc_feature: Ceres CLONE 1391552-F
cccgcggtggcggccgctctacaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaaggtcgcgacctccccgaccatggtctcgaggaataccatccgtacggctatcggcgtcatcgtcaatgacacgcccttgtgctcttcctctccccgggaagaaattatcgatcctgctcctggttgctattttttacccaccacccgaatattggaaaaattcatgaaaactaggccccccgcattccagctttccccctaataaggaaacccaggggataattttaaaaaaagccggggcttcaaaccccagaaaaaaaaaatggatgggccggaaactttgaacggtttgactttttcccggcaaaaa

SEQ ID NO: 22029 - DNA, 666 bp, Zea mays
  misc_feature: Ceres CLONE 1391554-F
  misc_feature (217)..(217): n is a, c, t, g, unknown, or other
  misc_feature (257)..(257): n is a, c, t, g, unknown, or other
  misc_feature (278)..(278): n is a, c, t, g, unknown, or other
  misc_feature (292)..(292): n is a, c, t, g, unknown, or other
aaagctggagctccccgcggtggcggccgctctagaactagtggatcccccgggctgcaggaattcgcacgagaccattacctagaacatcctaatcgaaaagtcgcacggattggcattggctgccctccggccctgttcctcgtcctcctcatcaaatcccgtctcctcagtcctcccaataatggtggcgtggtgagaaatcctttccgtccgncgtcgtcttagaagatgaaactgtcctcttgctgcggcgnttgcacttcatctttctccgngctttctcgcaggncgcgggggggggtttagttggtagttgttccccgaagaaaggaaattagaaagtggttttttcctgggtcaaaaaaagtttccacgggatcacgataaggcgcgcggcctccaccgtttgtcccgaaaaaaaggaaataaattttgtgcggggaaaaaccttgggaaaatcggcgaatttttccagaaagttttattttttttaagggggctcccaaaccttttttagaagggggaaatctattcttcggcagttttcctggggccccgctttaaggggaggggccccaaaaaaaggggaacccccccggtgggggggtggtataatgaggccacccggggtggggttgtccaaacaaggtggggccgcccttc

SEQ ID NO: 22030 - DNA, 697 bp, Zea mays
  misc_feature: Ceres CLONE 1391555-F
  misc_feature: Encodes the peptide sequence at SEQ ID NO. 22031
tccccgcggtggcggccgctctagaactagtggatcccccgggctgcaggaattcgcacgagaccattacctagaacatcctaatcgaaaaacctccactcgtttcgctcctctgaatccccccgggccccggcacggaattccccccggcacaccccccaaggccaccggacgccagcagccccgcccccgcccacacctacgtgcgagcgcaatgctggcggcgtccctcaggccggggccttcgctcgcggccttccccggtaccgcccagaggagcccagttcctttcctcccctttcctggccgcctcaaccaacggtccgttcttcctctctgcgaacgcagaggaaaccggtgcccacgccgtgctaggaccatccttccttgccccgcctcaacgaggaggtacctgccgcaacactacgagccaacacgcccaaataacgatagccacagagaaacgaagacaggaacaaacacagaaagtaggcgttaaagtatttcatcgaccaattagaaaaaaccaaccgcgagaaacacgcctccccccaacagcagactcaaccccatccctctcccccgatagacagaactttaggtcttttccagttacatacctgcgaacttaaacaaagaaatctagaacacatatcctcttacacattctcgcctcttcgctcccacccccccaccc

SEQ ID NO: 22031 - protein, 94 aa, Zea mays
  misc_feature: Ceres CLONE 1391555-F
MLAASLRPGPSLAAFPGTAQRSPVPFLPFPGRLNQRSVLPLCERRGNRCPRRARTILPCPASTRRYLPQHYEPTRPNNDSHRETKTGTNTESRR

SEQ ID NO: 22032 - DNA, 809 bp, Zea mays
  misc_feature: Ceres CLONE 1391558-F
  misc_feature: Encodes the peptide sequence at SEQ ID NO. 22033
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (50)..(50): n is a, c, t, g, unknown, or other
ggtttgccccnnnnnnntnnnncccccccccccccacccccccccttgtntattaaaaagctggagctccccgcggtggcggccgctctagaactagtgtatcccccgggctgcaggaattcgcacgagaccattacctagaacatcctaaaaaaatctctcgtctctatcgccgcatcgcttctctgccggagctccaacaacctcgcctcgcgcagcactccgctgaccctccctgactccctccctgccgctgggatggccgggaaacgagttacgggccgcgatgggcaagacgaggccggcgcccaggtcgggctcccggcgatggacctctcccctcgcgttcccgcaggccacacctgccctcatttttcccgccgtccgccttcggattattacccagccctgatgatctgctgaccagtgaaagagcgctcctatcaggaatgaagggtcagggggtattatggaaaaaaagaaaattggctcccatttatggccaagggtacctgggcaaaaagggaaaaaggtttcccattttaatggccatttcctaaaacttggcaaaggccctggggtggtttgcccggccgcccacaaaaaaaaggggtttatagggggggccccgaggaccttttcccaattaacaggcccggggggtggcgttacttagtgggccagacaaattcgcctttaaaaaggacccagccgtgctaccacaactttaataccgcgggggccactgcccccctccggcggggggggggggggaagtaatcgctggggtgcggcgggggcccgacggc

SEQ ID NO: 22033 - protein, 54 aa, Zea mays
  misc_feature: Ceres CLONE 1391558-F
MAGKRVTGRDGQDEAGAQVGLPAMDLSPRVPAGHTCPHFSRRPPSDYYPALMIC

SEQ ID NO: 22034 - DNA, 679 bp, Zea mays
  misc_feature: Ceres CLONE 1391559-F
  misc_feature: Encodes the peptide sequence at SEQ ID NO. 22035
  misc_feature (251)..(251): n is a, c, t, g, unknown, or other
  misc_feature (258)..(258): n is a, c, t, g, unknown, or other
  misc_feature (259)..(259): n is a, c, t, g, unknown, or other
  misc_feature (264)..(264): n is a, c, t, g, unknown, or other
  misc_feature (267)..(267): n is a, c, t, g, unknown, or other
  misc_feature (268)..(268): n is a, c, t, g, unknown, or other
  misc_feature (273)..(273): n is a, c, t, g, unknown, or other
  misc_feature (274)..(274): n is a, c, t, g, unknown, or other
  misc_feature (278)..(278): n is a, c, t, g, unknown, or other
  misc_feature (282)..(282): n is a, c, t, g, unknown, or other
  misc_feature (307)..(307): n is a, c, t, g, unknown, or other
ggagctccccgcggtggcggccgctctagaatagtggatcccccgggctgcaggaattcgcacgagaccattacctagaacatcctaatcgaaaactctcgctttctctagccatgacgctggtgaggatgccttgccgcctctgctgcttcctgctcgtcgtcgccgcctcccgcgtctccgggcggggggcggtggtcaccaccctcccgggctacgagggccgccctcccttcccactcgaaacaggntatgtgnnagtgnacnnagacnncggngcgnagctcttctactacttcgtccgggncgagtccggcggcgacgacagcgacaccccgttcgtcctccgaatccccggcggccaacgctgctccgccttcagcggcctccccatagaagataggcccatcatgttcggcggggagcccaacaagggaggttgccgggccgtggctaaaaaccaaattcgtggaaaaagggggcccatattcttttttgggatcccccaagtgggggcccgggtttccttctccaaaaatgcaaaaggtatacacgttggaggggaaacaaccccgctggcattggaggaagttccccgaaagagggggttcaccgacccatccggagaacccgggcacaccttctcccaagtggaaaaccaacccctcgaaaaccctcg

SEQ ID NO: 22035 - protein, 188 aa, Zea mays
  misc_feature: Ceres CLONE 1391559-F
  misc_feature: SWISSPROT Homolog: EC 2.3.1.92 Sinapoylglucose--malate O-sinapoyltransferase
  misc_feature (49)..(49): Xaa is any aa, unknown, or other
  misc_feature (51)..(51): Xaa is any aa, unknown, or other
  misc_feature (52)..(52): Xaa is any aa, unknown, or other
  misc_feature (54)..(54): Xaa is any aa, unknown, or other
  misc_feature (57)..(57): Xaa is any aa, unknown, or other
  misc_feature (65)..(65): Xaa is any aa, unknown, or other
MTLVRMPCRLCCFLLVVAASRVSGRGAVVTTLPGYEGRPPFPLETGYVXVXXDXGAXLFYYFVRXESGGDDSDTPFVLRIPGGQRCSAFSGLPIEDRPIMFGGEPNKGGCRAVAKNQIRGKRGPIFFFGIPQVGARVSFSKNAKGIHVGGETTPLALEEVPRKRGFTDPSGEPGHTFSQVENQPLENP

SEQ ID NO: 22036 - DNA, 712 bp, Zea mays
  misc_feature: Ceres CLONE 1391560-F
gctctagaactagtggatcccccgggctgcaggaattcgcacgagaccattacctagaacatcctaatcgaaaaaacgatcgatcgggccaggcccgcattctatgggatccgtctctccactctcttctctaccgaacacaatctcatccgtcttcctcttccccatcagccgccctaccgagtcttcgcacgcacgacgcttcgtcaggatcgattcgcgagacctctcctgtccggatcgaggttcatggtttacatatgcgcgtttgtttactgatgcataccacgaccacctggatccggatgtcaggacagatctcctgctttaatcgagtccagctcatgtatgaactctcccttttcctggcacgttgctaaatgtaaaagggtgtctccggcatttaagaaaaccaccccggcatccttggtctgaccaggaaaaggacctacgggcagcttacgagctccctcccggctcacccaaaattttgcgggggactgggcctggcacgcagacccgttcccctcatttgacacccggagaccccccgacagggttgtggaagtttttaacgcataagggcaggggcagcggagtgtattgtcggcttaccttacgtggaacaccaacagggggatcgaatacttcccccggagctcaacgccgtaaggaagagagcaccggcatgatggattcccattgctccccc

SEQ ID NO: 22037 - DNA, 661 bp, Zea mays
  misc_feature: Ceres CLONE 1391561-F
  misc_feature (315)..(315): n is a, c, t, g, unknown, or other
  misc_feature (337)..(337): n is a, c, t, g, unknown, or other
  misc_feature (432)..(432): n is a, c, t, g, unknown, or other
  misc_feature (570)..(570): n is a, c, t, g, unknown, or other
  misc_feature (661)..(661): n is a, c, t, g, unknown, or other
tggagctccccgcggtggcggccgctctagaactagtggatcccccgggctgcaggaattcgcacgagaccattacctagaacatcctaatcgaaaaagctagctagctctccatgaatcgtatcgatcggaagagaagaagcccattccctgcccctgcctgccttggatacctactccctctccctccctcctcacatcacacagacagcagacaccactggccggccggcctgttcgttcattctctctcgctcgctcgctcgcccgcccgcccgcccgccagcctttcattccatctattaaacgcctatnaatacagtacaggctcacacgntccatgggaaggaatgtccatcttccttcactaccaccacacggctgctggctgctactaggcaggccttcccacacgcccgccgtagctctctncgcttgtgtggtcatccccggcctcgccttctctcattctgtcgtctgctgcccctgcctgccagtgccacacccccccgggccgtgcgggattatattcgggcccaacccaagcaaatggagaaagcgaggaggggncacggggagtggtggcgcgaggagtatgcaaaggagctcacgaagaacaaaagcgaaggccacttgccagtcaaaagggatgctggtgcgn

SEQ ID NO: 22038 - DNA, 723 bp, Zea mays
  misc_feature: Ceres CLONE 1391565-F
  misc_feature: Encodes the peptide sequence at SEQ ID NO. 22039
gctctagaactagtggatcccccgggctgcaggaattcgcacgagaccattacctagaacatcctaatcgaaaaaaaggtggcaggcacagagagagctagctttggccaggcgtccacagcagccagcacaagatgtcgacggtggtcatgggggtggatcttgagtgccacaagtgctacaagaagatcaggaaggtcctctgcaaggtccaagacaaggtgagcatcaggaccatctcctacgacgagaagacaacacggtggacggtgtcccgggccttcgacggcccgaggaggtcgccgacaggctcaccgccgacgccggcaaggtcatcaccgacataccccgtcggccgggggcttcgggttttcggctttgggcagggggcccgacgcggtggcctttagctaaatatcaaaaagaccacccggcttaggatccggacccacgcctacacaccatcgccctcatctcacctactcacggattatctatctgcccccgaacgaccggcgacttttttgacgctgtttgccgcttttggatcctttatcccccgcccccggcgaacgcagaaggcgggaagacccccggcggccgcccgcgccgcggtgtgacgcgccccttactccgatcacaacaagccacgccacccccaagacatcgcaaccgaggcgggggagcgcgggggccgcgccggggtggcggggtgccgcggcc

SEQ ID NO: 22039 - protein, 91 aa, Zea mays
  misc_feature: Ceres CLONE 1391565-F
MSTVVMGVDLECHKCYKKIRKVLCKVQDKVSIRTISYDEKTTRWTVSRAFDGPRRSPTGSPPTPARSSPTYPVGRGLRVFGFGQGARRGGL

SEQ ID NO: 22040 - DNA, 704 bp, Zea mays
  misc_feature: Ceres CLONE 1391569-F
  misc_feature: Encodes the peptide sequence at SEQ ID NO. 22041
  misc_feature (480)..(480): n is a, c, t, g, unknown, or other
  misc_feature (496)..(496): n is a, c, t, g, unknown, or other
  misc_feature (525)..(525): n is a, c, t, g, unknown, or other
  misc_feature (540)..(540): n is a, c, t, g, unknown, or other
  misc_feature (619)..(619): n is a, c, t, g, unknown, or other
  misc_feature (690)..(690): n is a, c, t, g, unknown, or other
  misc_feature (691)..(691): n is a, c, t, g, unknown, or other
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggnagggcgagtgccggcngcagtgcctgcgcccgcacgagggccagncgtgggagacccagnagtgcatgaggcggtgccgccgccgcggactggccgtcgacatggagcaagagtacggtcgcggcagcgagagcgcggncaagtgccgggagaagtgcgagcgccaccacccgcgggactggtgggaagagcagcgctgctgatgatgannaaaaacccggggg

SEQ ID NO: 22041 - protein, 159 aa, Zea mays
  misc_feature: Ceres CLONE 1391569-F
  misc_feature (93)..(93): Xaa is any aa, unknown, or other
  misc_feature (98)..(98): Xaa is any aa, unknown, or other
  misc_feature (108)..(108): Xaa is any aa, unknown, or other
  misc_feature (113)..(113): Xaa is any aa, unknown, or other
  misc_feature (139)..(139): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGXGECRXQCLRPHEGQXWETQXCMRRCRRRGLAVDMEQEYGRGSESAXKCREKCERHHPRDWWEEQRC

SEQ ID NO: 22042 - DNA, 677 bp, Zea mays
  misc_feature: Ceres CLONE 1391572-F
  misc_feature: Encodes the peptide sequence at SEQ ID NO. 22043
ggagctccccgcggtggcggccgctctagaactagtggatcccccgggctgcaggaattcgcacgagaccattacctagaacatcctaatcgaaaacattttctcggccgggagccgcaattccatcctgctgctagagttacatactcacccaatagaacaattctatgcccggtgattgtacctcctgaagtagaagagcatactgaagcagaactcgagtggtgttggatcgaaatggaaggcgggatgtcaagtttggaagccgccatgaaagcttcttcatcgatggccagcagcatggcaaggaatgctgaccctaaccaacagactctccgccccaattaatgggagcaggtctattttccaagaactggtcaatctttgccaggcattcctccattttttggggcctcccctccaagttggatcttcccaatggacatggaggctaaatttggcaaacaactttggaatcaaatccttcacagaataacagattggaaccccacaggggaataggggagcaaccctaccccttcctttgagcagaagatcaagcagggaaaggaattttggggcagcccaggggtaacccgagaagaaccaggaggtggggggttcccgggggaggaagttggaaaagagcaagtttataaacgggggacctccattag

SEQ ID NO: 22043 - protein, 36 aa, Zea mays
  misc_feature: Ceres CLONE 1391572-F
MEGGMSSLEAAMKASSSMASSMARNADPNQQTLRPN

SEQ ID NO: 22044 - DNA, 803 bp, Zea mays
  misc_feature: Ceres CLONE 1391574-F
  misc_feature (11)..(11): n is a, c, t, g, unknown, or other
  misc_feature (16)..(16): n is a, c, t, g, unknown, or other
  misc_feature (19)..(19): n is a, c, t, g, unknown, or other
  misc_feature (35)..(35): n is a, c, t, g, unknown, or other
  misc_feature (283)..(283): n is a, c, t, g, unknown, or other
tttttcccccnttctnttnttcccctcacttttgnacgccccaaccccacaaactggtgctccccgcggtggcggccgctctataatagtggatcccccgggctgcaggaattcgcacgagaccattacctagaacatcctaatcgaaaatcaaacccccggacatttctggtcgcaccctcctccggccctcccagccgctaagccctctggaaccttcgagagctcgatcggatcggagcccctgccatgcccgacgaggcgaaggcaaagggtaatgcgncgttttacagccgccgcttcgaggaggggcgcggaactccaggaagccatcgcgctcgcccggggaaaccaacgtctctactccaaccggccgggggggttcgcctcactccaacggttactccgagcttctcccccaacgggaagaaaaacccgtcaagttcaagcccgaattgggcccaaggggttactccccgccttcgggggggggcacctccggccctcgggggaagcccgcccagatggcctttccccgaaaaaagaaaaaaggggcttttgtgcgctccccccccagagagaaaaaaggttcccagggggggggcttccaagaaaaccccccaaaaaaggcccccccacccccccaacaaggggttggggattatccaaccgcggcccctagcgcacgtaggacacaatagaagacccgcgccccccccactggggggagtgaaaaaccgcggggacccccccccacccttcgaccttcattaaacccgccctctcattcctaccgccgcccg

SEQ ID NO: 22045 - DNA, 659 bp, Zea mays
  misc_feature: Ceres CLONE 1391575-F
  misc_feature (73)..(73): n is a, c, t, g, unknown, or other
  misc_feature (82)..(82): n is a, c, t, g, unknown, or other
gctctagaactagtggatcccccgggctgcaggaattcgcacgagaccattacctagaacatcctaatcgaanaaacagcanagcccaggctgcccagcacacgcgacgcgaaccagctgccgaggacccctagcggagcactgtgcaggcgaccgcggcgcgctatcactttacgggagatacggcggcatcggccccctcggcccctcctccatccctggggcggggcgccagcctgcaggtgttgaatgctgatttgtgggggctgaataattggggtgatcgccaattaaacgggattaggcccgttgaacgcccttctggggatcagaaacgccccgcaatctggaaggggtggggccgccaacctccggagggactccggggagccggggcccccttggccaaaccacgccccaaaaagcttttcgggagctggcccggccacgaggggtcccggtggactcctatccccggggcaaggggaagcctctggcaaaaaggggccggggggggtttggcccccggccccccgggggggaagctgcggggccgcccgcccgagggaggcccgccccccccccctccccccgagagcggggggcccctttcggggggggtccggggcgggacccgccctcccccaggcgctttttcg

SEQ ID NO: 22046 - DNA, 678 bp, Zea mays
  misc_feature: Ceres CLONE 1391576-F
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
aaagctggagctccccgcggtggcggccgctctataacagtggatcccccgggctgcaggaattcgcacgagaccattacctagaacatcctaatcgaaaactcccagctcctcctccctgtctgctcccctccactgctgtggcgctctccctctcccgtctcccctcaccttctccacctcccccattccgccaccgcacaagccgacctccctcaccaagaggagaaaagaaagggagagcgaaggaggcaaaccaggtgggacagcaacgcgacgtgcttgctattctctcgagagagatgtcaattttataataaaaccccagcatgcgtcagctggcgaattatgacttgagctcatgccaaggtgtaagtcttactgcaagaagggcagctgtgcatgttaagacccatacatagcctctcttgattaccagcacgnnngggtgaaaacttgagatacagttgatctcctggttcagagtatgggttcaaggtttgcatcgcatcagctgagcatgggcctggatgtttctggtcgacctgaacaacctaaggagaaggccccaccattttttcccctgcgatgcatatactgggggggacatcaaaaatcaggagagctggggaaagaggtttgcctccatggtgagaaacaaaaaaaactggccctcta

SEQ ID NO: 22047 - DNA, 685 bp, Zea mays
  misc_feature: Ceres CLONE 1391577-F
  misc_feature: Encodes the peptide sequence at SEQ ID NO. 22048
  misc_feature (344)..(344): n is a, c, t, g, unknown, or other
  misc_feature (375)..(375): n is a, c, t, g, unknown, or other
  misc_feature (384)..(384): n is a, c, t, g, unknown, or other
aagctggagctccccgcggtggcggccgctctataactagtggatcccccgggctgcaggaattcgcacgagaccattacctagaacatcctaatcgaaaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcctgctggccgccacgctgtncgagcgcttccgcgtgctgctgctggagcgncgcgcctcnccctacgacgacgacccgcatcggggacatggcccgcttcgcggacacgctgtcggacacctccccgggctcgcccgcgcagcgcttccgtgtcggaaggacggcgtcatcaactcgcgccccgggggggctggcggcggaaactgcaatcacgccggcttcaacccgcgggccaacaaccacccaccgggggggccgctgggttgggacctggggcgccccccggggcgtcgaaccgggggttaaaaaaataggttgatttaccccccgccatgggcgcccgcgacggcccccacgaagg

SEQ ID NO: 22048 - protein, 162 aa, Zea mays
  misc_feature: Ceres CLONE 1391577-F
  misc_feature (68)..(68): Xaa is any aa, unknown, or other
MSGRSRHFTMSTLLATSFFFVLLCSSLQVRGVNYTFVKDAALAPSVSYYDYIIVGGGTAGCLLAATLXERFRVLLLERRASPYDDDPHRGHGPLRGHAVGHLPGLARAALPCRKDGVINSRPGGAGGGNCNHAGFNPRANNHPPGGPLGWDLGRPPGRRTGG

SEQ ID NO: 22049 - DNA, 679 bp, Zea mays
  misc_feature: Ceres CLONE 1391578-F
  misc_feature: Encodes the peptide sequence at SEQ ID NO. 22050
  misc_feature (391)..(391): n is a, c, t, g, unknown, or other
  misc_feature (494)..(494): n is a, c, t, g, unknown, or other
  misc_feature (532)..(532): n is a, c, t, g, unknown, or other
  misc_feature (547)..(547): n is a, c, t, g, unknown, or other
  misc_feature (549)..(549): n is a, c, t, g, unknown, or other
  misc_feature (550)..(550): n is a, c, t, g, unknown, or other
  misc_feature (567)..(567): n is a, c, t, g, unknown, or other
  misc_feature (568)..(568): n is a, c, t, g, unknown, or other
  misc_feature (580)..(580): n is a, c, t, g, unknown, or other
  misc_feature (581)..(581): n is a, c, t, g, unknown, or other
aaagctggagctccccgcggtggcggccgctctagaactagtggatcccccgggctgcaggaattcgcacgagaccattacctagaacatcctaatcgaaaaatcttttcctttcccctcctccctcctcggctcgtctctgttcccctttccctcctgcgcacccgtcttctcctccccgcgtcaaaccccagcacaaaaagcaaccgcccgccgcctcctcgttcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccgncaactaacgtcaaggcgttccctctctacatgaacgcgctcgagtacttcaaaacccacctcaagtacgagaagaaccccaagatcaagggagccatcaccgncaagttcaccgagtactccgccgcggcgagagaatccnggcggtcctcgatgngnnggcgcgcagggctgggnnccaaaggtgggnnacccaacttgtcgccacgccccccaagaccaagggcagggacgggggaagaaggcaacggaaggggaatgactccaagcaagccaaggttgaaggcgg

SEQ ID NO: 22050 - protein, 98 aa, Zea mays
  misc_feature: Ceres CLONE 1391578-F
  misc_feature (3)..(3): Xaa is any aa, unknown, or other
  misc_feature (37)..(37): Xaa is any aa, unknown, or other
  misc_feature (50)..(50): Xaa is any aa, unknown, or other
  misc_feature (55)..(55): Xaa is any aa, unknown, or other
  misc_feature (56)..(56): Xaa is any aa, unknown, or other
  misc_feature (62)..(62): Xaa is any aa, unknown, or other
  misc_feature (66)..(66): Xaa is any aa, unknown, or other
MPXTNVKAFPLYMNALEYFKTHLKYEKNPKIKGAITXKFTEYSAAARESXRSSMXXRAGLGXKGGXPNLSPRPPRPRAGTGEEGNGRGMTPSKPRLKA

SEQ ID NO: 22051 - DNA, 646 bp, Zea mays
  misc_feature: Ceres CLONE 1391579-F
  misc_feature: Pfam Name: zf-B_box Pfam Description: B-box zinc finger
  misc_feature (411)..(411): n is a, c, t, g, unknown, or other
gctctataactagtggatcccccgggctgcaggaattcgcacgagaccattacctagaacatcctaatcgaaaaagcctttccctctcttctctgctctttgcatctctctcttgttcctcccttcctctctaaaaaaagggttctgatccctttctagaagctcctgggtttctgttgccgacccgagctccccaggggcgctcaggaggcgccgagccggcgaccgctccggcggatctgagaagccgccgcggtcgctttgcctccgttgcgatactgcacaggttccttgtaaactattgattgggaacactctgaagaagagtttgttggctgcataacatctcctgaagctggtttgaagtttgctgataggaaagatcatgggcgctctctgtgatttctgtgnggagcagaggtctatggtttactgccgatcagatgcagcatccttgtgtttatcatgtgaccggaatgtgcattcagctaatgctctttctcggcgtcataacaagacacttttatgggaccggggtgcttcacagcctgtaatggtccgctggctaacaaaaaatgcctcgctttgccaaaattgggattggaagggcccattgcaggatcctcatctggcggaaaaaaaggaa

SEQ ID NO: 22052 - DNA, 613 bp, Zea mays
  misc_feature: Ceres CLONE 1391585-F
  misc_feature: Encodes the peptide sequence at SEQ ID NO. 22053
  misc_feature (269)..(269): n is a, c, t, g, unknown, or other
  misc_feature (270)..(270): n is a, c, t, g, unknown, or other
  misc_feature (284)..(284): n is a, c, t, g, unknown, or other
gctcttaactagtggatcccccgggctgcaggaattcgcacgagaccattacctagaacatcctaatcaaaactgagcactgctgctgctgaaaatggcgcctgggcttgcgaactgggtcgcgctggttctgaccgtcgtccttggtctctcgtgccacgtcgcgctctcggaggatgaacactggacaagctgcggttcgtgcgcacgcacaggacgcgcccctggtgtcccagtacactactcgtgatcggcggcggcacggcggnntgcccgctggggcnaccctggcggacactcgcgggggtgctcctgggagggggggcccccggcccgcaaatggcggaccggaccactcacgggcggcctgcgaaacgtcccggggtccccggaaatggttgtgtcaaaaccgcttttaaaccctgtcccctttttctacgaggaagatgcccccctcaggaaaaaaacgggcgcgtcccctctcgggtgcccgccgcggtgaactccccccgccgcgcaaacgcacgcgttgtttgtccccgagaggtcttccgggcggcgggggtcggccgccggctcccaccaggctgggtaggtggcggccgcccgcccg

SEQ ID NO: 22053 - protein, 51 aa, Zea mays
  misc_feature: Ceres CLONE 1391585-F
MAPGLANWVALVLTVVLGLSCHVALSEDEHWTSCGSCARTGRAPGVPVHYS

SEQ ID NO: 22054 - DNA, 680 bp, Zea mays
  misc_feature: Ceres CLONE 1391586-F
  misc_feature: Translation starting site: 216
  misc_feature (253)..(253): n is a, c, t, g, unknown, or other
  misc_feature (258)..(258): n is a, c, t, g, unknown, or other
  misc_feature (261)..(261): n is a, c, t, g, unknown, or other
  misc_feature (274)..(274): n is a, c, t, g, unknown, or other
  misc_feature (298)..(298): n is a, c, t, g, unknown, or other
  misc_feature (326)..(326): n is a, c, t, g, unknown, or other
tggagctccccgcggtggcggccgctctagaactagtggatcccccgggctgcaggaattcgcacgagaccattacctagaacatcctaatcgaaaatctgggccccatgtgctaactgcctgtaaaccctaatcccgaatccctcccggcctcctccgtctcgcgctcgattcgaatccgagctccctatcctgctcctgctgttcccgctgcaatggaggacaacgcggtcgaagagcccgagttgagcgntgcgncgnagttcgcgccggngctcgtcgccgcccaccacacggnacctccgtcgccgttcgcatcgggccgnagttccgcgtgtttgatctcagggctggtcatcccatttcatgggcgggggattggggtggccattcttcatcaacccaataaagagtatttggttcagggggaggggagttttgttccgttccgtgggggacgaaatttggggaaggtttagaaaactaattctgcctctctctcccccccccactccccaagaggcacttcggagtcgttatatctgacagtatttccgcattctctcttttcccccatttctcaccgtctcctcctgtccacccaccggctcgacctctaaaatgttagggtgtggcccaccccttcttcttgttgctacccctttcctcctcccgcctcg

SEQ ID NO: 22055 - DNA, 652 bp, Zea mays
  misc_feature: Ceres CLONE 1391588-F
  misc_feature: Encodes the peptide sequence at SEQ ID NO. 22056
  misc_feature (302)..(302): n is a, c, t, g, unknown, or other
  misc_feature (359)..(359): n is a, c, t, g, unknown, or other
aaagctggagctccccgcggtggcggccgctctagaactagtggatcccccgggctgcaggaattcgcacgagaccattacctagaacatcctaatcgaaaaaacccccctttcccgccacaccatctcctcgccgcttcccgccacctctctcccatggcggcgccgtcggcggccacgcgcaggaaactgcagcgcaagttccgcctacgaggcttcaccctcaaggtggacgccctcgaggaggccgccgccttcctcgaccgcttccccgacgccgaggacgacgcgctcgatctccntcctcgacgagctcgacaagaaaccgctgcagtcgtcgatactggaccgggacgcgntcaggcgcgtggtggcgctgcttgtcgaagggcgagaggcgctcgatgtgccgtcgccagggccaccagcgcaagtctgcgctggggtggggggacgccttcccgggggccgggttccctaacttcccttcaagaaggatttttcgggcccccgggaaaatacctggccagggaaaaagggggaaaaaaacgctccctttataggggaagggaaccagggggtggtggaaaagcggctccgggaaaaaatattccccaaacccggtttttttgaacagagtggagacgcaacg

SEQ ID NO: 22056 - protein, 158 aa, Zea mays
  misc_feature: Ceres CLONE 1391588-F
  misc_feature (49)..(49): Xaa is any aa, unknown, or other
  misc_feature (68)..(68): Xaa is any aa, unknown, or other
MAAPSAATRRKLQRKFRLRGFTLKVDALEEAAAFLDRFPDAEDDALDLXPRRARQETAAVVDTGPGRXQARGGAACRRARGARCAVARATSASLRWGGGTPSRGPGSLTSLQEGFFGPPGKYLAREKGGKKRSLYRGREPGGGGKAAPGKNIPQTRFF

SEQ ID NO: 22057 - DNA, 674 bp, Zea mays
  misc_feature: Ceres CLONE 1391594-F
aaagctggagctcaccgcggtggcggccgctctagaactagtggatcccccgggctgcaggaattcgcacgagaccattacttagaacatcctaatcgaaaacaaagcctttcttcctcctgtgaagccaactcgtcccctcgggccaacgcgaggccaaaaccaatctcacatctcctccccctcccaccaccgaggacccttccccaagaactgctccgagtcctggagcgggagagaggtcgagggaggagcccaataagagtttctcctcgcctctctctctctctttctgctcgaaaaattattgtcgcattggtttggttcccttgccaaaggaggctgcttttctgtcctccctgatctaacatgatggcgagcaccgcatcagcgaccgccgccgccgccgccgtggcattcggggcagccgccaagccgcggggaccggcggctgtggcgctccgcgcaagggtgcctggcgccggcaggcggcgttccggcgtggccgccgcctccctccgccgcggtggggtcccccccgcggcggtttgcccgtctgcccgccggcgcgcccgccggcgcgtccggcccccgtccccggtccccggcgccccggctccctggtctccgttgcgtgtgcgtgtcgggggccgccgcggccccgcggcgccctg

SEQ ID NO: 22058 - DNA, 671 bp, Zea mays
  misc_feature: Ceres CLONE 1391596-F
  misc_feature (460)..(460): n is a, c, t, g, unknown, or other
aagctggagctccccgcggtggcggccgctcttttccagtggatcccccgggctgcaggaattcgcacgagaccattacctagaacatcctaatcaaaaaacgtgaactcccccgacgactcagtgcgtcttcgccgccgttttcgtcgtcgcagattaaggttcccctcctctaacacgccggcgcttccccccctgccaccgcgacactcagtcgtcgccgccgtcggctctgctgccgtggccaagcgcgttggcagcgaggattgctttagcttgcaggcactttccccacccccaccgccgctgatttcgccgttatgcggtgaagcccttcgcgttgacgggctaatcggctgcctgatttctattatgatgggggtaggtgtgctcctggttcgcgtctcggaggaccctcgccgtttatcgatccagtgatgtggagctcacctttctccgnctagcgttgtgccaggggagagtgcttgttgatccctcgggagctggttgagttgtctttcgtttgtggcgaatccgggcggcaggtaagggtgctgattcggttgcaccggtgggggattatattggggacccctgctccgagaagcagacctgcccccgtccccttccctaaacaacctcctaggaccccccgcccccccgattgcgtg

SEQ ID NO: 22059 - DNA, 758 bp, Zea mays
  misc_feature: Ceres CLONE 1391597-F
  misc_feature (8)..(8): n is a, c, t, g, unknown, or other
  misc_feature (9)..(9): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
tttttttnnttnnntnnnnnttcctttccgttgccgtcggatggtttaacaagctggagctccccgcggtggcggccgctctagaactagtggatcccccgggctgcaggaattcgcacgagaccattacctagaacatcctaatcgaaaactcccagctcctcctccctgtctgctcccctccactgctgtggggctctccctctcccgtctcccctcaccttctccacctcccccattccgccaccgcacaagccgacctccctcaccaagaggagaaaagaaaggtagagcgaaggaggcaaaccaggtgggacagcaacgcgacgtgcttgctattctctccagagagatgtcaattttataataaaaccccagcatgcgtcacttggcgaattatgactttgagctcatgcaagggggaagtcttaactgcaagaaaggcagctggggatggttaacaacccatacatagccctctcttgattacccacccccggcgcggcgaaaacttggaaaaccaggtggcatctcctgggccaatagaaaggagtttcagggttggacatcccaatcacctgaggaagcggcccgtccagctgcgccggggccgatctggcagaatccatacgggagataccgccgccacatttcttctcccggtggccggcccccccccgcgggggggaagggcccacagcatctccaggagaggtgccggtgaaatcatggtcccggcgcgtcgcgaggcgggaagg

SEQ ID NO: 22060 - DNA, 655 bp, Zea mays
  misc_feature: Ceres CLONE 1391600-F
  misc_feature (191)..(191): n is a, c, t, g, unknown, or other
  misc_feature (215)..(215): n is a, c, t, g, unknown, or other
tggagctccccgcggtggcggccgctctagaactagtggatcccccgggctgcaggaattcgcacgagaccattacctagaacatcctaatcgaaaaatctgaagcaaaatgtaccgggaatgttgaagagcgggactcttaagcagtagtgagatgcggcggtggtggtcgcccggcgttggcgctgtgnagccgcgttccgtgcagctctgcntctggcgtcgctctcgtcgcagctctttctacggcggaccctcttcggtcctcgcgtccctggggtcggattgcccccttgggccccgatcgccgattccttcgggccaaaaattccggggtttccaacgggttttcggggggcggggaaaatcggggcgttccaacccggggggggggggggcttggaaaaaaaggaggccccccgggggggggtccttatagggcgtgggggtgggtctccgggggggggtttgacagttttcccccgcgcaagcggtttctttatctgcccccccgcgtggtgccgggcgggtcaggcgggccgcccgtccgtgtggccggggggtgaggggccgcctctctcgcgtgggggcgggcagagtggggaggggttcggtggggtggggcggctctcgcgccgtgcgcgtactttttcgc

SEQ ID NO: 22061 - DNA, 666 bp, Zea mays
  misc_feature: Ceres CLONE 1391602-F
  misc_feature: Encodes the peptide sequence at SEQ ID NO. 22062
  misc_feature (589)..(589): n is a, c, t, g, unknown, or other
tccccgcggtggcggccgctctagaactagtggatcccccgggctgcaggaattcgcacgagaccattacctagaacatcctaatcgaaaaaccattcgaaagatccctccaggaaagatttttcttccctcctccgacgccccagcccaccaacacactctataaagcagccccccagtcacacacagaacgcacaagcgcaagcagggcaagaaaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagcccgaaaggcgccgcggttcgtgctggttgacgcagccgcacctgttcaagccgacctacccgggnagcaggagcggatgatcgggcccgtcgttctcttcttcaacaaggggactaccacctccgctccgaaagctcgtcag

SEQ ID NO: 22062 - protein, 102 aa, Zea mays
  misc_feature: Ceres CLONE 1391602-F
  misc_feature: SWISSPROT Homolog: EC 1.14.13.93 (+)-abscisic acid 8'-hydroxylase
MAFFLALVCILVLLAIASYVQYTRWQKGKGRFGGHGRSAPLKLPPGSMGWPYLGETLQLYSQDPSVFFASKQKRYGEIFKTHLLGCPCVMLASPKGAAVRAG

SEQ ID NO: 22063 - DNA, 697 bp, Zea mays
  misc_feature: Ceres CLONE 1391606-F
  misc_feature: Encodes the peptide sequence at SEQ ID NO. 22064
tccccgcggtggcggccgctctagaactagtggatcccccgggctgcaggaattcgcacgagaccattacctagaacatcctaatcgaaaagcaatcaactctagtctctagccacaactcgaagtacgagtaactccggagtccggatggctgcagcgatggacgtcgacgaagccggcggcgaggagaggcgaccgtcagagaaggagctcttccgcgccgctgagtccggcgacgccgccgcgttcgcctccctcgcccccgccgacctctccctgcgcaacgaggacggccgctccctcctccacgtcgccgccgctgccgggcatccccaggtggtgctcgcgcttgcccagtgcggtggtgacgccgcggctagcgtgctgaatgcgcaggacgaggaggggtgggcgccgatccactccgccgcgagctccggcaactctcaaatcgtcaacatcctgcttgagcgaggtgctgatgttaacctggttactgatggtggtcgaactgctcttcattatgctgcgagtaaagggaggcttaccatagctgaaaactaatagcccatggtggctatgccaacagaaagaccagtttggctgcccacctttgcataaagctgcaagcactggaaacgcgaagctgtgtgaattcctcattgaggaagtgcttgaattgattgtgttgacaaaa

SEQ ID NO: 22064 - protein, 138 aa, Zea mays
  misc_feature: Ceres CLONE 1391606-F
  misc_feature (86)..(118): Pfam Name: Ank Pfam Description: Ankyrin repeat
  misc_feature: SWISSPROT Homolog: EC 2.7.11.1 Non-specific serine/threonine protein kinase
MAAAMDVDEAGGEERRPSEKELFRAAESGDAAAFASLAPADLSLRNEDGRSLLHVAAAAGHPQVVLALAQCGGDAAASVLNAQDEEGWAPIHSAASSGNSQIVNILLERGADVNLVTDGGRTALHYAASKGRLTIAEN

SEQ ID NO: 22065 - DNA, 710 bp, Zea mays
  misc_feature: Ceres CLONE 1391608-F
  misc_feature: Encodes the peptide sequence at SEQ ID NO. 22066
  misc_feature (437)..(437): n is a, c, t, g, unknown, or other
aagctggagctccccgcggtggcggccgctctagaactagtggatcccccgggctgcaggaattcgcacgagaccattacctagaacatcctaatcgaaaaccatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcanccgccccggcctcagcctcatccccagccacacccatgcccgtgccaacagccgcatccaagcccgtgccagctgcagggaacctgcggcgtttggcagcccccgatcctgggccagtgcgtcgagttcctgaggcatcagtgcagcccgacggcgacggcctactgctcgcctcagtgccagtcgtttgcgcagaagtgtttgcagcagttcaggcaggtgaagccgaaccacggaaccaggcaatcttcggttggtcctccagcccacctg

SEQ ID NO: 22066 - protein, 179 aa, Zea mays
  misc_feature: Ceres CLONE 1391608-F
  misc_feature (88)..(88): Xaa is any aa, unknown, or other
MRVLLVALALLALAASATSTHTSGGCGCQPPPPVHLPPPVHLPPPVHLPPPVHLPPPVHLPPPVHLPPPVHVPPPVHLPPPPCHYPTXPPRPQPHPQPHPCPCQQPHPSPCQLQGTCGVWQPPILGQCVEFLRHQCSPTATAYCSPQCQSFAQKCLQQFRQVKPNHGTRQSSVGPPAHL

SEQ ID NO: 22067 - DNA, 891 bp, Zea mays
  misc_feature: Ceres CLONE 1391609-F
  misc_feature: Encodes the peptide sequence at SEQ ID NO. 22068
  misc_feature (1)..(1): n is a, c, t, g, unknown, or other
  misc_feature (30)..(30): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
naccccccctcccccctcccaactcgactnggngnnngccgggctaattacaaactggagctccccgcggtggcggccgctctataatagtggatcccccgggctgcaggaattcgcacgagaccattacctagaacatcctaatcgaaaagtcgagtctaaccctagcgcgcgccgcccacacctgccgttgctaccgccccgtacctcgcttgctttcccgtcgccgaaatgacgaagcgcacccaagaaggctggaattgttggaaaatatggaacccaggtatggcgctagctttgcgtaagcaaatcaagaagatggagggatctcaccactccaagtacttctgcgaggtttgtgggaagtttgctgtgaagaggaaagaagtttgaattttgggaatgcaaggacttgtgggaaaggtccaaaggttggcggtggctttaccccatgaaaccttcttagtggcatccactgggccaggaccacccattccccccctttgaagaaaacgaaaatggaaagccattggatttaagctttggctaacattccaggggcctcctccctaaaaattgctgggtggctccgaaaaatggtctccaaccctcccttcctaagttgggaatccaccgaaaacttgggcttaaaaaagctggggggcgctaaaaaattttggcaaactcgggcctacccgggtgggtgaaaattttccccaagggagatatcttatcccctaatggttttggccccacaaggagtctcaaaattttgggatgggcggtattcctatgctctttttggcccgcgccacaaaggggttttaccccatttggataaacaactcccaccgccaacaaggagcggcgccctaaaacaaataaaaaagg

SEQ ID NO: 22068 - protein, 53 aa, Zea mays
  misc_feature: Ceres CLONE 1391609-F
MTKRTQEGWNCWKIWNPGMALALRKQIKKMEGSHHSKYFCEVCGKFAVKRKEV

SEQ ID NO: 22069 - DNA, 724 bp, Zea mays
  misc_feature: Ceres CLONE 1391610-F
  misc_feature: Encodes the peptide sequence at SEQ ID NO. 22070
  misc_feature (362)..(362): n is a, c, t, g, unknown, or other
  misc_feature (518)..(518): n is a, c, t, g, unknown, or other
aagctggagctcaccgcggtggcggccgctctagaactagtggatcccccgggctgcaggaattcgcacgagaccattacctagaacatcctaatcgaaaaatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcgaggcgtgccggacggcggtcggcagcatcggccgccgctccgcccgcatcgcctactgcnggctcttcgcgctctccctcttcgcatcctgggcgctccgcgaggtcgccgcgcccctcctcagtcgatcccatgaattaaacactttccacagacccccgaccgcgagtgtttcgagaacgacgcggtgctcagggtcagcctcgggaacttccntcttcttcacatccttcggcgtcatcatgggcgggaataaggaccagaaagaccccccgtgaccagatcccaccacgcggggatggatgggcaaaaatcttcttggtgggccaacaatcggcttcctccatgggtcttccgggccaaagggggccgccagctttcaattaaactaatatccaaggtttggtttcgggcgtggtccc

SEQ ID NO: 22070 - protein, 108 aa, Zea mays
  misc_feature: Ceres CLONE 1391610-F
  misc_feature (37)..(37): Xaa is any aa, unknown, or other
  misc_feature (89)..(89): Xaa is any aa, unknown, or other
MWAASCLASCCAACACEACRTAVGSIGRRSARIAYCXLFALSLFASWALREVAAPLLSRSHELNTFHRPPTASVSRTTRCSGSASGTSXFFTSFGVIMGGNKDQKDPP

SEQ ID NO: 22071 - DNA, 766 bp, Zea mays
  misc_feature: Ceres CLONE 1391611-F
  misc_feature: Encodes the peptide sequence at SEQ ID NO. 22072
  misc_feature (325)..(325): n is a, c, t, g, unknown, or other
  misc_feature (371)..(371): n is a, c, t, g, unknown, or other
  misc_feature (372)..(372): n is a, c, t, g, unknown, or other
aagctggagctccccgcggtggcggccgctctataactagtggatcccccgggctgcaggaattcgcacgagaccattacctagaacatcctaatcgaaaacgtgccacacatccatccccgttcgcctcttctcctccctcctgccgggtccttaataaagagcagcagcgcaagaggttggtagagcgagcgagaagaaggcaatggcggcggagagcttcctgttcacctcggagtccgtgaacgaggggcaccccagacagctgtgcgaccaggtgtcggacgcggtgctggacgcctgcctggcgcaggaccccgacagncagggtgcctgcgagacctgcaccaagacgaacatggtgatggtgnntcggcgagatcaccaccaaggcgagcgtggactacgagaagatcgtgcgcgacacctggccgcgagatcgggttcacctccgacgacgtggggctcgacccccaccggtgcaaggtgctggtgaacatcaagaaagagccccccgaatcggggaggggggggcccggcacttccggaaacggccccgaggaattggggcccgggaaaaagggccaattggttgggttacccccccgaagagaccccccgagttggggccgctgaaccccgggggtggcccccaaagttccggggggcgccttgggaggggtcccaaagagagcgccccctggcctgggtcttcgccccccaggagaaaacacccgggggtggggtgggtaaatataaacaaggg

SEQ ID NO: 22072 - protein, 96 aa, Zea mays
  misc_feature: Ceres CLONE 1391611-F
  misc_feature (4)..(83): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
  misc_feature (40)..(40): Xaa is any aa, unknown, or other
  misc_feature (56)..(56): Xaa is any aa, unknown, or other
MAAESFLFTSESVNEGHPRQLCDQVSDAVLDACLAQDPDXQGACETCTKTNMVMVXRRDHHQGERGLREDRARHLAARSGSPPTTWGSTPTGARCW

SEQ ID NO: 22073 - DNA, 729 bp, Zea mays
  misc_feature: Ceres CLONE 1391613-F
  misc_feature: Translation starting site: 302
  misc_feature (409)..(409): n is a, c, t, g, unknown, or other
  misc_feature (410)..(410): n is a, c, t, g, unknown, or other
  misc_feature (426)..(426): n is a, c, t, g, unknown, or other
  misc_feature (431)..(431): n is a, c, t, g, unknown, or other
  misc_feature (437)..(437): n is a, c, t, g, unknown, or other
  misc_feature (439)..(439): n is a, c, t, g, unknown, or other
  misc_feature (440)..(440): n is a, c, t, g, unknown, or other
  misc_feature (453)..(453): n is a, c, t, g, unknown, or other
  misc_feature (455)..(455): n is a, c, t, g, unknown, or other
  misc_feature (456)..(456): n is a, c, t, g, unknown, or other
  misc_feature (469)..(469): n is a, c, t, g, unknown, or other
  misc_feature (470)..(470): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
aagctggagctccccgcggtggcggccgctctagaactagtggatcccccgggctgcaggaattcgcacgagaccattacctagaacatcctaatcgaaaagcatttcacacgcgaaatttccccttttccaacgccacagcaaacagcatccacagcggagagcgtctctttctccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccgggccctggcacaccnngagctccggccccggncacantccagncnngcgctccggcccngnncacaccaagccgnncgcagcgnnngaagaaaaaggcggtggcccggtggtgaatctcaccggcgtcccgcgaaggataacgtggaggcgcggcggctggcgaacaaaccgggcaagggagggggccccaatgcacgtggcgcaggggggggccaaattcacgttggtcaactcccaagggaacgccccccaaacctgggcaaaaggacgaattttttggaaaggtaagggccaccctaaaggaaaacccctgggggataagaaatttcggggg

SEQ ID NO: 22074 - DNA, 705 bp, Zea mays
  misc_feature: Ceres CLONE 1391617-F
  misc_feature: Encodes the peptide sequence at SEQ ID NO. 22075
aaagctggactccccgcggtggcggccgctctagaactagtggatcccccgggctgcaggaattcgcacgagaccattacctagaacatcctaatcgaaaaaaccagcacacagctctcgccttctctctcccatcggcacacccgagctcgctccctccttccacgtcgaggtccgagtcctgctttgatggcgaccgacgtggctgagactcccgcgccgttggtggatgcggccccagaggcgcccgccgacgccccggcggcgcctgctgccgacgcgaagccggccaaggccaagaaggccaccgcgccgaagaagcgcgccagcccgacccacccgccgtacgccgagatggtctcggaggcgatcacgtcgctcaaggagaggacggggtccagcagctatgcgattgccaagttcgtggaggacaagcacaaggacaagctcccgcccaacttccgcaagcttctgaacgttcagctcaagaagctcgtcgccggcggcaagctgaccaaggtgaagaactcgtacaagctgtcgtccgccgcccacaagccgaatcccaagcccaaggccgcccccgaagaagcccagaccggcgctaagaagcccaagggcgctgcccagaccaaagctaagaccccggccaggggaagcccgcacaaagcccagcccgccgggagcccaaaagcgtaaggaacc

SEQ ID NO: 22075 - protein, 169 aa, Zea mays
  misc_feature: Ceres CLONE 1391617-F
  misc_feature (49)..(119): Pfam Name: Linker_histone Pfam Description: linker histone H1 and H5 family
MATDVAETPAPLVDAAPEAPADAPAAPAADAKPAKAKKATAPKKRASPTHPPYAEMVSEAITSLKERTGSSSYAIAKFVEDKHKDKLPPNFRKLLNVQLKKLVAGGKLTKVKNSYKLSSAAHKPNPKPKAAPEEAQTGAKKPKGAAQTKAKTPARGSPHKAQPAGSPKA

SEQ ID NO: 22076 - DNA, 720 bp, Zea mays
  misc_feature: Ceres CLONE 1391621-F
  misc_feature: Encodes the peptide sequence at SEQ ID NO. 22077
  misc_feature (608)..(608): n is a, c, t, g, unknown, or other
  misc_feature (609)..(609): n is a, c, t, g, unknown, or other
  misc_feature (626)..(626): n is a, c, t, g, unknown, or other
  misc_feature (628)..(628): n is a, c, t, g, unknown, or other
  misc_feature (629)..(629): n is a, c, t, g, unknown, or other
  misc_feature (687)..(687): n is a, c, t, g, unknown, or other
  misc_feature (690)..(690): n is a, c, t, g, unknown, or other
tccccgcggtggcggccgctctatatatagtggatcccccgggctgcaggaattcgcacgagaccattacctagaacatcctaatcgaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgagccggagatagccgccgagaccaaagaggtggcggctgtgnnaggctaaacgagaggangnnagagcagcgcctgctgttgctgccactcctgaggtcgcagcgacccgaggagaagcgncgnccccctgctccgaggccgccgtcgagaagc

SEQ ID NO: 22077 - protein, 129 aa, Zea mays
  misc_feature: Ceres CLONE 1391621-F
  misc_feature (128)..(128): Xaa is any aa, unknown, or other
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAETEAAAAPVEAAEPEIAAETKEVAAVXG

SEQ ID NO: 22078 - DNA, 799 bp, Zea mays
  misc_feature: Ceres CLONE 1391622-F
  misc_feature: Encodes the peptide sequence at SEQ ID NO. 22079
  misc_feature (32)..(32): n is a, c, t, g, unknown, or other
aaatttcctttcgtttattcattccgattatnttctgccctttccatagctggcactccccgcggtggcggccgctctttcctagtggatcccccgggctgcaggaattcgcacgagaccattacctagaacatcctaatcgaaaaacggccaatgcaattgcagttgcagttgcaattgcacggcacccatttccagagccgtcctcaattagctagtcaaatctcgctatcctttccccaccatccagatcttccctttcatggacgccgccgtctccaccctcaccgctctcgccatcttcgcgagcaccgtcgagcacgccgcctacaggagcgtgcaggggtatagggtggtcgggaggaaaggcggcgggtgggtccgttgggagaggtgggtggagcggcagttcgtcctctccctctccttcccacggtgcgtcgaggttgccctgcccgccgccgcgccgcggatactgccagcggggtggcgcagccggccggtgttcccgcgagggacagaccgtcgacacttggcgttgcattggggcattcgaactccgtcgccgccgtcgctccgtcctccccgccgccgaccgtgctctccccccttcgtgaacccacagctgcagtatctgtctaatctgtaccatgaacctgttgatgggggtttcggtttcgagaaaaaaaaaacggcccccacaattgtttaattcaaaagcaaacccttcccgttggggggggaaaaagggggcaaaacttcccggaatttgggggggaatgcatccggaagtcccaat

SEQ ID NO: 22079 - protein, 149 aa, Zea mays
  misc_feature: Ceres CLONE 1391622-F
MDAAVSTLTALAIFASTVEHAAYRSVQGYRVVGRKGGGWVRWERWVERQFVLSLSFPRCVEVALPAAAPRILPAGWRSRPVFPRGTDRRHLALHWGIRTPSPPSLRPPRRRPCSPPFVNPQLQYLSNLYHEPVDGGFGFEKKKTAPTIV

SEQ ID NO: 22080 - DNA, 671 bp, Zea mays
  misc_feature: Ceres CLONE 1391624-F
  misc_feature: Encodes the peptide sequence at SEQ ID NO. 22081
  misc_feature (481)..(481): n is a, c, t, g, unknown, or other
aaagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccggccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcngcagctcttccatcctgagcagctcatcagtggcaaggaggatgcagccaacaacttcgctcgtgttcactacaccattggcaaggagatttgtgacctgtgccttgaccgcatcaggaagcttgcagatattgcactggtctccagggcttctcgtctcaacgctgttggtggaagacgggctctgggc

SEQ ID NO: 22081 - protein, 147 aa, Zea mays
  misc_feature: Ceres CLONE 1391624-F
  misc_feature (49)..(147): Pfam Name: Tubulin Pfam Description: Tubulin/FtsZ family, GTPase domain
  misc_feature (84)..(84): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYXQLFHPEQLISGKEDAANNFARVHYTIGKEICDLCLDRIRKLADIALVSRASRLNAVGGRRALG

SEQ ID NO: 22082 - DNA, 725 bp, Zea mays
  misc_feature: Ceres CLONE 1391625-F
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (387)..(387): n is a, c, t, g, unknown, or other
  misc_feature (443)..(443): n is a, c, t, g, unknown, or other
gctctagaactagtggatcccccgggctgcaggaattcgcacgagaccattacctagaacatcctaatcgaaaacccaagcgcccaaggcagcggagagagctagctccctcctcctcctcaggtagcgagcgagcgagctcctctgcccctctgcacacctggcctccccttctccgctgcaggaccgccgttgacgactgctccaccagtactgcgcgcgcccgcgctgcctacccttacctagccagagcgcggcgcgcgagagggagaacgaccaggaggggaggagatcgatcgatcgatcgagatagatggctttcctcaacatggagcagcagacctgggccttcaccttcgnnntatctagtcatatctctgcaatggntgactacccaatccagattagcaccaagctcattgaccagcttgctcgtgatgacnagaagtaaaacggaaaagcaggaaggccaagcctaaaaagaggcccacgtccagccacattgaaagcccttggattccccaaaaaacaaaaaaaacaagcctggtaatgctcccggggggccctttgaaccccccctatgtttttgggggggaacctttccccccccacccccgggaaaaaggggggggggggaaaaccctttcttctcccctgaaaaaaaaaggggggttcttccaaaaaatggggaaaaacaaaaaagggggggccccccaaaattcata

SEQ ID NO: 22083 - DNA, 734 bp, Zea mays
  misc_feature: Ceres CLONE 1391627-F
  misc_feature: Translation starting site: 467
  misc_feature: SWISSPROT Homolog: EC 1.11.1.7 Peroxidase
  misc_feature (414)..(414): n is a, c, t, g, unknown, or other
  misc_feature (589)..(589): n is a, c, t, g, unknown, or other
  misc_feature (666)..(666): n is a, c, t, g, unknown, or other
aagctggagctccccgcggtggcggccgctctataactagtggatcccccgggctgcaggaattcgcacgagaccattacctagaacatcctaatcgaaaatcgcgccagagccacgcacgctagtgtcagtggcacgcaggcagccgcgcgcaccgaggggagaccagagctagcggcgaggccaagggcaagggcaagggcgcggacggcaatggcgagagctggaggcggcggtccgttcttcccggtccgcggcgcggcgctggtggtcgtgctgctaggcatcgtcgcgggcgcggcgagggcgcagctgcggctgaactactacggcagctcgtgccccagcgcggagtccacggtgcgctccgtcatctcgcagcgcctccagcagagcttcgccgtggggcccggnacgctccgcctcttcttcacgactgcttcgtcagggatgcgacgcgtcggtgatgctgatggcgccgaacggggacgacgagagccacagcggcgcggacgccacgctgtcgccggacgccgtggacgcatcaacaagcgaggcgggccggggaggcgctcccgggtgccgcggnaaggtctcctggcgcgacatcctcgccatggccgaacgggacgccgtctcccttgctggggggcccaaacctacggngggggaacttgggccggttggaacccaaaaactttcaaagggggccttcggggaggcccatcctcccg

SEQ ID NO: 22084 - DNA, 731 bp, Zea mays
  misc_feature: Ceres CLONE 1391632-F
  misc_feature: Encodes the peptide sequence at SEQ ID NO. 22085
  misc_feature (608)..(608): n is a, c, t, g, unknown, or other
aaagtggagctccccgcggtggcggccgctctagtaatagtggatcccccgggctgcaggaattcgcacgagaccattacctagaacatcctaatcgaaaaatctccagcagcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatggagaggaggatcatattgaaggcttttggtgctgaacttgtccttactgacccactcctgggaaatgaaggagctgtcaagaaagcgnaaagagatacagcaaagacacccaactcttacatcctttcacaatttgaaaatccagctaaccccaaagatcactatgagactactgggcctgaaatctggaaagctacagcaggaaaaatga

SEQ ID NO: 22085 - protein, 176 aa, Zea mays
  misc_feature: Ceres CLONE 1391632-F
  misc_feature (12)..(176): Pfam Name: PALP Pfam Description: Pyridoxal-phosphate dependent enzyme
  misc_feature: SWISSPROT Homolog: EC 2.5.1.47 Cysteine synthase
  misc_feature (136)..(136): Xaa is any aa, unknown, or other
MGEASPSIAKDVTELIGNTPLVYLNKVTEGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGNEGAVKKAXRDTAKTPNSYILSQFENPANPKDHYETTGPEIWKATAGKM

SEQ ID NO: 22086 - DNA, 737 bp, Zea mays
  misc_feature: Ceres CLONE 1391633-F
  misc_feature: Encodes the peptide sequence at SEQ ID NO. 22087
  misc_feature (638)..(638): n is a, c, t, g, unknown, or other
  misc_feature (639)..(639): n is a, c, t, g, unknown, or other
  misc_feature (690)..(690): n is a, c, t, g, unknown, or other
aagctggagctccccgcggtggcggccgctctatactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtnnctcacgctgttggtggaggaacgggctctgggcttggtctctccctctggnagcgctgtctgttgactatggcaagaagtcccagctcggtttcacgt

SEQ ID NO: 22087 - protein, 170 aa, Zea mays
  misc_feature: Ceres CLONE 1391633-F
  misc_feature (49)..(169): Pfam Name: Tubulin Pfam Description: Tubulin/FtsZ family, GTPase domain
  misc_feature (138)..(138): Xaa is any aa, unknown, or other
  misc_feature (155)..(155): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVXHAVGGGTGSGLGLSLWXRCLLTMARSPSSVSR

SEQ ID NO: 22088 - DNA, 742 bp, Zea mays
  misc_feature: Ceres CLONE 1391638-F
  misc_feature: Encodes the peptide sequence at SEQ ID NO. 22089
  misc_feature (490)..(490): n is a, c, t, g, unknown, or other
  misc_feature (491)..(491): n is a, c, t, g, unknown, or other
  misc_feature (509)..(509): n is a, c, t, g, unknown, or other
aaagctggagctccccgcggtggcggccgctctataactagtggatcccccgggctgcaggattcgcacgagaccattacctagaacatcctaatcgaaaaacacgatctctcctcgacggctaacccggattgccgtctcaagctcgggatccgggcgctcgcggcgatggacggcggcggcggcgctggcggcgcggagggggagctcacggcgcaggagacagcgctctacgaccgccagatccgcgtctggggcgtcgatgcccagaagagactaagtaaggcgcacgtgcttgtttgtggcatgaacggaaccaccatcgagttctgcaagaatattgttctagctggagttggaagtttatccttgatggatgataatgtagtcacagaggaggatctgaatgcaaatttcttaattcctcctgatgagagcatatatggtggtagatctcgagcccaagtttgctgcgagtctttgatagatnntcatcctatggttagagnttctggtgaaaagggtgatccatcattaattggatggagaattccttgaccagttcgacatttggtgtacttagcccgtgcatcctcttaaaacaaagttgttgattaatgaaaactgcccaaagagaaacaaacatattgcattttatactatagattgcaaggatccatgggggagaaaaattggtttgatttaacgaaacctaagctatggtcagaaaaagcctggaggg

SEQ ID NO: 22089 - protein, 129 aa, Zea mays
  misc_feature: Ceres CLONE 1391638-F
  misc_feature (108)..(108): Xaa is any aa, unknown, or other
  misc_feature (114)..(114): Xaa is any aa, unknown, or other
MDGGGGAGGAEGELTAQETALYDRQIRVWGVDAQKRLSKAHVLVCGMNGTTIEFCKNIVLAGVGSLSLMDDNVVTEEDLNANFLIPPDESIYGGRSRAQVCCESLIDXHPMVRXSGEKGDPSLIGWRIP

SEQ ID NO: 22090 - DNA, 739 bp, Zea mays
  misc_feature: Ceres CLONE 1391639-F
  misc_feature: Encodes the peptide sequence at SEQ ID NO. 22091
  misc_feature (462)..(462): n is a, c, t, g, unknown, or other
  misc_feature (501)..(501): n is a, c, t, g, unknown, or other
  misc_feature (516)..(516): n is a, c, t, g, unknown, or other
  misc_feature (540)..(540): n is a, c, t, g, unknown, or other
  misc_feature (541)..(541): n is a, c, t, g, unknown, or other
  misc_feature (572)..(572): n is a, c, t, g, unknown, or other
  misc_feature (573)..(573): n is a, c, t, g, unknown, or other
  misc_feature (630)..(630): n is a, c, t, g, unknown, or other
  misc_feature (724)..(724): n is a, c, t, g, unknown, or other
aagctggagctccccgcggtggcggccgctctataactagtggatcccccgggctgcaggaattcgcacgagaccattacctagaacatcctaatcgaaaagagaggaagggaggaggtgagccaccggaagcggagacgtgagcactggaccaaccccgtcgatccggctgcggcgcggcgtgctagatcgctaccgaccatggtggtggaggagatcgccgagggggtgaagaacctaaccgtcgccggagatgcggcggcttcaggcggagaggggcagaggaggggcggcggcggcagcagcaaccgcatccaggtgtccaacaccaagaaacccctcttcttctacgtcaacctcgccaagaggtatatgcaacagcacggcgatgtagagctatccgctcttgggatggccatagcaacagttgtgaccgtggcagaaattctgaagaaacatggnatttgctgtgaaaagaaaataggacctctactggtgaantaaacgacgaatcangagggcgtccattccaaaaggccnnagattgagatatcttgggaaagagcgacaannttgatgagctgatggccgctgctgcaaaagagaggggcgaagtggaagaatgtgaanagcaggcttgaaaacagtacgatgacaagctgctgctgctgggctcggtaaagggtgtttatttaagttaataaccgggggcatgaaaaatggnacgcggttcttgctc

SEQ ID NO: 22091 - protein, 99 aa, Zea mays
  misc_feature: Ceres CLONE 1391639-F
  misc_feature (34)..(101): Pfam Name: Alba Pfam Description: Alba
MVVEEIAEGVKNLTVAGDAAASGGEGQRRGGGGSSNRIQVSNTKKPLFFYVNLAKRYMQQHGDVELSALGMAIATVVTVAEILKKHGICCEKKIGPLLV

SEQ ID NO: 22092 - DNA, 784 bp, Zea mays
  misc_feature: Ceres CLONE 1391642-F
  misc_feature: Encodes the peptide sequence at SEQ ID NO. 22093
  misc_feature (285)..(285): n is a, c, t, g, unknown, or other
aaactggagctccccgcggtggcggccgctctagaactagtggatcccccgggctgcaggaattcgcacgagaccattacctagaacatcctaatcgaaaaaacagcagcagaagcaaaagccgcaggccgcaactactccgatctgagtatcacagtcacagctaatagctagccagcagcccagcacccagcaactacccgtacgtacgaacgtgcgcttccgatggcgaccacggtgatgggctccgcgaccgcgagctcccccgccttctccgcccccggngcgcgcgccaggcgcgccgcccggcttccgggggggttccgcggccgtgtcgccgggccgccgggccgcctcgggttgttcgccagggccttccaaaaggccgatgacccttgccgccgacacaaaggcggaggcgggccccggttgtccggaaaattggggttcgggaacagcgtgggggttcagggggccccccgccccgggaagggaaaaaacggccggctggggaaattgggggttttctgggccccgcctctcgccgccaaaggccccccgcggggggaggggatccccctctccggaggggggaaaaggggcccccgccccgggggggttcgcaaaaacccccccttttttttttccccgcggcctccgggggggctcttctcccccgggaaaaccgcccccgggagaaagggcctcctctttttatgccccgccccccccctttttttgagaagggcccccctccgtggggtggccccccccgggccccacc

SEQ ID NO: 22093 - protein, 186 aa, Zea mays
  misc_feature: Ceres CLONE 1391642-F
MATTVMGSATASSPAFSAPGARARRAARLPGGFRGRVAGPPGRLGLFARAFQKADDPCRRHKGGGGPRLSGKLGFGNSVGVQGAPRPGKGKNGRLGKLGVFWAPPLAAKGPPRGEGIPLSGGGKRGPRPGGVRKNPPFFFSPRPPGGLFSPGKTAPGRKGLLFLCPAPPLFLRRAPLRGVAPPGPH

SEQ ID NO: 22094 - DNA, 718 bp, Zea mays
  misc_feature: Ceres CLONE 1391647-F
  misc_feature: Encodes the peptide sequence at SEQ ID NO. 22095
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaaacttctacctggcctcgcaggcttcgcaaggcggccacacgccgatacctcctccttcacccgctccgtcgtcccccccagccggccacgccaccatgctgccaccggccgcgcgccttgcggcccgccgcctcctcggcctcgcctccgcatctgcgtcggaagccgccggccgccgggtagcttcctctccgatcgcttccgcaggctactccgccgccgcgtccaggggctccgtctccagcaccaggcccttctccacggctcttaactaccaccttgactcgccggagaacaagccggacatgaaatgggagttctcacaggcgaatatgaagaaggtcaatgagattctgtctcactatccaagcaactacaagcaatctggtattattccgctgcttgatcttgcacagcagcagcatggtggatgggtgccagttgcagcaatggatgctattgctaaaattgtcgaaagtgcaccaatcagggtctatgaagttgcaaccttctatacaatgtttaacaggactaagggtggtaaatacacccntttggtgtgtggaactacaccttgtatgatccgtggtcacgtgaaatcgagagaccgtgttga

SEQ ID NO: 22095 - protein, 103 aa, Zea mays
  misc_feature: Ceres CLONE 1391647-F
  misc_feature (3)..(102): Pfam Name: Complex1_24kDa Pfam Description: Respiratory-chain NADH dehydrogenase 24 Kd subunit
  misc_feature: SWISSPROT Homolog: EC 1.6.99.5 NADH dehydrogenase (quinone)
  misc_feature (83)..(83): Xaa is any aa, unknown, or other
MKWEFSQANMKKVNEILSHYPSNYKQSGIIPLLDLAQQQHGGWVPVAAMDAIAKIVESAPIRVYEVATFYTMFNRTKGGKYTXLVCGTTPCMIRGHVKSRDRV

SEQ ID NO: 22096 - DNA, 756 bp, Zea mays
  misc_feature: Ceres CLONE 1391650-F
  misc_feature: Encodes the peptide sequence at SEQ ID NO. 22097
  misc_feature (756)..(756): n is a, c, t, g, unknown, or other
aagctggagctccccgcggtggcggccgctctagaactagtggatcccccgggctgcaggaattcgcacgagaccattacctagaacatcctaatcgaaaaattcgctcctcccgcccgccgccgtcgccgcctcctctccccagcacccggagctcgcccgaccgccgctcaccatgatcatccccaagaagaaccgcaatgagatctgcaagtacctcttcaaggagggcgtgctgtatgccaagaaggactacaacctggcgaagcacccgcagatcgatgtgcccaacctcccagtgatcaagctcatgcagagctttaagtccaaggagtatgttagggagaccttctcctggcagtactactactggaatctcaccaacgatggcattgagcacctacgcaactacctggaactccccgtctgagatcgtgccttgccacgctcaaaaagtctgccaagccccctggccgcccattttggttctggccctccgggagacccgccaaggggcccaaggtccttttttacggcaacggccaaaggtttgtgaaaagggaatgggaacgcggggggccccccgcgggcccccccggggactttttgggggaaaaaaaaggggccccccggggtttcccccccctcttattaaggggccttttttttggggtgggggagggaaaaggttttttgggaaaacacccccccctcttttttcaagagaagaagaacccccctctggtgtaaaaaagn

SEQ ID NO: 22097 - protein, 84 aa, Zea mays
  misc_feature: Ceres CLONE 1391650-F
  misc_feature (3)..(84): Pfam Name: S10_plectin Pfam Description: Plectin/S10 domain
MIIPKKNRNEICKYLFKEGVLYAKKDYNLAKHPQIDVPNLPVIKLMQSFKSKEYVRETFSWQYYYWNLTNDGIEHLRNYLELPV

SEQ ID NO: 22098 - DNA, 731 bp, Zea mays
  misc_feature: Ceres CLONE 1391656-F
  misc_feature: Encodes the peptide sequence at SEQ ID NO. 22099
  misc_feature (523)..(523): n is a, c, t, g, unknown, or other
  misc_feature (544)..(544): n is a, c, t, g, unknown, or other
  misc_feature (558)..(558): n is a, c, t, g, unknown, or other
  misc_feature (574)..(574): n is a, c, t, g, unknown, or other
  misc_feature (666)..(666): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
aaagctggagctccccgcggtggcggccgctctagaactagtggatcccccgggctgcaggaattcgcacgagaccattacctagaacatcctaatcgaaaactcccggtccttctggacgcgacagcacaccacctctacgaagcatctcgaactctcggtgccgctcaatttgtacccccaatccccttccacacaccgcctcgccacatcgcagagccagagcaagggaagacgacgcagatctcgccacgcgaacacagttagatcgagggagtaagtgagagtgagagccatgacggagctgttcgacacggccgtgaccagcctcctccacctgccggaggtgctggaccgcctcgccgccgcagacggcgaccggcggtcggccggccaccacgcggcgcacggccacggccacggccacggccacggacgcgtccacgggctcggcggcggcggagcgccggtggacatcgtggagagcccccgcgagtacgccttcgtgctcgacgtgcccggnctctccaagtcagacatccangtgacgctggaggnaggaccgggtggctgntgatgaagggcggcagcgggaagcggaagcgcgatggagggagaggacatgaacgggcgaagggtgccgatacatcccggttggagcgcggncngnnnnccccggttcgtttcgtgcgcaagttccggtttgccggaggatgccgacaaggggcggg

SEQ ID NO: 22099 - protein, 92 aa, Zea mays
  misc_feature: Ceres CLONE 1391656-F
  misc_feature (83)..(83): Xaa is any aa, unknown, or other
  misc_feature (88)..(88): Xaa is any aa, unknown, or other
MTELFDTAVTSLLHLPEVLDRLAAADGDRRSAGHHAAHGHGHGHGHGRVHGLGGGGAPVDIVESPREYAFVLDVPGLSKSDIXVTLEXGPGG

SEQ ID NO: 22100 - DNA, 713 bp, Zea mays
  misc_feature: Ceres CLONE 1391657-F
  misc_feature: Encodes the peptide sequence at SEQ ID NO. 22101
  misc_feature (563)..(563): n is a, c, t, g, unknown, or other
aagctggagctccccgcggtggcggccgctctagaactagtggatcccccgggctgcaggaattcgctcgagaccattacctagaacatcctaatcgaaaaagctgcggcgccaccctcggcctcgggccgtccgccgtcggcggccacgaccctggtgtaatctgctccatacgtggcggcgcctgcaaaagccacgctgctgccagtgccagccatggatgcagtggcggccagcgacgccgtactcctccttgctaccgtagctatctccctgctcatcactgccactttctggagcaggcatcgtcgtcagggcgaagcgccgagcccgccgtcgctaccgctgctgggccacctccacctgctcggcaacggcaagccgctgcaccacacgctggcggcgctggccatcgcgcgcggggcaccgggggcgccccggcgccgctcctgtcgctgcgccctgggcgcgcggcgcgcgctgctgttgtcgtaacacgccgcggccgaggagtgcttcacggcgcacgacgccgcgctgggcggccggccgcggttgctggntcgggacaggctcaactacggtaccacacggggggctggtcctcgcacggcgaccactggcgcgccctccgcggttcatggccggggagctggtcgccgcgtccgcctcgccgggggggccgcagacggaatggcgaagtccccggcttg

SEQ ID NO: 22101 - protein, 92 aa, Zea mays
  misc_feature: Ceres CLONE 1391657-F
MDAVAASDAVLLLATVAISLLITATFWSRHRRQGEAPSPPSLPLLGHLHLLGNGKPLHHTLAALAIARGAPGAPRRRSCRCALGARRALLLS

SEQ ID NO: 22102 - DNA, 749 bp, Zea mays
  misc_feature: Ceres CLONE 1391658-F
  misc_feature: Encodes the peptide sequence at SEQ ID NO. 22103
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (635)..(635): n is a, c, t, g, unknown, or other
  misc_feature (710)..(710): n is a, c, t, g, unknown, or other
aaagctggagctccccgcggtggcggccgctctagaactagtggatcccccgggctgcaggaattcgcacgagaccattacctagaacatcctaatcaaaaaaaaaacaaatctgtgcaaattctctccctctctctctctctttctatctggaattctggatgcagtctgcaaggatgacacaagaacaagaacaacgccatcaatcaatcaatcaacacacacgagacctactgtatatagagcagagaagggggatactaatttgtcagtaaaactaaaacaaggaagcacttattttgtgcttgtttagttgcgatcaattagcccgccgccgcgccgccgcctcctcctcctatattagcccacttcccttccttcctttgcagcagcaagaactaaggcttgtccctttccctctcctctcctcccctcccctccgtctccactcccatcttctctcctggaagccgcctcggtcggacccggacaagatggccgccttcttcggtgctgcaccgccgccggctctcgcttcgtcccgccacgaggaggaggagcagcagcatcaggacgccgccgaggaggtgtaccacgtggacgatgtcacnnnaggcagcggtgacggccgtggncacggcggcgccgcaaaggggaagcttgtgcgcagggggcactggcgcccccgccgaggacgcaagctcaagagnttcgtccccgcagttcgggcccccagaactgaacctcat

SEQ ID NO: 22103 - protein, 85 aa, Zea mays
  misc_feature: Ceres CLONE 1391658-F
  misc_feature (40)..(40): Xaa is any aa, unknown, or other
  misc_feature (72)..(72): Xaa is any aa, unknown, or other
MAAFFGAAPPPALASSRHEEEEQQHQDAAEEVYHVDDVTXGSGDGRGHGGAAKGKLVRRGHWRPRRGRKLKXFVPAVRAPRTEPH

SEQ ID NO: 22104 - DNA, 706 bp, Zea mays
  misc_feature: Ceres CLONE 1391660-F
  misc_feature: Translation starting site: 298
  misc_feature: SWISSPROT Homolog: EC 2.7.1.90 Diphosphate--fructose-6-phosphate 1-phosphotransferase
  misc_feature (349)..(349): n is a, c, t, g, unknown, or other
  misc_feature (405)..(405): n is a, c, t, g, unknown, or other
  misc_feature (485)..(485): n is a, c, t, g, unknown, or other
  misc_feature (504)..(504): n is a, c, t, g, unknown, or other
  misc_feature (526)..(526): n is a, c, t, g, unknown, or other
  misc_feature (655)..(655): n is a, c, t, g, unknown, or other
tggagctccccgcggtggcggccgctctagaactagtggatcccccgggctgcaggaattcgcacgagaccattacctagaacatcctaatcgaaaaaatcgaaaccaacagtgaatcagccggcgccgcagcatgcctgtacctctcggctctcgctcttatccccacccacctcgctttctcccctctacaagaaagcgaccaccgctgtgaatcagcagagctgcagtgagagcaagtgagaggatcagaggaggcatccgtgaccaaagatcgagtagccaagaagaagagagatgaacgccgacttcggcgcgcccaaggagctcgcgggaggcctgcagcagncggcggccctgtaccagccccgccctccgcatgggctcagggaccgacggtagggncggagtaacgtgacgcgacccacaacatcgatcccacctgtgccccagccgtcgcgcaggccttcccgcacacctttggncagccgctcgtcagcttcntcgcgccggccgccggcgccgncgcggttgaggagcgcacccgatcagggtgggggtgtggtctcctggaggcagtcgccgggagggcacaacgcgtctggggcctcctgacgcactaaagcctacatcctcgaggtggctcctacgatcntccggggcaccgaggaactgtttgcaacaagaccgtggagatcacggacgt

SEQ ID NO: 22105 - DNA, 726 bp, Zea mays
  misc_feature: Ceres CLONE 1391661-F
  misc_feature (327)..(327): n is a, c, t, g, unknown, or other
  misc_feature (403)..(403): n is a, c, t, g, unknown, or other
  misc_feature (543)..(543): n is a, c, t, g, unknown, or other
agagctggagctccccgcggtggcggccgctctagaactagtggatcccccgggctgcaggaattcgcacgagaccattacctagaacatcctaatcgaaaactcgaagaggaaaaaggaaaaaaagaaaacagggagagcccaagcctgagacgaacacgaagaagcaaggagcgaagcagacacgagcgagcccatcccaagttcccaacccacacgaagctgcagcagcaggcagccgcctcgccacgcgcccgagcaacgccgccgagagagccgcccgcccgcccgcccgccggtgagcagcgagggcaattcgtcttcggntggtccccgtcccgctcccgcccgccaaccccaattgctcccctctcggaggtcagctcaattcctgctgtttctncgattcgattcggttgcaccgggcgcgtcgtctccctcgcccgagatccagcaggtacgagctcgcctggggccgaggatcatgcccccatggctctaggggttggggtgggtaatcaattggctcggcagggccggcgnctctatgcttgattcggggctgccgcgccgctccctgggatctcggcggcggtgggtgcgcgccagcggtgatgaaatcccctccatgggcggggagtggggatttggggtacgggctccctctctgcaggagcggggcaggcccttatggtttgatcctagctggggggggggggctatcca

SEQ ID NO: 22106 - DNA, 708 bp, Zea mays
  misc_feature: Ceres CLONE 1391665-F
  misc_feature: Encodes the peptide sequence at SEQ ID NO. 22107
  misc_feature (409)..(409): n is a, c, t, g, unknown, or other
  misc_feature (411)..(411): n is a, c, t, g, unknown, or other
  misc_feature (412)..(412): n is a, c, t, g, unknown, or other
  misc_feature (451)..(451): n is a, c, t, g, unknown, or other
  misc_feature (453)..(453): n is a, c, t, g, unknown, or other
  misc_feature (454)..(454): n is a, c, t, g, unknown, or other
  misc_feature (463)..(463): n is a, c, t, g, unknown, or other
aaagctggagctccccgcggtggcggccgctctagaactagtggatcccccgggctgcaggaattcgcacgagaccattacctagaacatcctaatcgaaaaacgccctccgtgccgtgcccactcctctccccgcagcttcgggcccctgccatgccgtcctcgtcgtcgctgatccatggcatctccatctccgtctccgacgacgacgaggccaccggcaaggtgcgcgtccgcgtccgccgcaagcgctcccgcggccccgcatccgcttcggcgcgccgccgccgcatcctcttccgcgccgcgcggctgggcgtgccgctcctcctcgccgccctcgccgtgtgcctcctcctctacgagtcctaccgcctcacgccttcccgctccctcacactggcctcgncnngtcttcgcggacatcagccgcctctcccgcaacgcccgngnncgcgatggngccagaagtcatggctgaagtttcttgatcctgagagcttcaaattttgaacttccagaatcctgaacaatttgtcgatgagggaagtctgaaagaatcagtctgcccatatcgtcatggatccccacccctacgggaattcccgggtcaattggtccaggaatacaaaccctcctgacgaaaaaagctccaggtaaattttgggttttaccttcggggggtttggaaaccccccaaaggtcaat

SEQ ID NO: 22107 - protein, 119 aa, Zea mays
  misc_feature: Ceres CLONE 1391665-F
  misc_feature (86)..(86): Xaa is any aa, unknown, or other
  misc_feature (87)..(87): Xaa is any aa, unknown, or other
  misc_feature (100)..(100): Xaa is any aa, unknown, or other
  misc_feature (101)..(101): Xaa is any aa, unknown, or other
  misc_feature (104)..(104): Xaa is any aa, unknown, or other
MPSSSSLIHGISISVSDDDEATGKVRVRVRRKRSRGPASASARRRRILFRAARLGVPLLLAALAVCLLLYESYRLTPSRSLTLASXXLRGHQPPLPQRPXXRWXQKSWLKFLDPESFKF

SEQ ID NO: 22108 - DNA, 717 bp, Zea mays
  misc_feature: Ceres CLONE 1391667-F
  misc_feature: Encodes the peptide sequence at SEQ ID NO. 22109
  misc_feature (576)..(576): n is a, c, t, g, unknown, or other
  misc_feature (579)..(579): n is a, c, t, g, unknown, or other
  misc_feature (613)..(613): n is a, c, t, g, unknown, or other
  misc_feature (624)..(624): n is a, c, t, g, unknown, or other
  misc_feature (686)..(686): n is a, c, t, g, unknown, or other
aaagctggagctccccgcggtggcggccgctctagaactagtggatcccccgggctgcaggaattcgcacgagaccattacctagaacatcctaatcgaaaaatccgttccccttcccttccctcctctcgcgcgccggctccacgcagatccaggagatatgcctcgctatgatgaccgctatggaggcacgcgcttgtatgttggcagattggccactcgtactcgttcccgcgatttagaacatctgtttggcagatatggaagatggtaaacaatgattgttctgaactggtggaggtgcaaaccatctgatatataggagagcctagtaagctaaggggcccttgctacccttcttatagccattttagcaggtactgggttcagtggtactattgagtcttatcaagttacttgtggttgagcctctctccaaaacattgtctttgggagtttctgttacttaaataatgtagaaagtttcccccctcagaaattgtgtgtttgacttggatgatcttgttgaaggtttttcggtttttaccggagtcttttggtggaaggtgcctttgntgnacttggtgaccatttggtgaaggtggcctttgtngaatgttattngactgttttagggaagttccaagttgtgaaggcatttgagactggacacatgacgggacggntttacggtttgtggcaccctttgcgaaaaaa

SEQ ID NO: 22109 - protein, 37 aa, Zea mays
  misc_feature: Ceres CLONE 1391667-F
MPRYDDRYGGTRLYVGRLATRTRSRDLEHLFGRYGRW

SEQ ID NO: 22110 - DNA, 707 bp, Zea mays
  misc_feature: Ceres CLONE 1391668-F
  misc_feature: Encodes the peptide sequence at SEQ ID NO. 22111
  misc_feature (196)..(196): n is a, c, t, g, unknown, or other
  misc_feature (251)..(251): n is a, c, t, g, unknown, or other
  misc_feature (289)..(289): n is a, c, t, g, unknown, or other
  misc_feature (306)..(306): n is a, c, t, g, unknown, or other
  misc_feature (314)..(314): n is a, c, t, g, unknown, or other
  misc_feature (337)..(337): n is a, c, t, g, unknown, or other
  misc_feature (344)..(344): n is a, c, t, g, unknown, or other
  misc_feature (348)..(348): n is a, c, t, g, unknown, or other
  misc_feature (351)..(351): n is a, c, t, g, unknown, or other
  misc_feature (382)..(382): n is a, c, t, g, unknown, or other
  misc_feature (419)..(419): n is a, c, t, g, unknown, or other
  misc_feature (421)..(421): n is a, c, t, g, unknown, or other
  misc_feature (455)..(455): n is a, c, t, g, unknown, or other
  misc_feature (459)..(459): n is a, c, t, g, unknown, or other
  misc_feature (472)..(472): n is a, c, t, g, unknown, or other
  misc_feature (473)..(473): n is a, c, t, g, unknown, or other
  misc_feature (524)..(524): n is a, c, t, g, unknown, or other
  misc_feature (525)..(525): n is a, c, t, g, unknown, or other
  misc_feature (593)..(593): n is a, c, t, g, unknown, or other
aaagctggagctccccgcggtggcggccgctctagaatagtggatcccccgggctgcaggaattcgcacgagaccattacctagaacatcctaaccaaaaaaacgagaaggaagccaccgctccccaatcgcctgcttgccttcccatcctcctcgtagatctccggcaccgggcaccatgagctcctactccggngaccgctcctcctcctcctccttgcgccccaccaacacctccttcgactcctacnagttcgacttcggcatcaactcctcccgctcctccggntctcgccccctccgcgnacagcggncgggcgcggctaccaaccctccnacgaggnccgnccnacggcgcacgtggatgcaccagcccgcagcngccaagcgtcgtggacccaccagcttccccccgcgcngngtcggcgcccaccatgggcggggctggatccggncaancctcatgggtcgnngacatctttggccggagctgttcctccggcgcgccctcctttggggtcggnnatcctagggcaaaaaccccggctctttcaggatttctcgggtccggggtcggtcttccggtccaatcnagggggcgtttaaaaccgccgccggccaaaggatccaggcagcgcggggaaaacccaatggcaagctagagtttcccttctgaggggggggatggcgggcgcgtccgaaaatag

SEQ ID NO: 22111 - protein, 75 aa, Zea mays
  misc_feature: Ceres CLONE 1391668-F
  misc_feature (9)..(9): Xaa is any aa, unknown, or other
  misc_feature (13)..(13): Xaa is any aa, unknown, or other
  misc_feature (31)..(31): Xaa is any aa, unknown, or other
MGGAGSGQXSWVXDIFGRSCSSGAPSFGVGXPRAKTPALSGFLGSGVGLPVQSRGRLKPPPAKGSRQRGENPMAS

SEQ ID NO: 22112 - DNA, 736 bp, Zea mays
  misc_feature: Ceres CLONE 1391669-F
  misc_feature: Encodes the peptide sequence at SEQ ID NO. 22113
  misc_feature (522)..(522): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (605)..(605): n is a, c, t, g, unknown, or other
  misc_feature (642)..(642): n is a, c, t, g, unknown, or other
aaagctggagctccccgcggtggcggccgctctagaactagtggatcccccgggctgcaggaattcgcacgagaccattacctagaacatcctaatcaaaaaattcgtcgctaatcacaatcccgatctccaagcaaacccacctcccgtcagttccctactcgccgatccagatctcctacagctttccactccgccactccaaccggacgcctccgccgtcgccggcggcggtcgagccacgcgcgcacgccgctgaggaacccggagagggcggcggcaatggagcagctgcggacgttcgggcgggagctggcgatggggtcgcagggcgggtgggggcagtccaaggatttcctcgacctcgtcaagtctatcggcgaggcgcgctccaaggcggaggaggaccgcatcatcgcgcgcgagcttgagcacctcaagcgccgcctggccgaccccgacgtgccacgccgcaagatgaaggagcttctcctccgcctagtctacgccgagatgctcggncacgacgcttccttcggccacatccacgccgtcaagatgacccacgacgagtcgctaccgctcaagcgtacggnnntactcgncgtcgcactcttcctcgacgagcgccacgactcgtcnatcctcgtggtcacaccatccagaaggacctcaggtcggacaactacctcgtcgtctgcgagcacttcacgcgcgtgccggccttaattggtga

SEQ ID NO: 22113 - protein, 148 aa, Zea mays
  misc_feature: Ceres CLONE 1391669-F
  misc_feature (105)..(105): Xaa is any aa, unknown, or other
  misc_feature (106)..(106): Xaa is any aa, unknown, or other
  misc_feature (108)..(108): Xaa is any aa, unknown, or other
MEQLRTFGRELAMGSQGGWGQSKDFLDLVKSIGEARSKAEEDRIIARELEHLKRRLADPDVPRRKMKELLLRLVYAEMLGHDASFGHIHAVKMTHDESLPLKRTXXLXVALFLDERHDSSILVVTPSRRTSGRTTTSSSASTSRACRP

SEQ ID NO: 22114 - DNA, 732 bp, Zea mays
  misc_feature: Ceres CLONE 1391670-F
  misc_feature: Encodes the peptide sequence at SEQ ID NO. 22115
  misc_feature (545)..(545): n is a, c, t, g, unknown, or other
  misc_feature (550)..(550): n is a, c, t, g, unknown, or other
  misc_feature (551)..(551): n is a, c, t, g, unknown, or other
aagctggagctccccgcggtggcggccgctctagaactagtggatcccccgggctgcaggaattcgcacgagaccattacctagaacatcctaatcgaaaaacgcgcgcaccgtccctcaccgccggcctctgctcctcttccgccgccgcaggatctcgtatcgccggagaccatgtaccgcgccgccgggagccacctccgctcccttaagcatcatggtgcttctaggcttgccagtacaagtgttgcgaagcagtcctcaggtggtctgttcagctggcttcttggtggaaatcaagcgaactccctccccttgatgttccactcccaggcattagcattccctcacctctaccagattttgtagaagagcctctaagacaaaagtcactactcttcccaatggggttcaagatcgcctcccgagacatcatcaagccccagagaatctgggggggctgaacattggactgggggtccatttaacaaacacccggctctcctctggaggaaaccacctctgtttggaaaaaagggctcgtnaaagnnccggggatcggactccctttacggtaaattccggggggaaaaagcccttggaaggaaatggtctggaattaattttccccggaaaaaaaggggctttaccccctggggggttggaaaaggttttccccccccaaaggggggggaagttccccttttggcgggggggggggaaccccccctc

SEQ ID NO: 22115 - protein, 64 aa, Zea mays
  misc_feature: Ceres CLONE 1391670-F
MYRAAGSHLRSLKHHGASRLASTSVAKQSSGGLFSWLLGGNQANSLPLMFHSQALAFPHLYQIL

SEQ ID NO: 22116 - DNA, 731 bp, Zea mays
  misc_feature: Ceres CLONE 1391674-F
  misc_feature: Translation starting site: 188
  misc_feature: SWISSPROT Homolog: EC 1.11.1.7 Peroxidase
  misc_feature (388)..(388): n is a, c, t, g, unknown, or other
  misc_feature (437)..(437): n is a, c, t, g, unknown, or other
  misc_feature (550)..(550): n is a, c, t, g, unknown, or other
  misc_feature (551)..(551): n is a, c, t, g, unknown, or other
aaagctggagctccccgcggtggcggccgctctagaactagtggatcccccgggctgcaggaattcgcacgagaccattacctagaacatcctaatcaaaaacgatacaaaacacaaactctcggagacagggaagtagcgtagctagatccagagctcggcgccagagatacccgacatcctcgtcatgtctccggttgcaagcaagggagtagtgatggacggtgcggtggcggtggcggcagtggccgccgccgtgctgctgtgcctccatctgccggcggtggcgcgaggccagctgcaggtggggttctacaacacgagctgccccaacgccgagtccctggtccgccaggcggtggccagcgcgttcgccaacgactccggnatcgccgccggcctcatccgcctccatttccacgactgcttcgtcaggngctggcgatgcgtcggtgctgctgacctccgccaacacacgggcggagcgtgacgcgccgcccaacacccgagcctccacgggtttccaggtgatcgacgcgcgaaaggcggnnggtggagcagagctgcccgccagacggtgtcgtgcggcggacatcgtgggctttcgcggcgcggacagcatcaacctcacgggaacctgccgtacaggtggcctcgggccggcggggacggaacgtctccctcgacacggaggccacaggaactgccgggcggcacgtcaacggggcccg

SEQ ID NO: 22117 - DNA, 718 bp, Zea mays
  misc_feature: Ceres CLONE 1391675-F
  misc_feature: Encodes the peptide sequence at SEQ ID NO. 22118
  misc_feature (402)..(402): n is a, c, t, g, unknown, or other
  misc_feature (430)..(430): n is a, c, t, g, unknown, or other
  misc_feature (502)..(502): n is a, c, t, g, unknown, or other
tggagctccccgcggtggcggccgctctagaactagtggatcccccgggctgcaggaattcgcacgagaccattacctagaacatcctaatcgaaaaacccgaatcccttcgatccaatctccaaaccctaggcagcccgctatcagattgttaggttctccttccttaaaccgcggcggccggccatgtcccacggcggcttcggcgggagggcgaaagtgacgccgaacctggcggtggacggcgagggcacgcggacgctcaatctcaccgtgctgcagcgcctcgaccacgccgttgaggacatcctcatcaccgcgggtcacgtcacgctctacgacttcgacaccgacatcaaccagtggagcccgaagggacgtgaggggtcgctctttgtcgtncagaggaatggctcaccccagattcagntcattgtcatgaatcgcaggaatacagataatctaggtgaagatcttttgggagattttgataaccactacnagctccttaaattatgtaccggcatgctgctcaagaagtataaggatctggttttacattcccaggagtggcaacaggtggcaatcttttcagcaggattctgatgctttctcaaaggtgcaccaaagcgaaattctctgtcaagtgattgaagtgaacacactcgtggtgatgcctgaggacgcaattgacacaccgtaagactacgttcggtga

SEQ ID NO: 22118 - protein, 139 aa, Zea mays
  misc_feature: Ceres CLONE 1391675-F
  misc_feature (19)..(140): Pfam Name: DCP1 Pfam Description: Dcp1-like decapping family
  misc_feature (82)..(82): Xaa is any aa, unknown, or other
  misc_feature (106)..(106): Xaa is any aa, unknown, or other
MSHGGFGGRAKVTPNLAVDGEGTRTLNLTVLQRLDHAVEDILITAGHVTLYDFDTDINQWSPKGREGSLFVVQRNGSPQIQXIVMNRRNTDNLGEDLLGDFDNHYXLLKLCTGMLLKKYKDLVLHSQEWQQVAIFSAGF

SEQ ID NO: 22119 - DNA, 668 bp, Zea mays
  misc_feature: Ceres CLONE 1391676-R
  misc_feature (668)..(668): n is a, c, t, g, unknown, or other
cgattgggtaccgggccccccctcgaggtcgacggtatcgatattttttttttttttttttgttatgaaactcaaaactcatataaagaattgacatttgaactaggaaagtcaaagcaagcagcaataatgcaacaaaaacaactcacagattgctcgtccctagaaatctagataactgatgatactgcagcaaactgcaaataattcagagaaacaatacattctagactagaaagattaatttgcaggctttgccatgcactccaaagaaaatgagatcagacattcgcactaccccttggagtttgctcaagatgtcgaagcagtccatttatatttgttacggagaacacaccttcctttcttccattgcagatgaacatggcacggcacgatctgagcatctggaaagttatgagctcctatgtcctgaaccactgcggcccctcttaatatatgagcctctgagctgacacaaaattcagatatctctcagctcaaatatattgccccaaatcgcctctgtaataaggttaatctgctccttgcccttagcagctgcagaagcagactcaataaccaaggatgcattttacagtaagtttctcactaaaaggccatgatatgttgggactttatgcagccacaactatatttttgagctn

SEQ ID NO: 22120 - DNA, 740 bp, Zea mays
  misc_feature: Ceres CLONE 1391678-F
  misc_feature: Encodes the peptide sequence at SEQ ID NO. 22121
  misc_feature (602)..(602): n is a, c, t, g, unknown, or other
  misc_feature (669)..(669): n is a, c, t, g, unknown, or other
  misc_feature (719)..(719): n is a, c, t, g, unknown, or other
  misc_feature (740)..(740): n is a, c, t, g, unknown, or other
aaagctggagctccccgcggtggcggccgctctagaactagtggatcccccgggctgcaggaattcgcacgagaccattacctagaacatcctaatcgaaaaacacccattttctcctgcaaagattctttataaccattttgacggtggtgagcccgaagccagcgaaaaccatcaatcccattcctctcctccgctagtagccgccaaatcgacgagaaggagccgaggccaggcctccaccaagtatcagattccacgccctacgaatcatcgcaatgacgaaaaagcagcggagggaggcgggggcgatgcgacggcgagaccgacaccaccatcaccggcggcagccgcgggacgagcgctgcgtttcctgcaccacgtttaacatcctggcgccgatctacaagcgcatggacaacgagaattgcagggagagccagtacagggcctactggttcagccgcaacgagaagattattgaccgccttctcgctgatcactcctccatcatctgccttcaggagggtatgggttggggaacgacgagctggtcgacatgtaccaggaagcgtctgggagacgccaattacatgctcttncagcttgcacgcaccaacagtccgtggagacggtcttcttactgctgtacatagaaactaacttcancgtttttgaatataggggaactgctggtcaatgacatccggtgatcgggnagctcaggctgttgcatgtgn

SEQ ID NO: 22121 - protein, 125 aa, Zea mays
  misc_feature: Ceres CLONE 1391678-F
  misc_feature (108)..(108): Xaa is any aa, unknown, or other
MTKKQRREAGAMRRRDRHHHHRRQPRDERCVSCTTFNILAPIYKRMDNENCRESQYRAYWFSRNEKIIDRLLADHSSIICLQEGMGWGTTSWSTCTRKRLGDANYMLXQLARTNSPWRRSSYCCT

SEQ ID NO: 22122 - DNA, 708 bp, Zea mays
  misc_feature: Ceres CLONE 1391679-F
  misc_feature: Encodes the peptide sequence at SEQ ID NO. 22123
  misc_feature (341)..(341): n is a, c, t, g, unknown, or other
  misc_feature (526)..(526): n is a, c, t, g, unknown, or other
  misc_feature (527)..(527): n is a, c, t, g, unknown, or other
  misc_feature (529)..(529): n is a, c, t, g, unknown, or other
  misc_feature (530)..(530): n is a, c, t, g, unknown, or other
  misc_feature (670)..(670): n is a, c, t, g, unknown, or other
aaagagctggagctccccgcggtggcggccgctctagaactagtggatcccccgggctgcaggaattcgcacgagaccattacctagaacatcctaatcgaaaataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcgggcgcacgggcgggtgcccgctgtccngcacgctgtcggagcgcttccgcgtgctgctgctggagcgcggcgcctcgccctacgacgacgaacgcatcggggacatggcccgcttcgcggacacgctgtcggacacctccccgggctcggccgcgcagcgcttcgtgtcggaggacggggtcatcaactcgcgccccgcgggtgctgggcgnngnnagctgcatcaacgccggcttctacacgcgggccagcgacgactaacttgcggggcgtccggttgggaactggggcgccgcccggggcgggcttaccgggggggtggaaggacctgggtgccgtccagccggagtgggggnccccgtgaaaagcccgcccttgaaggggggcctgcctc

SEQ ID NO: 22123 - protein, 186 aa, Zea mays
  misc_feature: Ceres CLONE 1391679-F
  misc_feature: SWISSPROT Homolog: EC 4.1.2.10 Mandelonitrile lyase
  misc_feature (65)..(65): Xaa is any aa, unknown, or other
  misc_feature (127)..(127): Xaa is any aa, unknown, or other
  misc_feature (128)..(128): Xaa is any aa, unknown, or other
MSGRSRHFTMSTLLATSFFFVLLCSSLQVRGVNYTFVKDAALAPSVSYYDYIIVGGRTGGCPLSXTLSERFRVLLLERGASPYDDERIGDMARFADTLSDTSPGSAAQRFVSEDGVINSRPAGAGRXXLHQRRLLHAGQRRLTCGASGWELGRRPGRAYRGGGRTWVPSSRSGGPREKPALEGGPA

SEQ ID NO: 22124 - DNA, 710 bp, Zea mays
  misc_feature: Ceres CLONE 1391680-F
  misc_feature: Encodes the peptide sequence at SEQ ID NO. 22125
  misc_feature (349)..(349): n is a, c, t, g, unknown, or other
aaagctggagctccccgcggtggcggccgctctagaactagtggatcccccgggctgcaggaattcgcacgagaccattacctagaacatcctaatcgaaaatctctatgacacgtgccccttcccccctcttaagctaagggacccttgggcagcccggcatcttctccaatctccaccctctgcccctctcgatttcttcttcccatctcccgatccatcgcaacccaaaccctactccaggcagatctccgtctccgccgacgctgccggcgtgagcacagcatcagatccgctgtgatggcgttccgccgcatcctatccaacggcggtggcgccgccgctcggncgtggccgccgcggcggccgggaacgcgcgcgaggcctccacggccgtcgctgcggcgccaggtgtgctcgcccccgatgcgaccgcggtgcgcgctcccgtgatgccgtatgaccgcatcgccgaggccgtcaacgccaggctccggcggttcgagcacccagaaccgcgcttcctccgctacgccaggcccgtggcggcccacgcggaccacatgggcttcctttgcgcgcccgaagacccgggtcaccaaaatggccaaaggcctggggatcggcacggaagttttccctcgccgggggaaaggttaacggcggggggggggattcgatgggggcagccaggtacaaaaaacgggggg

SEQ ID NO: 22125 - protein, 86 aa, Zea mays
  misc_feature: Ceres CLONE 1391680-F
MPYDRIAEAVNARLRRFEHPEPRFLRYARPVAAHADHMGFLCAPEDPGHQNGQRPGDRHGSFPSPGERLTAGGGIRWGQPGTKNGG

SEQ ID NO: 22126 - DNA, 718 bp, Zea mays
  misc_feature: Ceres CLONE 1391681-F
  misc_feature: Encodes the peptide sequence at SEQ ID NO. 22127
  misc_feature (349)..(349): n is a, c, t, g, unknown, or other
  misc_feature (542)..(542): n is a, c, t, g, unknown, or other
tggagctccccgcggtggcggccgctctagaactagtggatcccccgggctgcaggaattcgcacgagaccattacctagaacatcctaatcgaaaaactgatggatcactcctgcagctgcagctgcagtgcgtcgccgctactccatcgtctattaattcctcgtgtagctccagcgctcggcttagacaagcctctccaacatgaagctcctgggttggatgcaccggaagttacgacagaacagtaatgatgtgttcaaagagttcaacaacgctggaggtgggacgtgcaactgcatcaccgggctggccgcgtcggacccggccactttcctcgccaccgccnacgaatacttcgccgccgacaacgacttcaccaacaatcatccatcgtcgccggccgccgacctcttcacctttggtggcagcggcctcctcaccattggcacgctaggcatcgccgcccgtcgcggtgtctgcagatgctgatgaagttgattacgacgtcgacgccgatgctgactccgactttgacgacnacgacgaccaccggcggtgatgacgaagacccagtcgacagcgccgtcaccgccacgttcacatatgcagcgccgccttccggagaggacgcccacgtcgtcgagaaggctgcagttgcccggggttgaggccattgccgaaaaggcgaccacccacccctgaggagacctcctgg

SEQ ID NO: 22127 - protein, 95 aa, Zea mays
  misc_feature: Ceres CLONE 1391681-F
  misc_feature (49)..(49): Xaa is any aa, unknown, or other
MKLLGWMHRKLRQNSNDVFKEFNNAGGGTCNCITGLAASDPATFLATAXEYFAADNDFTNNHPSSPAADLFTFGGSGLLTIGTLGIAARRGVCRC

SEQ ID NO: 22128 - DNA, 732 bp, Zea mays
  misc_feature: Ceres CLONE 1391682-F
  misc_feature: Encodes the peptide sequence at SEQ ID NO. 22129
  misc_feature (372)..(372): n is a, c, t, g, unknown, or other
  misc_feature (417)..(417): n is a, c, t, g, unknown, or other
  misc_feature (551)..(551): n is a, c, t, g, unknown, or other
  misc_feature (675)..(675): n is a, c, t, g, unknown, or other
aaagctggagctccccgcggtggcggccgctctagaactagtggatcccccgggctgcaggaattcgcacgagaccattacctagaacatcctaatcaaaaggcccgcgcctcgctctctcttgtctcgcccgctagctcccatcccagcctcccaccgcgcccgcctgccccaacctcccccctcccctccccgctccgctccgctccacgcacggcgccagatctgctgctgctgcggcggccggtggacgccgcgccgcgcgtgccggcggcggtgacgtgagcggcggatcctgcccggccgtgccatcccggcgacgatgacagcgtaagcgggcggcggacgaccgcgcccccccggcccctactnccgaggtcattggcgtgtgctccttggcagaaatggcgatgatgntggatccccccaatggcatgggcagtcaaggaagcattactatactatgtggcagacactggttgagatcgacaccaagtacgtgccgatcaagcccatcgggaagaggagctacgggatcgtttgctcatctngtaaccgcgagaccaatgaaaagtcgcgataaaaagataaacacgtctttgacaaccgtgtggatgcgctaaggacgctgagagagctgaaactccttcggcactgaaggcacgagaatgtatngctctcagggacatatgatcctggcgcatagaagagcttcaggacgttttactgggt

SEQ ID NO: 22129 - protein, 39 aa, Zea mays
  misc_feature: Ceres CLONE 1391682-F
  misc_feature: SWISSPROT Homolog: EC 2.7.11.24 Mitogen-activated protein kinase
  misc_feature (30)..(30): Xaa is any aa, unknown, or other
MWQTLVEIDTKYVPIKPIGKRSYGIVCSSXNRETNEKSR

SEQ ID NO: 22130 - DNA, 725 bp, Zea mays
  misc_feature: Ceres CLONE 1391683-F
  misc_feature: Encodes the peptide sequence at SEQ ID NO. 22131
  misc_feature (358)..(358): n is a, c, t, g, unknown, or other
aaagctggagctccccgcggtggcggccgctctagaactagtggatcccccgggctgcaggaattcgcacgagaccattacctagaacatcctaatcgaaaaaaaagcaaaaagctacaccaggtctacagcgccgggagcccgggagtccgggatccagccacggccacggggggcgctctcgagagaaagatccagccccaaaggcccaaacccgaaacccctctcttcttcctccttccattggggtcgcgtccaacaagaggctggccagccatcccgcgcgagccacttcctctctcctccccatcggatccagcgccacgcggatccgcaaggcaatccatggcctctaccncaggcggaagcggaggcgggggcaccggccccgcccgaggcggcggaggcgaaggagaagggcaagcagggcgggtgctgcgggagggatggtggcgaccgtctcttcagtggccgcgaggactcctagaagcggatgctatacctgaccaaggagagtagacagccgcgcgcgcgaggatggatcgagctatctttaaatcgatcccgggccgggggaagcatcatcatgctctctgggcgatgccgaagcggatacatgatgcaaatggcctactgacgaccacgaaatgacgagctaacctgcccaatgaggaacatacgagtgttccttacgtttctcgttaatgctggtgccacagcatata

SEQ ID NO: 22131 - protein, 47 aa, Zea mays
  misc_feature: Ceres CLONE 1391683-F
MLYLTKESRQPRARGWIELSLNRSRAGGSIIMLSGRCRSGYMMQMAY

SEQ ID NO: 22132 - DNA, 744 bp, Zea mays
  misc_feature: Ceres CLONE 1391686-F
  misc_feature: Encodes the peptide sequence at SEQ ID NO. 22133
  misc_feature (530)..(530): n is a, c, t, g, unknown, or other
  misc_feature (537)..(537): n is a, c, t, g, unknown, or other
  misc_feature (539)..(539): n is a, c, t, g, unknown, or other
  misc_feature (540)..(540): n is a, c, t, g, unknown, or other
  misc_feature (597)..(597): n is a, c, t, g, unknown, or other
  misc_feature (607)..(607): n is a, c, t, g, unknown, or other
aaagctggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaaacacctcggtaccatcgccaggtccgggaccaagggagtcatggaatcccttgctgccggcgctgatgtgtccatgattggncagttcngnncgtcgtttctactctgcctaccctcgtcgcgatagagttgtcgtgaccaccaagcancacgatgacnagcagtacgtgtgggagtccccagcgggcgggtcgttcactgttactcgtgacacgtcaggggagcagctgggcagggggactaagatccactggtccctcaggacgatcagctgaagtaccttgagagcgcccccc

SEQ ID NO: 22133 - protein, 134 aa, Zea mays
  misc_feature: Ceres CLONE 1391686-F
  misc_feature (123)..(123): Xaa is any aa, unknown, or other
  misc_feature (124)..(124): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVKHLGTIARSGTKGVMESLAAGADVSMIGQFXXSFLLCLPSSR

SEQ ID NO: 22134 - DNA, 772 bp, Zea mays
  misc_feature: Ceres CLONE 1391689-F
  misc_feature (772)..(772): n is a, c, t, g, unknown, or other
gctctagaactagtggatcccccgggctgcaggaattcgcacgagaccattacctagaacatcctaatcgaaaaatcccagctcctcctccctgtctgctcccctccactgctgtggcgctctccctctcccgtctcccctcaccttctccacctcccccattccgccaccgcacaagccgacctccctcaccaagaggagaaaagaaaggcagagcgaaggaggcacaccaggtgggacagcaacgcgacgtgcttgctattctctcgagagagatgtcaattttataataaaacccccacatgcgtcagctggcgaattatgactcgagctcatgccagggtgaaagtcttactgcaaaaagggcagctgggcatgttaagacccatacttaaccctctctttgaataccccgcccgggggggggaaaaccttgaaaaaccgttggaccccctgggtcagaagaaaggggcttcagggttttcctccccaatcacctgaacaatggggcccgggatgtttttgggggccacctggacccccccaaggggaaagggccccacccattttttttccccgggggaaggactataaagggggggggggcctccccgaaatactgcgggaagcccggggaaaaaaggtttgtgtccccctcggggtaaaaaagcccaaaaaaatctgggggccccctaaagaaagagcgcccctcctagaagaaaaccttcctttgtgggaggggggtgtctcgcacaaatctggggacccccan

SEQ ID NO: 22135 - DNA, 725 bp, Zea mays
  misc_feature: Ceres CLONE 1391690-F
  misc_feature: Translation starting site: 266
  misc_feature: SWISSPROT Homolog: EC 5.1.3.2 UDP-glucose 4-epimerase
  misc_feature (481)..(481): n is a, c, t, g, unknown, or other
  misc_feature (514)..(514): n is a, c, t, g, unknown, or other
  misc_feature (541)..(541): n is a, c, t, g, unknown, or other
  misc_feature (555)..(555): n is a, c, t, g, unknown, or other
  misc_feature (556)..(556): n is a, c, t, g, unknown, or other
  misc_feature (686)..(686): n is a, c, t, g, unknown, or other
aaaagctggagctcaccgcggtggcggccgctctagaactagtggatcccccgggctgcaggaattcgcacgagaccattacctagaacatcctaatcgaaaagcgaaacagaagcacggcaatctcgatctcgttcgttcccctgagcggcagtcagtgcgagcgagcgcgcacacagacaactcatcctctcccctctctctctcacacacacacatccatcatcccatccctgtgacgggcgatccgagggcctaaccgacgatggtgtccgccgtgctccggaccatcctcgtgacgggcggcgccgggtacatcggcagccacacggtgctgcagctgctgcagcagggcttccgcggtcgtcgtcgtcgacaacctcgacaacgcctccgaggccgccctcgcccgcgtcgccgagctcgccgggcacgacggcgccaacctcgtcttccacaagtttgaccttcgcgacaggcnacgcgttggtggacatcttctcgtcgcacaggnttcgaggctgtcattcactttgctggnctcaaggctgttgnnggagagcgtgcacaagcccctactttactacgacaccaacctggtcggcccatcacccctcttgggaggtgatggctgcgaacggctgcaaagaagttggtgttctcgtcatctgcaactgggctatggntggcccaagggagtaccctgcaccgaagaattcccgctc

SEQ ID NO: 22136 - DNA, 745 bp, Zea mays
  misc_feature: Ceres CLONE 1391691-F
  misc_feature: Encodes the peptide sequence at SEQ ID NO. 22137
  misc_feature (285)..(285): n is a, c, t, g, unknown, or other
  misc_feature (308)..(308): n is a, c, t, g, unknown, or other
  misc_feature (413)..(413): n is a, c, t, g, unknown, or other
  misc_feature (428)..(428): n is a, c, t, g, unknown, or other
  misc_feature (475)..(475): n is a, c, t, g, unknown, or other
aaagctggagctccccgcggtggcggccgctctagaactagtggatcccccgggctgcaggaattcgcacgagaccattacctagaacatcctaatcgaaaaacaaaccctcgtctcgtgccactttctcagtcccctctagccgccgcctaccgctcgcgctctcctcgcgttcgggaaggtcgtttcgccatggcctcggagacggagacgttcgccttccaggcggagatcaaccagctgctctcgctcatcatcaacaccttctactccaacaaggagatncttcctcagggagctcatctccnactcctccgatgccttggacaagatcaggttttgagagtttgacggacaagaccaagctggatgcacaggcagagctggtcatccacattgtccccgaacagggncaacacacgctgacnatcatcgacagcggcatgggtatgacccaggtcagacccttgggacnaaccttggtaccattggcggggcaaggcacgaaggaatcctgggggcacttggctgctggggctaaggggccatgatggcccagtttggggggcggtttccaccccgccaacctggggcaaaaaaggggtttccggcccctaaaccacatggttttggccccccccgggggggaaatcccagggggggggggtcccttccggggccaagggatacccttggggggacattgtggggggggaaaaaagagcccccccccccggggggggga

SEQ ID NO: 22137 - protein, 77 aa, Zea mays
  misc_feature: Ceres CLONE 1391691-F
  misc_feature (53)..(53): Xaa is any aa, unknown, or other
MPWTRSGFESLTDKTKLDAQAELVIHIVPEQGQHTLTIIDSGMGMTQVRPLGXTLVPLAGQGTKESWGHLAAGAKGP

SEQ ID NO: 22138 - DNA, 719 bp, Zea mays
  misc_feature: Ceres CLONE 1391692-F
  misc_feature (361)..(361): n is a, c, t, g, unknown, or other
  misc_feature (446)..(446): n is a, c, t, g, unknown, or other
  misc_feature (455)..(455): n is a, c, t, g, unknown, or other
aaagctggagctccccgcggtggcggccgctctagaactagtggatcccccgggctgcaggaattcgcacgagaccattacctagaacatcctaatcgaaaaaaaagcaaaaagctacaccaggtctacagcgccgggagcccgggagtccgggatccagccacggccacggggggcgctctcgagagaaagatccagccccaaaggcccaaacccgaaacccctctcttcttcctccttccattggggtcgcgtccaacaagaggctggccagccatcccgcgcgagccacttcctctctcctccccatcggatccagcgccacgcggatccgcaaggcaatccatggcctctacccagngcggaagcggaggcgggggcaccggccccgcccgaggcggcggaggcgaaggagaaggcaagcagggcgggtgctgggggagggnggtgtcggncgctcttcggtggccgcgaggacttcgagaagcggctgcagtacctgtccaaggaggaggcagccgtgcacgcgcggatgcgccggtgggacgcagttctcgcgccgcggcgtggggaacctcatcgtactctccgtcctcgccgagggagttatctgctgtttatgccatcatgacgaccagaaatgaggatctaccttgtaacctgagggctatacgagggctacctatggtcattcttcctgctggatcctctggcatata

SEQ ID NO: 22139 - DNA, 729 bp, Zea mays
  misc_feature: Ceres CLONE 1391693-F
  misc_feature: Encodes the peptide sequence at SEQ ID NO. 22140
  misc_feature (619)..(619): n is a, c, t, g, unknown, or other
caaagctggagctccccgcggtggcggccgctctagaactagtggatcccccgggctgcaggaattcgcacgagaccattacctagaacatcctaatcgaaaactctctccatctctcattggccattccgcccgcatgaagccccaaaccctcttcggcatcgccttcgccgcagcagcgcccgcgtagcccgcccctctcgcccccgcccgctcgcccgctcctcgatcccgcccgctctgcagccgatcccgccgggagcacgaccgattacgatgaacggcgccgcggcaccggagcgctcgccctcaccctcgcccccgcctccggcccaggcccaggcccaggcgccgccgtcgccctctccggctcagccgctcgagtggaggttctcccaggtgttcggtgagcgcagcgccggggaggaagtccaggaagttgacatcatctcagcaatagagttcaataaatcaggacatcatcttgccactggagacagaggtggacgagttgttttatttgaaaggactgatgtcaaagatcatgcttgtagaaaagatgctgagaaagctgatcattctatcagcaggcatcctgaatttcgctacaaaactgagntttcaagccacgaaccagagtttgattatcttaagagcttggaaatttgagagaagattaaccaaataagatgggtgtcagcagcagatggcgcattgtatcttctatcc

SEQ ID NO: 22140 - protein, 130 aa, Zea mays
  misc_feature: Ceres CLONE 1391693-F
  misc_feature (115)..(115): Xaa is any aa, unknown, or other
MNGAAAPERSPSPSPPPPAQAQAQAPPSPSPAQPLEWRFSQVFGERSAGEEVQEVDIISAIEFNKSGHHLATGDRGGRVVLFERTDVKDHACRKDAEKADHSISRHPEFRYKTEXSSHEPEFDYLKSLEI

SEQ ID NO: 22141 - DNA, 706 bp, Zea mays
  misc_feature: Ceres CLONE 1391695-F
  misc_feature (476)..(476): n is a, c, t, g, unknown, or other
  misc_feature (478)..(478): n is a, c, t, g, unknown, or other
  misc_feature (479)..(479): n is a, c, t, g, unknown, or other
caaagctggagctccccgcggtggcggccgctctagaactagtggatcccccgggctgcaggaattcgcacgaaaccattacctagaacatcctaatcaaaaagactcacgattctgcatctgctcgtgtcgcatccgcctcaacgcgattctgcatctgctcgcgtcgcatccgcctcaacgccgcccagcgacctggatcctggcctctcgccttcgcgttcgcaccagccggtccccgcgccacgcttcggccgctggtcaccagctccgtcgctgcctcaacaactttatccggtcattcgagggcgcaacatcattccattcgacttccgctagcgccaagactacaccctcggcggttgccacgccggtgaagaaagcatactcactcgccacgatcgcaggtgaacgtcggattactgccatcaaagcgacaaagatgcacaggctggaaacatactttccctgtgaantnnagacattcactattcaaaaaacattggaaggggattgcattgcttattcccaggaaaagtgccgatctatgggccgttcaaatgaggaattgatggtcttggctgaagggaaaatctttccaaggggtttttgggttttcaaataaaaaaattagcgagttttgtttccttttcccaaggggaaggaagatccttccccaaggggttggggttgaaaaagccttacc

SEQ ID NO: 22142 - DNA, 719 bp, Zea mays
  misc_feature: Ceres CLONE 1391696-F
  misc_feature: Encodes the peptide sequence at SEQ ID NO. 22143
  misc_feature (585)..(585): n is a, c, t, g, unknown, or other
  misc_feature (686)..(686): n is a, c, t, g, unknown, or other
  misc_feature (719)..(719): n is a, c, t, g, unknown, or other
aaagtggagctccccgcggtggcggccgctctagaactagtggatcccccgggctgcaggaattcgcacgagaccattacctagaaacatcctaatcaaaaaaaggaaacgtcacgtcaccaccacacacctcttctgctcttcctcttctcctccgtatagcgtgtgtgactccgtcgccccccttccaccccgttttgccgccccgcaggtcatacgcccaaaatcctcctcgtcgctggtgccctctccgcgaccacctccgcctgacatggccgccgctgggcccgggctctactccgacatcgtaaagaaggcacgaggtctcctgtacaaggtctaccacactgaccggacagtcacgctcaccacttacgccgccaacggagctttcaaggtcgcgtgtcaccatggacatgaagcaccgcgtcgtccgcgccatgatcgcgctgagcatgcgagacggtgatgccgcacccgtgcatgtccagcataagaccgagtcggtcattactgctgcaagcacaaggaaagatgaagctatctttaataaaatccagggccagctgaagcacaacaatgtgnactggtggatgtgatagcaacttcagaatcaaaagtgacaactacaatcacagttcacgagctagccacaccagggcctgaagggatttttatgcattccntttcccgtacaagaaatctgcaaaggctgaacn

SEQ ID NO: 22143 - protein, 65 aa, Zea mays
  misc_feature: Ceres CLONE 1391696-F
MAAAGPGLYSDIVKKARGLLYKVYHTDRTVTLTTYAANGAFKVACHHGHEAPRRPRHDRAEHARR

SEQ ID NO: 22144 - DNA, 723 bp, Zea mays
  misc_feature: Ceres CLONE 1391697-F
  misc_feature (367)..(367): n is a, c, t, g, unknown, or other
  misc_feature (392)..(392): n is a, c, t, g, unknown, or other
aaagctggagctccccgcggtggcggccgctctagaactagtggatcccccgggctgcaggaattcgcacgagaccattacctagaacatcctaatcgaaaagtgagtcgtgagtagtgactcgtctggtctcccctctctcgtccgtctggtcctcccgtccagaggagttctctctccctccccctttcctctggtcatcgcacccgtctccccgctctgactccgcccgcgccgccgactcccgggacggacccagggttcatctccgccgccgcgccgcctcgctccgatcgacccccgaaacgccggaaaccgtgggcttcgcgaggtgcaatttcttgggccgcgtctgagcttgattcantttctggaaagcggctgagcttganatttgatcagtgttgcctctcttcgtccaagcggtagataacataacagtgcgacagttgaatcgcatagagaaggggggcatttgttctctgtatgatggggcaggccccaatttccctggcatgattggaggcattagcatggcggagatttccggcgagtggcatactaccggaagctcggtgagggccaaaacatgtgggaaacaacttaaatagcatgaaaccacacacatgggggttccttggaaagggtggggaaaaaaaaacgggagggccccggggaccccataacaaggagttcaatcccccgggccaagggaacaggtgg

SEQ ID NO: 22145 - DNA, 722 bp, Zea mays
  misc_feature: Ceres CLONE 1391700-F
  misc_feature (535)..(535): n is a, c, t, g, unknown, or other
  misc_feature (615)..(615): n is a, c, t, g, unknown, or other
  misc_feature (626)..(626): n is a, c, t, g, unknown, or other
  misc_feature (635)..(635): n is a, c, t, g, unknown, or other
  misc_feature (636)..(636): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
aaagctggagctccccgcggtggcggccgctctagaactagtggatcccccgggctgcaggaattcgcacgagaccattacctagaacatcctaatcgaaaaaatgtctacttgtctaccgtcgttgtgctagccctcctccctgcttcttgcttttgcctgaccctgcagcctgctgcaagcttttgctttggcttaggcgcttcttttccacccctttactgttccccccacttttgcttgctttgtcacgcacacgaaaagctcctgcctttaccttatctccgcacccgtagtggtattctggtggggagctgcgctgctcgcccctcgcgtttctttgctcaattgggggtcacggtcacggacccgcgggtgctgcgcgtgctcgtgggcggacggaattcggggtttcttgctgcggtcccggtccccctcggcgattgcggacgctgctctgcagatcttcgcgtaactccgggagctgcgccggagaatgaactgcggaccgccgacagctggcccgccgaggacngtcgtcaacgtgcttctcaaactgaactgggacgagcctatggccgccgaccagtcgacccggagttcactcgatgcttnctcccgcgttncactcgcgnngggcgacggggtactgacgccgagatcccacggaatgctcacgataggagacaaggtctccgttctttcccccccagcccannnnt

SEQ ID NO: 22146 - DNA, 681 bp, Zea mays
  misc_feature: Ceres CLONE 1391702-F
  misc_feature (351)..(351): n is a, c, t, g, unknown, or other
  misc_feature (352)..(352): n is a, c, t, g, unknown, or other
  misc_feature (365)..(365): n is a, c, t, g, unknown, or other
  misc_feature (366)..(366): n is a, c, t, g, unknown, or other
  misc_feature (441)..(441): n is a, c, t, g, unknown, or other
  misc_feature (442)..(442): n is a, c, t, g, unknown, or other
aaagctggagctccccgcggtggcggccgctctagaactagtggatcccccgggctgcaggaattcgcacgagaccattacctagaacatcctaatcaaaaagagggggaggcagagagcttgccatcccaagcaaaggttccctctccttccccacctcgcgctcaacccccctcatcctcccacatccgattgtgccctgcgctctgccgttctcttatccaagatttcgccggcggcggctcagggagcggacaaagattgtttttttttcgggctatggagacgaggcctgattcattcagccccgggcggtggagtggcttcctgaccgggtctgattcgtattgnntcaaatgatctgnngcgcttaattggttgcatccgcttccaccgggaaatcgagctagggctgtggtttgttgccggctggtggattcnntcgcttggggtctgtgagatcttgagggtttctgggtcagcacacggccgcaggtctgcgaaaatccccctctcgattcgtgcgatttgtttaagggttttggtttgagcctgggggaaaatgatagcaaatccttgcaggctgccaagaaaccgggaaaggtggggaaacagggagcctgtgttgcgggaatggaactaacctccaatcctaaagggtgggaaggcatggaccaggaa

SEQ ID NO: 22147 - DNA, 697 bp, Zea mays
  misc_feature: Ceres CLONE 1391703-F
  misc_feature: Encodes the peptide sequence at SEQ ID NO. 22148
  misc_feature (388)..(388): n is a, c, t, g, unknown, or other
  misc_feature (562)..(562): n is a, c, t, g, unknown, or other
  misc_feature (563)..(563): n is a, c, t, g, unknown, or other
aaagctggagctccccgcggtggcggccgctctagaactagtggatcccccgggctgcaggaattcgcacgagaccattacctagaacatcctaatcgaaaagagcagcagaccacgaccagcacgcccacttgcctgcgattactttgcgccagagggcagaggccttggccctgccatcgttgttcttatccccccttcctctttctttctcctccctcttgcggcttctctctggactcgcccctccctccgtctcgtctcccaggtcatggcaaagctggaacacccgtgaatatagcaagtgggagataaacaggaagagctagggtgaatactaaatacaagtagcagtagaaggaaaagagtcagtccgcccgtgactacnagtgaatttgttgggtgtggtgtttgttgaggtcacgatgatgggaggcgggctgttggtggatcagagcgtggtgttccctggcgtcccacacttcgtggatctcctgcagcagaacggcgacaagaacctgggcttcgggtctctgatggcgcagacgtcctctggcgacanntgcggtgatggggggagggcgatctcgtggacccggctccggatagcttcccccgacgcggggagacgacagcgacgatgacgtcgaggacatcaaggagctggagcgcccatggggcccgaccgcatgaactt

SEQ ID NO: 22148 - protein, 72 aa, Zea mays
  misc_feature: Ceres CLONE 1391703-F
  misc_feature (46)..(46): Xaa is any aa, unknown, or other
MMGGGLLVDQSVVFPGVPHFVDLLQQNGDKNLGFGSLMAQTSSGDXCGDGGRAISWTRLRIASPDAGRRQRR

SEQ ID NO: 22149 - DNA, 722 bp, Zea mays
  misc_feature: Ceres CLONE 1391704-F
  misc_feature: Encodes the peptide sequence at SEQ ID NO. 22150
  misc_feature (570)..(570): n is a, c, t, g, unknown, or other
  misc_feature (573)..(573): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcaaaaacctttccccgctcttctcccacacaaacgccaccgccgcatcgaatccgagacgccgatctcggattcgccgtcaccacacgctgccctcgtcgcgctctcccgccgccgccgctcgtctcgtcagccatggcaggattggcaccagaagggtcgcaatttgatgacaagcagtatgacaagaaaatgcaggagatattaactgaagacttcttcacttcatatgatgatgtttgtgaaagttttgacagcatgggactgcaagagaaccttctgagaggcatctatgcctatggttttgagaagccatcggctattcagcagaggggaatagttcccttctgcaaggggcttgacgtgattcagcaagctcagtctggaactggaaaaacagctaccttctgttctggaatcttgcagcaacttgattatggattggttgaatgcccagcattggttcttgctccanccngtgagcttgctcagcaaattgagaaaggtatgcgtgctcttgaggactatttgggtgtcaagtgcatggcctggtgtgntggaaacatctgtcgtgaggaccaaagatctttgcagtggtgggcattggtgttgtggcaccccaggacg

SEQ ID NO: 22150 - protein, 164 aa, Zea mays
  misc_feature: Ceres CLONE 1391704-F
  misc_feature (114)..(114): Xaa is any aa, unknown, or other
  misc_feature (115)..(115): Xaa is any aa, unknown, or other
  misc_feature (141)..(141): Xaa is any aa, unknown, or other
MAGLAPEGSQFDDKQYDKKMQEILTEDFFTSYDDVCESFDSMGLQENLLRGIYAYGFEKPSAIQQRGIVPFCKGLDVIQQAQSGTGKTATFCSGILQQLDYGLVECPALVLAPXXELAQQIEKGMRALEDYLGVKCMAWCXGNICREDQRSLQWWALVLWHPRT

SEQ ID NO: 22151 - DNA, 692 bp, Zea mays
  misc_feature: Ceres CLONE 1391707-F
  misc_feature: Encodes the peptide sequence at SEQ ID NO. 22152
aagctggagctccccgcggtggcggccgctctagaatagtggatcccccgggctgcaggaattcgcacgagaccattacctagaacatcctaatcgaaaatgtttcaaatagtggagatgcatgttcagtcttagctagtaaagtcacatcattaaatcccaatggcagcggagtttgtaccgtcatttgttaaaccatcttttggaatgggtacagttctagataagtcagatttcaggggttcttctgaaaaacatttctagatagggcctgaccatcaaaggctattaactcagatgatgaggcacaccagttttgggataagcagcttccggatgacattattccaaaacttcacttcttttgaaaaagttgaacaaggggctgaactggcccttggtggattatccttgaatggaccccccttttatgggacaacttccagtcgcttcctcagagaaataccccaattattcttctccaggttccaagggcctgggactggaactagaacctactaatatggtatatggaagaaaaaagaactggggagaaaattatattgggggatcttcctattggtaagggaaacccggaccttcttaatgatccgaaactgggggaaactttttctaaaaatttttctaagggagaatgttccccaataaaaggcggtttttgcccccccggg

SEQ ID NO: 22152 - protein, 74 aa, Zea mays
  misc_feature: Ceres CLONE 1391707-F
MMRHTSFGISSFRMTLFQNFTSFEKVEQGAELALGGLSLNGPPFYGTTSSRFLREIPQLFFSRFQGPGTGTRTY

SEQ ID NO: 22153 - DNA, 895 bp, Zea mays
  misc_feature: Ceres CLONE 1391708-R
ccgattgggtaccggggcccccctcgaggtcgacggtatcgataagcttttttttttttttttttgcggcggaatttctttttttcaaagttccaggttacaacaaatttcctttgtttatcagagggattccaaaaggggttcaaagggataaactttgaaatgttataaattttttataagtttgaaatatatgctagctcaaatgaccatcctcaataagaaatatagaagagttccttagacgtataaaagggtcgggtcccccggcgcttaaccccttccaaagcggcacaaacctagtacctgcaacaacatgggttcaaaaaccctgaaaaaacactaggttagggtttgttaaacaacctccacttgacgaccatgctttgtcttggcactctttcaaataacccacctccgggttcgcccattacatcacctgggggagaagctcacgctttccagcatctaggggtggacccagttctaatcccccgcatcacgcgatcaactagcgtcccttcagaaatgcacggggcacttgtttgagcccgagtataaatggtaaaagatagatatcctccccggaaaaggaggaaacccttattacaaaccttaaaccggatcctggctgggggatttaaaactgattataaaatttcccgctttcccgcccatttcaaagggggctcatatttcggcaaaaaaataaatattattttttcccccccctttttttccttttgcgatttttttaccaaaaactcttttccccccttatttttttcccccaggcatttttttatataaatatccccctcccccccaattccctaggaagaagaaaattcctccgattaatatctccaaaacaagggggtccaccccgcggccg

SEQ ID NO: 22154 - DNA, 663 bp, Zea mays
  misc_feature: Ceres CLONE 1391709-F
  misc_feature: Encodes the peptide sequence at SEQ ID NO. 22155
aaagtggagctccccgcggtggcggccgctctagaactagtggatcccccgggctgcaggaattcgcacgagaccattacctagaacatcctaatcaaaaaattcgtcgctaatcacaatcccgatctccaagcaaacccacctcccgtcagttccctactcgccgatccagatctcctacagctttccactccgccactccaaccggacgcctccgccgtcgccggcggcggtcgagccacgcgcgcacgccgctgaggaacccggagagggcggcggcaatggagcagctgcggacgttcgggcgggagctggcgatggggtcgcagggcgggtgggggcagtccaaggatttcctcgacctcgtcaagtctatcggcgaggcgcgctccaaggcggaggaggaccgcatcatcgcgcgcgagcttgagcacctcaagcgccgcctggccgaccccgacgtgccacgccgcaagatgaaggagcttctcctccgcctagtctacgccgagatgctcggccacgacgcttccttcggccacatccacgccgtcaagatgacccacgacgagtcgctaccgctcaagcgtaccggctacctcgccgtcgcactcttcctcgacgagcgccacgacctcgtcatcctcgtggtcaacaccatcc

SEQ ID NO: 22155 - protein, 127 aa, Zea mays
  misc_feature: Ceres CLONE 1391709-F
MEQLRTFGRELAMGSQGGWGQSKDFLDLVKSIGEARSKAEEDRIIARELEHLKRRLADPDVPRRKMKELLLRLVYAEMLGHDASFGHIHAVKMTHDESLPLKRTGYLAVALFLDERHDLVILVVNTI

SEQ ID NO: 22156 - DNA, 745 bp, Zea mays
  misc_feature: Ceres CLONE 1391710-F
  misc_feature: Pfam Name: Catalase Pfam Description: Catalase
  misc_feature: SWISSPROT Homolog: EC 1.11.1.6 Catalase
  misc_feature (256)..(256): n is a, c, t, g, unknown, or other
  misc_feature (257)..(257): n is a, c, t, g, unknown, or other
  misc_feature (298)..(298): n is a, c, t, g, unknown, or other
  misc_feature (299)..(299): n is a, c, t, g, unknown, or other
  misc_feature (392)..(392): n is a, c, t, g, unknown, or other
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaatgtaaaccacactccactccagcactgaacacttgattgattcagtgggtagctagctagctgaatcacaatggatcctaccaagttccgtccgtccagcagccacgacacgacggtgacgacgacaaacgcgggcgctcctgtgtgaacgacnnacgagcgctgactgtggggcctcgccgtcccatcctgctgnnagactaccacctgatcgagagggggcgcacttcgcgcgcgagcgcatcccggagcgcgtggtgcacccgggcggggcctgcggcaaaggcttnctccgaggcccccaccacgtgacgtccttgagggggcccaatttcttgggggcgccggggtgggaccccccggattcgcccttcccaaaaggaatcccagaagggggccccccgaaaaatccccccccccgggggttttccccggaaatttcccccccgggggggaaatgggcaccgggtgaaaaaaaattccccggttttttatccgcggggggtaaaatctccccgagggaacaccccgtttaaaacccccccccgggnaaaaaaggagaaaaaaacgggggggggtttccatttttgtgcgccccccccgagagaggggcccctcttttctttctttccagggggggggg

SEQ ID NO: 22157 - DNA, 716 bp, Zea mays
  misc_feature: Ceres CLONE 1391712-F
  misc_feature: Encodes the peptide sequence at SEQ ID NO. 22158
aagctggagctccccgcggtggcggccgctctagaactagtggatcccccgggctgcaggaattcgcacgagaccattacctagaacatcctaatcgaaaaaatatcctctcctcgcaccccctcaagaactgtacccatcacgcgccgccatcgattgaccttgaccgacccgaccacccatcacgcttcttgttgccgccgctgttgcttgccgatacgaggtggatgcgctcgccgacgattaataggagtcgcggtgtgcgcgcctctagtctttcttcgcctccgtgctctcgggccttcttcggccaggccgaccagcacgagcaccaagagatggcctcgcgcaaccacaacgacgtcgctccgcagcttcaccatcacaaccgagccggtgttcccgctcttgaaaagaccaaggacgtgcccgcccgatctgacgctctgaaccggcgaccccctctcgtcgatatcggcaacctcgtcagcgtccgcccagccacagggaacccgcaggagtaggtcaaccgccccatcactataagcttcggcgctcaactcttcaagaaagcgcaggctgaggtcgctatcaagacagacgcaatcctgcctgcgaggcatgcgccgaggtaggagaggtaggcttcttgtcaagcagcacccgccgccgtatgatatcatagtactcagctccgattctgaacagatcaggcg

SEQ ID NO: 22158 - protein, 61 aa, Zea mays
  misc_feature: Ceres CLONE 1391712-F
MASRNHNDVAPQLHHHNRAGVPALEKTKDVPARSDALNRRPPLVDIGNLVSVRPATGNPQE

SEQ ID NO: 22159 - DNA, 700 bp, Zea mays
  misc_feature: Ceres CLONE 1391713-F
  misc_feature: Encodes the peptide sequence at SEQ ID NO. 22160
aagctggagctccccgcggtggcggccgctctagaactagtggatcccccgggctgcaggaattcgcacgagaccattacctagaacatcctaatcgaaaaaccgtccatccgtattcccgtcacgcccccaacacccccacaacccgaagcagcgaaagctcccctaaccctctccgcgcatccgatcgcaaggaagaagagggagatgagctactacgggcagcagccccccgtcggcgtcccgccgcagcaaggctacccgggcaaggacggctacccgccagcggggtacccgccggccggctaccccccgccggcgcagggctaccctccgcagggctacccgccgcagtacgcgcagccgccgccctcacagcagcagcagagcagcgggccttccttcatggagggatgcttggctgccctctgctgctgctgcctcctggacgcctgcttctgagagtgagagggggcgaccgacggattcaacacggcgacaagtgaaactactagcttttctatgcgagggagagagagagagaagctgaactggattgagcctgggatgctatcgtgctatcctagctttggcagagaatatatggccccctaggtttttatttctctctggcaagggtgacgggatcagacggtgtgtgtgtattctggctggggaatgttcggtgtttctggggaaa

SEQ ID NO: 22160 - protein, 84 aa, Zea mays
  misc_feature: Ceres CLONE 1391713-F
MSYYGQQPPVGVPPQQGYPGKDGYPPAGYPPAGYPPPAQGYPPQGYPPQYAQPPPSQQQQSSGPSFMEGCLAALCCCCLLDACF

SEQ ID NO: 22161 - DNA, 727 bp, Zea mays
  misc_feature: Ceres CLONE 1391714-F
  misc_feature: Encodes the peptide sequence at SEQ ID NO. 22162
  misc_feature (483)..(483): n is a, c, t, g, unknown, or other
  misc_feature (525)..(525): n is a, c, t, g, unknown, or other
  misc_feature (549)..(549): n is a, c, t, g, unknown, or other
  misc_feature (550)..(550): n is a, c, t, g, unknown, or other
  misc_feature (574)..(574): n is a, c, t, g, unknown, or other
  misc_feature (575)..(575): n is a, c, t, g, unknown, or other
  misc_feature (627)..(627): n is a, c, t, g, unknown, or other
  misc_feature (661)..(661): n is a, c, t, g, unknown, or other
aaagctggagctccccgcggtggcggccgctctagaactagtggatcccccgggctgcaggaattcgcacgagaccattacctagaacatcctaatcaaaaaattgtccagccatcctcaggcagcttcgagttccacgacgagagcaccggcagccgcacacgcgtttgtctcctcgccggaccttcccggcaccgccgccggctctccctcacggtccactacactccacagcaccgccgtcgcacaacgacatggcctcctccgctacctatctcatgctcgccagcgcccacgctcccctcgctcctctcataaggccaccgccgatggcccttgtcgcgagaaccgccgcaacctccatcactaggcgcgaaagagccagtgtccctctgttagtcaaccccgctgcgtgccggccggacctgcggcgccgtggctgggcccatatctgcagagactcgtccctccagggcccttcgnggcgccgattctcctgctcaggagcaagaggatctgaagagnagcgaggcggtgtcagaggctgcnngctcggattgccggaggcactggnncggacgtttagcgacgggaagcacgtcggtgctcatcttccgggaatctggncgggactcaatgtactacgtcttccttgctcgcngctaaccagacaccataccgagacacatactttcttgcagaaacttttaaatctgaaggggggacg

SEQ ID NO: 22162 - protein, 157 aa, Zea mays
  misc_feature: Ceres CLONE 1391714-F
  misc_feature (77)..(77): Xaa is any aa, unknown, or other
  misc_feature (91)..(91): Xaa is any aa, unknown, or other
  misc_feature (99)..(99): Xaa is any aa, unknown, or other
  misc_feature (107)..(107): Xaa is any aa, unknown, or other
  misc_feature (125)..(125): Xaa is any aa, unknown, or other
  misc_feature (136)..(136): Xaa is any aa, unknown, or other
MASSATYLMLASAHAPLAPLIRPPPMALVARTAATSITRRERASVPLLVNPAACRPDLRRRGWAHICRDSSLQGPSXRRFSCSGARGSEEXRGGVRGCXLGLPEALXRTFSDGKHVGAHLPGIWXGLNVLRLPCSXLTRHHTETHTFLQKLLNLKGG

SEQ ID NO: 22163 - DNA, 588 bp, Zea mays
  misc_feature: Ceres CLONE 1391723-F
  misc_feature: Encodes the peptide sequence at SEQ ID NO. 22164
  misc_feature (450)..(450): n is a, c, t, g, unknown, or other
  misc_feature (462)..(462): n is a, c, t, g, unknown, or other
tccccgcggtggcggccgctctagaactagtggatcccccgggctgcaggaattcgcacgagaccattacctagaacatcctaatcgaaaaatcatttcgttccgttcctgatacaggcgagcagggacgactgcaggcctccccctctttctcggcttccactcacccgccaccactggaccacccccaacggcgagggagtgagagagatcggcagcagctcgggggcctggcagggcagctgcattgcgctgcggcgggcggcggccatggccgattcgtacggcgacggcaagggcccatcactcaagagccagagccagaaccagcagccgcgccctggcccccgcctcaaggccgccatcgagatggaggatctcatcaacctcctccacggatccgatccagtccgggtcgagctcacccgcctacgaagaacgaactgcagnttcaaggataangagctgggcgatgcgcaggcggagaacaaagggtccttcgcttgggcgcaccccccccggggggggaaaaggcgcccccaaggggtttttttcccaaaaaattgcaaagggggggggggaacacaa

SEQ ID NO: 22164 - protein, 106 aa, Zea mays
  misc_feature: Ceres CLONE 1391723-F
  misc_feature (60)..(60): Xaa is any aa, unknown, or other
  misc_feature (64)..(64): Xaa is any aa, unknown, or other
MADSYGDGKGPSLKSQSQNQQPRPGPRLKAAIEMEDLINLLHGSDPVRVELTRLRRTNCXFKDXELGDAQAENKGSFAWAHPPRGGKRRPQGVFFPKNCKGGGGTQ

SEQ ID NO: 22165 - DNA, 629 bp, Zea mays
  misc_feature: Ceres CLONE 1391728-R
cgaggtcgacggtatcgataagcttttttttttttttttttgagttccaggggaaattccctctcggatttggttttttattccgccacacgaactgtcatttcctcccagagggttcatcccttactgtaacccatgcagctaagaactgacccatccactaggccggctcactagccccaaaacgcgagagcccgccttatccttatctccgtccttgcccaatcctgcaagaatccggtggttcacagatgaaagcccccaagtgttattgtaaaaaacctatgtccccctactttggagaagtgggaccttcatatcgatcctaatgatctcattcgaaccatctctgcctggagatctacgtaccgccaccggcatcctcgttaccatcgacggcttcacctctctcaatcccttgcgcccacctccattctgatagactgtaccgattgttgccttagaacccacctctttcgaccagtgcattcactgaaggtcttcatgtgagtgctgtcatttagaacacatgtatggtccacgagcacgacttcctcaaagtagttcctcgatcctacttccagcgtgttatacatactcatctgggatttcactgaactttgggactg

SEQ ID NO: 22166 - DNA, 649 bp, Zea mays
  misc_feature: Ceres CLONE 1391728-F
  misc_feature: Translation starting site: 234
  misc_feature: Pfam Name: UBA Pfam Description: UBA/TS-N domain
  misc_feature: Pfam Name: EF_TS Pfam Description: Elongation factor TS
ccccgcggtggcggccgctctagaactagtggatcccccgggctgcaggaattcgcacgagaccattacctagaacatcctaatcgaaaagccgactatgatagtgccgtcgccgccctacaccagatgcccagttcttcgacagccccttctccgggaacgagcacctaacaggctgaaaaaaaatcattgatacacgtacgccgccagaggctgcaggatattctgtgagaatgggatgctgccaaggagataagagggccatactacgccttctctttcgctcacaataccaaactgctcgcccatactcttcttcatcattccagactcaccaattgagcactcatgttccccaagacgtagagcttattaagagatgctcctctgaggtgtcttcttcatagcaaatgaaccttattaagcaactcagacaaacgaacgagtgctccaatcaaagatgtcgaggcctctctaggtacctgcaactgggatattgaggctgcacataaggacctaaggaagagaggtgttgctcttgctgcctaaaagtcttcacgcactgctgctgaaggtttgctagctatcgcacaagatgacaaaagggctgctgtagatgagcttaactgtgacactgatttcgtagcaa

SEQ ID NO: 22167 - DNA, 583 bp, Zea mays
  misc_feature: Ceres CLONE 1391731-F
  misc_feature (320)..(320): n is a, c, t, g, unknown, or other
  misc_feature (406)..(406): n is a, c, t, g, unknown, or other
  misc_feature (424)..(424): n is a, c, t, g, unknown, or other
  misc_feature (425)..(425): n is a, c, t, g, unknown, or other
ggagctccccgcggtggcggccgctctataactagtggatcccccgggctgcaggaattcgcacgagaccattacctagaacatcctaatcgaaaaaaaagcaaaaagctacaccaggtctacagcgccgggagcccgggagtccgggatccagccacggccacggggggcgctctcgagagaaagatccagccccaaaggcccaaacccgaaacccctctcttcttcctccttccattggggtcgcgtccaacaagaggctggccagccatcccgcgcgagccacttcctctctcctccccatcggatccagcgccacngcggatccgcaaggcaatcatggcctctccccagcggaaagcgaggcggggcaccggccccgccccgagccgggcgagcgaagganaaaggcaaccaaggccgnnttgctggggaaaggtgtgggcggcccctcctttgggggggcgccgggagatttcaaaaaaagggggtggggaacccctgccacaggaaggggaaacccgtgcccccccggggatggcccccggggaaaaaaattttcccccccccgccgcgggggaaa

SEQ ID NO: 22168 - DNA, 618 bp, Zea mays
  misc_feature: Ceres CLONE 1391737-F
  misc_feature: Encodes the peptide sequence at SEQ ID NO. 22169
gctctagaactagtggatcccccgggctgcaggaattcgcacgagaccattacctagaacatcctaatcgaaaaggttatcacaataacccgactctcggacccacgacgagttaagcccggagggaaaaaggacaaatcacacaaaggcacagggaatcgcgccaccgtgggacgcgtacggcgcaccgcccgcccgccggatctgcgccggcgacgcgcccggacgtcggatctacgccgccgcaggaggggggaggcggcgctgttgccgttctctgcccgcgagcgcccggatccgtcccgccggtgacttcatctccgctaatccaacggataggcaaaactctaatctttgtcaaccatcaagtatatatatatatatcaatcaaaatggtcctgtgatatcgagcttcagttgatgcagaggtggtgaaaacatcttctcttctccaaagactgctgactgcaagttgcaaaagtttgtcttcagcttgctgtgttctttcttccctctctggcggagtacacgagaagtttgtagatataggcactaggcagctcctttcagctcttctatgtccagggatttggactgtcctgttcagacacagatggc

SEQ ID NO: 22169 - protein, 37 aa, Zea mays
  misc_feature: Ceres CLONE 1391737-F
SRTSGSPGLQEFARDHYLEHPNRKGYHNNPTLGPTTS

SEQ ID NO: 22170 - DNA, 757 bp, Zea mays
  misc_feature: Ceres CLONE 1391741-F
  misc_feature: Encodes the peptide sequence at SEQ ID NO. 22171
  misc_feature (29)..(29): n is a, c, t, g, unknown, or other
  misc_feature (31)..(31): n is a, c, t, g, unknown, or other
gtgtggcccccccccccgttttcctcctnanaagtaactctcatgagcctaaaaaaaaaatggagatccacgcggtgggggccgctctagaatagtggatcccccgggctgcaggaattcgcacgagaccattacctagaacatcctaatcgaaaaccacagcctccccagcatcagtgaagctcgctcaccgtcattcgacgacgccctcccgcacacacgaccatggccgcggcgatgaccggcagtgctcgcgccagcaccggctccttgctcgtgcttctcttcgtcgcgctggccggcgcgaccgccggggcgagtgccaccgttgccttcagcagcggcgacagcaacgcggcggcgctgctgacgacgccagcatcggcgtccccggggcagctgaacggcatcatccagtgccttatgggctgcttcacgcaggtgttcggctgttcgttcggatgcatgggcaagcagggcgctgacctgccgctctgcatcatcagctgcgaccagaagagcgtcgtgtgcatggtccgctgcggacttgccccgtcaccgccatcaccgtcgcccgcccacgcccaaaccaccagcaacccaagccggcccacggcccaaagccgccccgggccccgcccctacacccccggccggtacgcccgcccgccggcccggccacccggaaccggcaacattctggccctgaaaatattgtccgaaccatggtggcccttggcccaggctcttttcccaa

SEQ ID NO: 22171 - protein, 177 aa, Zea mays
  misc_feature: Ceres CLONE 1391741-F
MAAAMTGSARASTGSLLVLLFVALAGATAGASATVAFSSGDSNAAALLTTPASASPGQLNGIIQCLMGCFTQVFGCSFGCMGKQGADLPLCIISCDQKSVVCMVRCGLAPSPPSPSPAHAQTTSNPSRPTAQSRPGPRPYTPGRYARPPARPPGTGNILALKILSEPWWPLAQALFP

SEQ ID NO: 22172 - DNA, 733 bp, Zea mays
  misc_feature: Ceres CLONE 1391745-F
  misc_feature (37)..(37): n is a, c, t, g, unknown, or other
ttggtggccccccccccccctccgccattccaccccngcggagaaaaccccaaaaccggagctcaccgcggtggcggccgctcttacaatagtggatcccccgggctgcatgaattcgcacgagaccattacctagaacatcctaatcgaaaaaccgagccggcaagcaggctgtttacctgtttctgctagcaagccgagatgtggcgaaatttagaaagcctgaggtgtcggccgttcacgattacctttatgttcacgttcttctgcgtgcaaacgttccattcattggcgcaattaatggcggccattcttggcacgcctctcttccatctttctttaccatgctgagttgtctgtcaatgacctcaaaagctggcgggagaccgtcctcgaccgcattgaccccgccgcggcacggcctccaggccggcgacgacgcaggcgcgaggcgccggagggcccgcccatgacgtcgtccgtgcggcagtggtgacgccgcgccgccgctgccctcaagcacaggaggagcctgctcctggcgcccctgccccccccgccggaccgcatagacgtagtggaaacaccgggcagctgaaaggggcccgcgatccgcagcgccgacgccaccccgcacccggtggcatgtcccaccggaagcgccccccccgcccgcatcaccgagggccccccttcgttccaccaactctcaatcgtgcctccccccccgcgg

SEQ ID NO: 22173 - DNA, 819 bp, Zea mays
  misc_feature: Ceres CLONE 1391749-F
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (361)..(361): n is a, c, t, g, unknown, or other
ggtgtgtggtgcccccccccnncnatactccgccccccccccccctggcccccccaaaccttacctccacgcgctgccggccgctctagaaatagtggatcccccgggctgcaggaattcgcacgagaccattacctagaacatcctaatcgaaaaattggaccggacgttgttgctttgcgtcttcgccaaaaacagaataagcttgtcttgctccgatcaggcgtgttcttaggcttcgctgcccctaccgcgtcttcgccgggatcggtccatggccggcgccgagcgcgcggaggcggtcgcgctggaacaagggctcctcgatccggaggaatccaaccaagtagtatacactggnagatggatcagtcgacttttctggaaatccctgttggccaaggaaaagaccgggtagaatggaaggcatggcccattcatattaagctaatgaaatgcctgggaacgaattggccctactatgggcatcttccaacaaaacctttggtaccttccttggaccaaaaaaaactggcatggctggggaaagggcccccccggcccccctcacgaggggggaactaaccaggggcccggcaaaaattgcgaaaatttaaacccccacttttttgggggccaacctccccggggtggaagggcaaacttcggggggggagaggtatgggaacaaaattccgaaaaatttttccccacagattattacttcttctccgcaaaaacaaaccgggggacaccttctttccacaccaacccccctcaagggcgccgggccccccctcctgggggggaaaaacctct

SEQ ID NO: 22174 - DNA, 779 bp, Zea mays
  misc_feature: Ceres CLONE 1391752-F
  misc_feature (12)..(12): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
gggtggggcccncccccccccccccccccccccccctccccccccccaccaacaaccctcaccctcaaccgcggtggcggccgctctaaaatagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagataagtagctagccagcactaccataagggcgtggcaagaatcatgagagagatagcagggcggctagctagctgacctcgtgcgacgaacaatgcccggaattggcaggaaccatgccggcgcccgctcctggtggtcaacctcctcatgtacatcatccccatcnnntttcccgagctggaacccctgaacccctttatccacgggaaatatcaactaccccaacttgggaaggcaaacgccgcagcaatttccaaaattccccgaagcttcacccaatcctgacactcttttgagaggacaacagccgtcaccaactctcaccgccatttggacccaacctgtctccaccacgtggttcccaaaaaaccgaattttggtcatccacacgacccccacccccccactctcacttctaaaaaggaccgcacacccacgcagacaacccaacaactcgcccttcttcttccttg

SEQ ID NO: 22175 - DNA, 663 bp, Zea mays
  misc_feature: Ceres CLONE 1391764-F
  misc_feature: Encodes the peptide sequence at SEQ ID NO. 22176
  misc_feature (263)..(263): n is a, c, t, g, unknown, or other
  misc_feature (397)..(397): n is a, c, t, g, unknown, or other
  misc_feature (398)..(398): n is a, c, t, g, unknown, or other
  misc_feature (410)..(410): n is a, c, t, g, unknown, or other
  misc_feature (432)..(432): n is a, c, t, g, unknown, or other
  misc_feature (513)..(513): n is a, c, t, g, unknown, or other
tccccgcggtggcggccgctctagaactagtggatcccccgggctgcaggaattcgcacgagaccattacctagaacatcctaatcgaaaaaaaaaccccccctgccccagacgtcgcgcgcatgaaatgaaaccctagtgagtagtgaccctgtccggatcactgcgtggcgccgccatggcaccctccgctctggcctccctcccggcgccgctccggtcactgcggctcaagacgaagcagcaggagctactgctccgcngtctcggcgctggcgctcatctacgttctcgccttcgccgtccgcctcttctccgtcctccgctacgagtctatgaatccacgagttcgacccctacttcaattaccgcaccacgctcttccctcacgagacgnnttttagcgagtnctgggaacttggttcgattccngagagctggaacccgctcccggggggggtccggccggggggaatctccttcccgggtctcatggggggacgccggggttgnttccacggccttctccggggggttttccctcggttgccacaattcggggaaggtctggcgtcctcaccggggctttttttcgccggcaaaaccaatttttcgtcgccaaagcctttgggccgcaaaatttggggaccccggggggggggg

SEQ ID NO: 22176 - protein, 57 aa, Zea mays
  misc_feature: Ceres CLONE 1391764-F
  misc_feature (7)..(7): Xaa is any aa, unknown, or other
MGGRRGXFHGLLRGVFPRLPQFGEGLASSPGLFFAGKTNFSSPKPLGRKIWGPRGGG

SEQ ID NO: 22177 - DNA, 668 bp, Zea mays
  misc_feature: Ceres CLONE 1391765-F
  misc_feature: Encodes the peptide sequence at SEQ ID NO. 22178
  misc_feature (318)..(318): n is a, c, t, g, unknown, or other
ggagctcaccgcggtggcggccgctctataactagtggatcccccgggctgcaggaattcgcacgagaccattacctagaacatcctaatcgaaaacttcagtaatcagtgctcgctagcccaccacgccctgaacctagcccggacaccagccagaacaggccatgtccatgggctccccggtgcagctcaggcggctgaagcctctgtaccagttcgtggtgaacaacatcctggccatcgtggccgtgccgctcgccaccgcggtcctgctcaaggcgtcgtcgctcgggcccgaggagatcctggcgctccggncggcgcacctgttcctggccgcgttcctgcctgccgcggccacggtgctgtacctgatgctccggccgcgcacggtgtacctggtggactacgcgtgcttccgcaccagccccaactgccgcgtcccgttcgcgacgttcctggagcacctccccgcgtgcgcccgggcttagacgagcgcaacgcccggctcatgcacgcgccctgctggagcggccgggactccggcgaggacacgtgcccggccgtacccccaaccactacatcccccccgtcccgccgacctgcacctcctcccccgccgaagccccaccatcctcctccttccgcggcaatcgaagaaccctgct

SEQ ID NO: 22178 - protein, 108 aa, Zea mays
  misc_feature: Ceres CLONE 1391765-F
  misc_feature: SWISSPROT Homolog: EC 2.3.1.119 Icosanoyl-CoA synthase
  misc_feature (52)..(52): Xaa is any aa, unknown, or other
MSMGSPVQLRRLKPLYQFVVNNILAIVAVPLATAVLLKASSLGPEEILALRXAHLFLAAFLPAAATVLYLMLRPRTVYLVDYACFRTSPNCRVPFATFLEHLPACARA

SEQ ID NO: 22179 - DNA, 665 bp, Zea mays
  misc_feature: Ceres CLONE 1391769-F
  misc_feature: Encodes the peptide sequence at SEQ ID NO. 22180
  misc_feature (296)..(296): n is a, c, t, g, unknown, or other
  misc_feature (299)..(299): n is a, c, t, g, unknown, or other
  misc_feature (300)..(300): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (320)..(320): n is a, c, t, g, unknown, or other
aaagctggagctccccgcggtggcggccgctctagaactagtggatcccccgggctgcaggaattcgcacgagaccattacctagaacatcctaatcaaaaaacagattagcttaaacacgcgctcgcgtacagcgaagaaatggcgatggcgatgcagccatcttagtcccctaccctgatcccctctccctctccgtctccatggccgcccctcctctggtgtttgtcgccgctgccatagccgcgctcgccatcctcgtcctcgtcctcgttgtcttcgccttccgggatggnggnnggggggggggtggnnnnnanccccgcccgctccaggccgcggcggaggcctcgaccccggtcgctgtccaggaggaggatatatataggcctcttctttccggaaatcgggacgatcactctagacaaagtaattatgtttcttggaagttctgtaggagaaccttcaaagattcaaacaaataggagtaacacttccgcctagaagtcatgcaattgctgatacagggaggacttatccagatgaatgttgtgctacacaaggagaaactcatgtaatcaatattgaaaatgatacttctgaagagtttcgattaagaagcacattaagacggacatcaccagcaaaattgacaacacctgctc

SEQ ID NO: 22180 - protein, 93 aa, Zea mays
  misc_feature: Ceres CLONE 1391769-F
  misc_feature (33)..(33): Xaa is any aa, unknown, or other
  misc_feature (38)..(38): Xaa is any aa, unknown, or other
  misc_feature (39)..(39): Xaa is any aa, unknown, or other
MAAPPLVFVAAAIAALAILVLVLVVFAFRDGGXGGGGXXPRPLQAAAEASTPVAVQEEDIYRPLLSGNRDDHSRQSNYVSWKFCRRTFKDSNK

SEQ ID NO: 22181 - DNA, 659 bp, Zea mays
  misc_feature: Ceres CLONE 1391770-F
tggagctccccgcggtggcggccgctctagaactagtggatcccccgggctgcaggaattcgcacgagaccattacctagaacatcctaatcgaaaaaacggtgtcctgcacttgcacccctatgccgtcgccgcggcggcagcggcattgatctcggcgtacatggtgtggttctgggcgctgacgcgacggctgtccgggccgcggatgtggcccctcgtcggcagcctgcccagcgtcgtcctgaatcgggcgcgggttcacgactggatcgtcgacaacctgcgctccaggggggaagcggtcacgtaccagacgtgcatcttgccgctgccgttcttggcgcggcgcccaggggctggtgaccgtcacgtgcaacccgcggaacctggagcacatcctgcgcgcgcgtttcgacaactaccccaagggccccatgtgggcaggcggcgttccacgatctcctgggccaaggtatcttcaactcccgacgcgagacgtggctgctccagcgcaagacgggcggcgctcgagttcaccacgaggaccttgcgccaggcgatgggcgcgctgggccaaccgcatcacaagtacgggcctgtggagtatcctcgcagaccactgcgagggccgcggcgagcgtcgacctccaggacct

SEQ ID NO: 22182 - DNA, 675 bp, Zea mays
  misc_feature: Ceres CLONE 1391771-F
aaagctggagctccccgcggtggcggccgctctagaactagtggatcccccgggctgcaggaattcgcacgagaccattacctagaacatcctattgaaaaaaaccctaacaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacagctccgccaggttgctgtgtgaagtcccaaggttgtcacatggattcagcacaagatttccaacccaggactttctctataaaggttgtggccaccaactgaaagcacacggatcattgcttgttgacaggatgacaaaacatctggtccacagagtccattttctctcgaaattttcgcctttttgggaaaagcaagaggctcatgagaatgcaaaaacgattgaagaactttgctttggccttgggtgatgggcattttcaaaaggaacaaaaggggggttaggggaaatttcccggtgccccctttttgggcagggaacgggcaaagtgtttgtgtgggaaagtctccaaa

SEQ ID NO: 22183 - DNA, 667 bp, Zea mays
  misc_feature: Ceres CLONE 1391774-F
  misc_feature: Encodes the peptide sequence at SEQ ID NO. 22184
  misc_feature (341)..(341): n is a, c, t, g, unknown, or other
  misc_feature (514)..(514): n is a, c, t, g, unknown, or other
  misc_feature (528)..(528): n is a, c, t, g, unknown, or other
  misc_feature (607)..(607): n is a, c, t, g, unknown, or other
  misc_feature (616)..(616): n is a, c, t, g, unknown, or other
aaagctggagctccccgcggtggcggccgctctagaactagtggatcccccgggctgcaggaattcgcacgagaccattacctagaacatcctaatcgaaaagacaaccccagcgcacgaactccaaaatagcgagccgaagggggccacgagtcctccacctccctctccgccgcgtcgctcgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacgcctccnagttcaccgtgcgggccgacctgggcgccaccgtcggggcgtttaaggcgatcgtcgccgacagctgcgacgtgccggcgccgcagcagcggctgatctacaagggccggatcttgaaggacgagcaaaccctagccaggctacgggtgtggagacagaccatacaatccacntgggtaacggtggntgctgtgccatcaccaacagtctactgcacctgcagccaaccaagaaactaccactgctggctcctgccagtcccgggnacagggaangggggggggggggttggttgcaaggtctggggtactacaggcgtgtgtaaa

SEQ ID NO: 22184 - protein, 136 aa, Zea mays
  misc_feature: Ceres CLONE 1391774-F
  misc_feature (22)..(92): Pfam Name: ubiquitin Pfam Description: Ubiquitin family
  misc_feature (28)..(28): Xaa is any aa, unknown, or other
  misc_feature (90)..(90): Xaa is any aa, unknown, or other
  misc_feature (119)..(119): Xaa is any aa, unknown, or other
MGGGDADAGGEPADAQATLHIRCTNASXFTVRADLGATVGAFKAIVADSCDVPAPQQRLIYKGRILKDEQTLARLRVWRQTIQSTWVTVXAVPSPTVYCTCSQPRNYHCWLLPVPGTGXGGGGVGCKVWGTTGVCK

SEQ ID NO: 22185 - DNA, 658 bp, Zea mays
  misc_feature: Ceres CLONE 1391777-F
  misc_feature: SWISSPROT Homolog: EC 3.5.1.32 Hippurate hydrolase
  misc_feature (316)..(316): n is a, c, t, g, unknown, or other
  misc_feature (361)..(361): n is a, c, t, g, unknown, or other
  misc_feature (365)..(365): n is a, c, t, g, unknown, or other
  misc_feature (485)..(485): n is a, c, t, g, unknown, or other
aaagctggagctccccgcggtggcggccgctctataactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcggaagctgctggacgcggcgcgggagccgaagttcgcgnagtgacagcgcggcgtgcggcgccgaatcccacagcacgcgtagntggncttccaggagcactgcaccagggcgctcgtgcgcgccgagctcgacgcgatcggcgtcccgtacgcctggcccgtcgcgcagacgggcgtcgtgaccaccatcaccggccccgacgcggnccccgtgatcgcgctccgcgacgacatggacgcgctccccatccaggaaatggtagaaggggagttcagaacaaagaagaacggaagatgcatgggtggggccatgacggccacggggcgatgcttcttgaagcagctaggttgctcccgcctcggagggacgatttaaaggg

SEQ ID NO: 22186 - DNA, 686 bp, Zea mays
  misc_feature: Ceres CLONE 1391778-F
  misc_feature (238)..(238): n is a, c, t, g, unknown, or other
  misc_feature (370)..(370): n is a, c, t, g, unknown, or other
  misc_feature (386)..(386): n is a, c, t, g, unknown, or other
  misc_feature (389)..(389): n is a, c, t, g, unknown, or other
tccccgcggtggcggccgctctagaactagtggatcccccgggctgcaggaattcgcacgagaccattacctagaacatcctaatcgaaaaatatagaacgctagctgccggccggagcagaccacgggaggcgcgggcgcgcgctataaaagccgagccagtgggcgcggccagtgtcacaactcacaattcacatcgaggtctcagcttcaggaaagggaaggaagcatgttcggncaccaccaccaccacggccacggcgggcaccaccaggccccgccgccgcacgagcagacgctgttcaggatcttctgccgcgccgacgaggcgtactgcctcacccgtgcgccacgacgccggtcgtctcgnggccaccaccccccgngangagtaccaggcactggtacaagacatgaggccccgcacgaaggggaagggacgggggagggccaagccggggttcggggtaattcaaagggccaccgggccttgccattaaggaatcggttgggaagccccatcccgggggagggggggcccaaacaacgggggaaccggggaacagagtcggtgtttggaaacaaaaaaccccaaacggggggaaaggggtttccctgggacccccgggggaaaaaaaaatcccccctcaatttggggcgcctctccgggggaaggggcaccgggg

SEQ ID NO: 22187 - DNA, 652 bp, Zea mays
  misc_feature: Ceres CLONE 1391781-F
  misc_feature: Translation starting site: 215
  misc_feature: SWISSPROT Homolog: EC 5.1.3.18 GDP-mannose 3,5-epimerase
  misc_feature (453)..(453): n is a, c, t, g, unknown, or other
  misc_feature (488)..(488): n is a, c, t, g, unknown, or other
  misc_feature (536)..(536): n is a, c, t, g, unknown, or other
  misc_feature (550)..(550): n is a, c, t, g, unknown, or other
tggagctccccgcggtggcggccgctctagaactagtggatcccccgggctgcaggaattcgcacgagaccattacctagaacattctaatcgaaaaacaccgcaggacaggagaagcttgggtctcctatcctccccacccctctctcggtctcttccccaccgcgtcttcgtcgtctcgtcttcctgcctccttcgcccgagaaaggagagaatggggagcagcgagaagaccgttaccgcttacggcgagtacacctacgctgagctggagagggagccctactggccgagtgagaagctgaggatttcgattactgggggctggtggtttcattggatcccacattgctcgccgtctgaagaacgagggccattacatcattgcctctgactggaagaagaacgagcacatgaccgaggacatggttctgccatgagttcccacctcgnttgatctcagggtcatgggacaactgtctcaaggncaaccccagggtggtcgaccatgtcttcaatctcgtgcttgatatggngggggaaagggggnttcatccagtcaaatcactcctgtgatcatgtacaacaacaccaatgatcagttttaacatggctggagctgacgtatcatgggggggggggagaaggtctt

SEQ ID NO: 22188 - DNA, 678 bp, Zea mays
  misc_feature: Ceres CLONE 1391783-F
  misc_feature: Encodes the peptide sequence at SEQ ID NO. 22189
  misc_feature (398)..(398): n is a, c, t, g, unknown, or other
  misc_feature (422)..(422): n is a, c, t, g, unknown, or other
  misc_feature (457)..(457): n is a, c, t, g, unknown, or other
  misc_feature (478)..(478): n is a, c, t, g, unknown, or other
  misc_feature (541)..(541): n is a, c, t, g, unknown, or other
  misc_feature (542)..(542): n is a, c, t, g, unknown, or other
  misc_feature (559)..(559): n is a, c, t, g, unknown, or other
  misc_feature (566)..(566): n is a, c, t, g, unknown, or other
  misc_feature (598)..(598): n is a, c, t, g, unknown, or other
  misc_feature (626)..(626): n is a, c, t, g, unknown, or other
  misc_feature (631)..(631): n is a, c, t, g, unknown, or other
  misc_feature (647)..(647): n is a, c, t, g, unknown, or other
tggagctccccgcggtggcggccgctctagaactagtggatcccccgggctgcaggaattcgcacgagaccattacctagaacatcctaatcgaagtatctgaccacgtcacacgacaccaccaccagccctccccttcatcaattggagcacggcgcccgttcattcccctcttctccgctgcttgcctccggctccccaattccacgagatctccaattccaccgcgtcgtctctgcatccggaccccataccccgatcgatccctaaggcccatggttttctccgccgccgcgtcgcctctagtagccaccgctgctgactctgcttcctcctgcgtcgcccacctccgctgctgctgtcgcgttagtgggctgccggttgttgaagacgcgaancctctttagggttcgcgatttctncgctgatcgggttcgagaattggtaaagctatggnatctctcgcggccccacatcngtcggaccctctcgctcgggctcccacttctcacggtcacgcccacgcccacgctcggaaggnnacgcggtagccgcgccngctgcgnctgtccgacggacgcggaggagccgaagccgnaaccgcgtcgtgggccggagaggccgangcggnaaaggaatgaccaagnacgggggcgaccagcactttctccctcctcg

SEQ ID NO: 22189 - protein, 43 aa, Zea mays
  misc_feature: Ceres CLONE 1391783-F
  misc_feature (41)..(41): Xaa is any aa, unknown, or other
MVFSAAASPLVATAADSASSCVAHLRCCCRVSGLPVVEDAXPL

SEQ ID NO: 22190 - DNA, 657 bp, Zea mays
  misc_feature: Ceres CLONE 1391786-F
  misc_feature: Encodes the peptide sequence at SEQ ID NO. 22191
  misc_feature (508)..(508): n is a, c, t, g, unknown, or other
  misc_feature (509)..(509): n is a, c, t, g, unknown, or other
tggagctccccgcggtggcggccgctctagaactagtggatcccccgggctgcaggaattcgcacgagaccattacctagaacatcctaatctaaaaccgttcacttctctttggcccgaaaccgagagctagtgcttgattcggtcgtttttgggcaccgaacacgttcttgggaccgccgccgccgccctacttccagtcccagctgctcaggtctccatcggcctcgagccctttgccggcgacgagcactcacaacaccagggtgtaacaatgtcttcttcaatggaatcgtcataccttcctgctacaactgagtcattagcccaagctcaagaggctaaggatgcttcagagtccatttcaatcctttaccgtgtcattcaggacccatcttcttctgctgatgcactgagaaacaaaagaagttgcaattacaaatcttacaaactacctcactaaagaaaacagagcctgaggagctgcgtaatcttttgacccagtcannacaatttttttgcagttattcctaaggcaagactgcaaaaattggtccgtggaaaaaatggatgctgtcgcccagatacctggaacatcagaatcttcagatttcctctgcagggaaattggtagaatggacccgtgcagagaagcgt

SEQ ID NO: 22191 - protein, 62 aa, Zea mays
  misc_feature: Ceres CLONE 1391786-F
MSSSMESSYLPATTESLAQAQEAKDASESISILYRVIQDPSSSADALRNKRSCNYKSYKLPH

SEQ ID NO: 22192 - DNA, 664 bp, Zea mays
  misc_feature: Ceres CLONE 1391787-F
  misc_feature (568)..(568): n is a, c, t, g, unknown, or other
  misc_feature (569)..(569): n is a, c, t, g, unknown, or other
  misc_feature (596)..(596): n is a, c, t, g, unknown, or other
  misc_feature (622)..(622): n is a, c, t, g, unknown, or other
aaagctggagctccccgcggtggcggccgctctagaactagtggatcccccgggctgcaggaattcgcacgagaccattacctagaacatcctaatcgaaaagacgagaaaaccccacagcctgcacctcggggacgccggcgcggagggatggagtgccacgccctacagtgatttctcccccgctccgatccccggtgcatgaccgggtcggctggcctatgcatcgcagcaggagttggcgtcgattgcccctgcctgccccagttaatcccgcccggtcgcaatccagtattagaggcgccgatctcctgccccgtcctgccctgtggattatcgacagcggcgccggataccacggaagagaaggaagacaaggaaggggtcgaaactaacttgcttgtgccggggcaaggacgagatcgagggcagacgagccgtgacccgaaactctaggcgagattgcaagtgcaggttcccacaatagaagttacccaatgggggtcccggggtaggttctcaccggaaaagacataaatctggttaccaatgttgacatcatcagtgnncctacctggatgttattagagacaatnattcctctgctgctatcaataaaaangatgctgtaataaacatgtctctgtgcaggggaaaatgcatg

SEQ ID NO: 22193 - DNA, 653 bp, Zea mays
  misc_feature: Ceres CLONE 1391789-F
  misc_feature: Translation starting site: 347
  misc_feature: Pfam Name: BTB Pfam Description: BTB/POZ domain
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
aaagctggagctccccgcggtggcggccgctctagaactagtggatcccccgggctgcaggaattcgcacgagaccattacctagaacatcctaatcgaaaacctttcgggcagaaagagccagagagagagagagagagaggtcggggctggggagcacacacccatcacccatggcctgactgacctccggactctccctgcttccgtcgccgccgcgggccgcccagctgactgctcctgccctccgcccgccctccagtggcgtccgtcaagctcggctccaagcctgacgccttcaagcggaagggccaggcatggttctgcacaacaggacttcctagcgatgcacccggtgagggtgggggatatgtctttccaaccttcaccagttccctttactttcaaaaagtggcttttcttgaacggtcaattggaagaaattctgaacaaagaagatgcatcatcaaactaaatgacttcccctgggggtggcaagtcatttgagtannntggaagggtctggctaaggtgggaaaaaaagagctttcacctggaaatggtgctaccccaaggggggggcccagagcatcttaaaaaggccggaagaagtaacctgagaaaaactggatgcgcagtcagaaatggtcttc

SEQ ID NO: 22194 - DNA, 631 bp, Zea mays
  misc_feature: Ceres CLONE 1391790-F
  misc_feature (307)..(307): n is a, c, t, g, unknown, or other
tccccgcggtggcggccgctctagaactagtggatcccccgggctgcaggaattcgcacgagaccattacctagaacatcctaatcgaaaagctttctcgcacaaagacccaaagaaacacactcatcgagcccagcacagaaaagcccacacccatcatccatgtactgatggactccaccactctccctgcttccgccgcggcggaggaccgaccatgtaactgctcctggcctctgcccgtccctccatgtcgtgcgcatgactctgatcaaagcctgacaccttcaactgctggagcagtagnaatgcagcacaacaggacttcctagcgatgtcaccgctgaggatggggatatgtctttccaccttcacaagttccctttactttcaaaaagtgcctttcttgaacgatcaattgaataaattctgaccaagaagaatgcatcatcaaactaaaatgacattcctgggggtgacaagtcatttgagctaagttgcaaggttctgctatggtgtgaaaatagagctttcacctgcaaaatgtgcctacctacggggtgcctcagagcatctagaatgaactgaagaagtagctgacgaaaaactgattgccaagtcagaatgttcc

SEQ ID NO: 22195 - DNA, 672 bp, Zea mays
  misc_feature: Ceres CLONE 1391795-F
  misc_feature: Encodes the peptide sequence at SEQ ID NO. 22196
  misc_feature (390)..(390): n is a, c, t, g, unknown, or other
  misc_feature (396)..(396): n is a, c, t, g, unknown, or other
  misc_feature (397)..(397): n is a, c, t, g, unknown, or other
  misc_feature (440)..(440): n is a, c, t, g, unknown, or other
  misc_feature (465)..(465): n is a, c, t, g, unknown, or other
  misc_feature (480)..(480): n is a, c, t, g, unknown, or other
  misc_feature (556)..(556): n is a, c, t, g, unknown, or other
tggagctccccgcggtggcggccgctctagaactagtggatcccccgggctgcaggaattcgcacgagaccattacctagaacatcctaatcgaaaaacgccaaagatttcctcttccgcctgcgcttccctttgccccgctctcccccagcctcgctcgccatataatacgggccggccggccggccagctgggtccccgcggatgggctcggtctcgcggggctagggtttggtcggtcgtctcgccggcgtcgaggccgccagcgctgctagctagctctctcgcgttagggttccccgtagccatggtgctgcagcgcttctcgtggccgtacggcggccggagcgccaccttctgcggtagcttcaccgggtgggagagagtgcncatggnngctggtttgggggccgtgtttcccaggtcgtcttcgatctggncccccggagtttaccagtacccggnttttgggttgatggnggtctggaaggtgtgatgagaacaaaaccctttgtacgtgatggatatggactgatcagcaatggaagtgcttgtnggaaaacaatgtaccaaccctgttgtgcagccagagccttctatcagaggaactaataaggggataaggggtaccatttttgaaaacaatgccccccggagccatcatctcagaac

SEQ ID NO: 22196 - protein, 62 aa, Zea mays
  misc_feature: Ceres CLONE 1391795-F
  misc_feature (28)..(28): Xaa is any aa, unknown, or other
  misc_feature (30)..(30): Xaa is any aa, unknown, or other
  misc_feature (45)..(45): Xaa is any aa, unknown, or other
  misc_feature (53)..(53): Xaa is any aa, unknown, or other
  misc_feature (58)..(58): Xaa is any aa, unknown, or other
MVLQRFSWPYGGRSATFCGSFTGWERVXMXAGLGAVFPRSSSIWXPGVYQYPXFGLMXVWKV

SEQ ID NO: 22197 - DNA, 616 bp, Zea mays
  misc_feature: Ceres CLONE 1391798-F
  misc_feature: Encodes the peptide sequence at SEQ ID NO. 22198
  misc_feature (573)..(573): n is a, c, t, g, unknown, or other
  misc_feature (616)..(616): n is a, c, t, g, unknown, or other
tggagctccccgcggtggcggccgctctataattccggtatcccccggcactgcaggaattcgctcgaaaccattacctataacatcctaatcgaaaagaaaaggctagccaagaaaacgactggccgcacgaggcttctgtgttctgtgacttctgtccctatccacacgaccccgacattccatgggcgactccggcggaccccaccaccaccgcccttcgccgccgcctctgctggacgccggcaagcgacggcgcatccccaacgtccgcctcggtggctccgtcccgctcccttcccacctgacccacccgcgccgcgtccccattgcccccgccaccaggtcccgcaaacccctccaacttcagcataacagcaaccagcatgaccacccctccgcggagccacccaataccctcctaaaacccttcgtcgacagcggtgacgacgtcgtcttggccgccgcttttccccgcaaggtcaggtccccggcttgaggtactggtgttgtccagctactgccacgatgtgctaatccggtgcggacgcatagtggtcgagacgctcgatngcgctgcggccttcgtgtccaacgtgctcgacgtcgcttcacn

SEQ ID NO: 22198 - protein, 104 aa, Zea mays
  misc_feature: Ceres CLONE 1391798-F
MGDSGGPHHHRPSPPPLLDAGKRRRIPNVRLGGSVPLPSHLTHPRRVPIAPATRSRKPLQLQHNSNQHDHPSAEPPNTLLKPFVDSGDDVVLAAAFPRKVRSPA

SEQ ID NO: 22199 - DNA, 671 bp, Zea mays
  misc_feature: Ceres CLONE 1391800-F
  misc_feature: Encodes the peptide sequence at SEQ ID NO. 22200
  misc_feature (351)..(351): n is a, c, t, g, unknown, or other
  misc_feature (438)..(438): n is a, c, t, g, unknown, or other
  misc_feature (439)..(439): n is a, c, t, g, unknown, or other
  misc_feature (501)..(501): n is a, c, t, g, unknown, or other
  misc_feature (671)..(671): n is a, c, t, g, unknown, or other
ggagctccccgcggtggcggccgctctagaactagtggatcccccgggctgcaggaattcgcacgagaccattacctagaacatcctaatcgaaaaagactagagagagaaacccttgtacccgtgttccttttcatcccccattttctccgagtttccggcccatcgccgagcatcgagtccaaggaagcggagccggcggagaaggggagatttgactttcccgtcgggtgcctagggagcaggagggatgcagcggcggcggggccacacgtgggcaggggtgggggaagacggcccagggcggcggcggcgcacgccgcgctcttctgcttcactctcctcctcgcngctcagggtcgacggacgcaccgcatagctcgctggtgggataatattcagtccactatggctcttttcatgggtattgttgcacgnncggaaggttttcaatgcctggccccttctttgccctcatgggccgtcattgggcaccatggntcattcgattgttgcggcgcctttaactaattgcgttcgagctgcttctttgtatatatcttgaaagcataagagttagaaatcatccatctggtgatcctgaagatggtgttcccttcccctgttggcctttgaagcaataatccttattgacaattttagaatgtgan

SEQ ID NO: 22200 - protein, 42 aa, Zea mays
  misc_feature: Ceres CLONE 1391800-F
  misc_feature (34)..(34): Xaa is any aa, unknown, or other
MQRRRGHTWAGVGEDGPGRRRRTPRSSASLSSSXLRVDGRTA

SEQ ID NO: 22201 - DNA, 674 bp, Zea mays
  misc_feature: Ceres CLONE 1391802-F
  misc_feature: Translation starting site: 166
  misc_feature: Pfam Name: SHMT Pfam Description: Serine hydroxymethyltransferase
  misc_feature: SWISSPROT Homolog: EC 2.1.2.1 Glycine hydroxymethyltransferase
  misc_feature (316)..(316): n is a, c, t, g, unknown, or other
tccccgcggtggcggccgctctagaactagtggatcccccgggctgcaggaattcgcacgagaccattacctagaacatcctaatcaaaaaacctcccaaactcgcgagcgagtcgaggctccaaccccggcacatcacaggaggaggaggacgacgcgcccaccatggccatggcgacggccctccgcaagctctccgccaacgctctgcgccgccagccgctctcccgcatcacgccgctctactacatggcgtcccttccggcgacggaggagagatccggaatcacctggactaagcagttgaacgcgccgnctggaagaggtcgaccccgagattgctgacatcatcgagcacgagaagccgcccaatgggaagggtctggagctcatcccgtcggagattttcacgtcggtgtcagtgatgcaggcagggggtttccgccatgaccaacaggtacaggcgaggggtaccctggggcaggatactacggggggaaatggaggttatggatatggggagaagtccttggggtcgaaacgggctttggaagggcttttcggtttgaacccgggaaaaggggggaggggaaggggcaacctctaatcgcggggcgcccggcaaatttccaggataaaccgggccccttggaagcccacgggaaaggggcttt

SEQ ID NO: 22202 - DNA, 655 bp, Zea mays
  misc_feature: Ceres CLONE 1391803-F
  misc_feature: Encodes the peptide sequence at SEQ ID NO. 22203
  misc_feature (600)..(600): n is a, c, t, g, unknown, or other
  misc_feature (601)..(601): n is a, c, t, g, unknown, or other
  misc_feature (621)..(621): n is a, c, t, g, unknown, or other
  misc_feature (632)..(632): n is a, c, t, g, unknown, or other
aagctggagctccccgcggtggcggccgctctagaactagtggatcccccgggctgcaggaattcgcacgagaccattacctagaacatcctaatcaaaaaaccacgctgtgcctgtgagtgagtcgctcgcatcttccccattctccatcgacgcaccggcgtcgcgacacgtgaacccagcaggaaaggaagctacgatatgtcgacgaccactgcagtgctgcccttgtggcgtgcaggcgggcatgacctacatcggctactccaacttctgcgctgcgttgtgccggaactgcctcaaggagcccttcaagtctgaggccgcgtcccgcgagaaggttcatttctccatctccaagtggacgtatgggaagcaggagaagcccactgtccgcacagaatcgtatgactaagggctggcgcgccatgccgacatagtccttcccacagatgatttgaagcgtcgttgcgagtttctgagacttgttatttacgtggcttgatttgtaatcaatgctgaagaataaatactttttgcgacaatggtctttttacaatgtcgtgttgttttcgttgctaattgcacttgcccttccannatcagcatgtgaactatggnaatgcctcagnttttggggcagttggcaaaaaaa

SEQ ID NO: 22203 - protein, 55 aa, Zea mays
  misc_feature: Ceres CLONE 1391803-F
  misc_feature (1)..(42): Pfam Name: ATP-synt_Eps Pfam Description: Mitochondrial ATP synthase epsilon chain
MTYIGYSNFCAALCRNCLKEPFKSEAASREKVHFSISKWTYGKQEKPTVRTESYD

SEQ ID NO: 22204 - DNA, 789 bp, Zea mays
  misc_feature: Ceres CLONE 1391803-R
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (422)..(422): n is a, c, t, g, unknown, or other
  misc_feature (478)..(478): n is a, c, t, g, unknown, or other
  misc_feature (739)..(739): n is a, c, t, g, unknown, or other
  misc_feature (740)..(740): n is a, c, t, g, unknown, or other
aaaataaaacactcccccccccctacacaannnannnnnnntctaggagatatttcgattaggtaccgggccccccctcgaggtcgacggtatcgatattattttttttttttttttttcctcgaacaagcaggcacatgtgtttacatacaattggtggaactcgcccagtacaaccaaaccaatcttacagggatgtctggacacatttattttcaacgtacagagcacggatgcggggtagcaaattcttaccgctccaaggagggaagattttgcggcatgcagtcacttagataagaatgacatgtattatagggatggccagagccttgtgtttatttgaatggagggtgtttgttcaagtactccatggccacggcggtgtgcaacgaggctccgacgggaagcgaggcctcgtngatgtccacgtgcggggagtgaaggtggtggaccttccccggttgcctcccccccnaacccgcccttgaaaaaaggcggccgggaatccccttgctcgtaaaacccgaaattcctcccgcccccatgaaactggggggcaacaaaatcaagtttgggctccacccaggatggttctccggcccccagctttggcgtggggaatatactgggaatacgtaccttcaaggggggtccggggtccaagccaaaatccccccccctccaattaaggtccacagggaaaggggcaccaacggatcccacaggaaccctcggnncctacgacaccaccctccccaaaaaccccatttccccgaaaaatagaga

SEQ ID NO: 22205 - DNA, 677 bp, Zea mays
  misc_feature: Ceres CLONE 1391806-F
  misc_feature: Translation starting site: 353
  misc_feature (419)..(419): n is a, c, t, g, unknown, or other
  misc_feature (422)..(422): n is a, c, t, g, unknown, or other
  misc_feature (428)..(428): n is a, c, t, g, unknown, or other
  misc_feature (479)..(479): n is a, c, t, g, unknown, or other
  misc_feature (507)..(507): n is a, c, t, g, unknown, or other
aagctggagctccccgcggtggcggccgctctagaactagtggatcccccgggctgcaggaattcgcacgagaccattacctagaacatcctaatcgaaaaattatcgatcccagccccaggccatggcgacgaggtggaggaggtcgctggctctgggtcgccgtcgtccagttcctgaccctgtgcgtcgccgagcatctcgtagtggaagcatacaaaaagtcctacattgtgtatctgggatcacatgcatatggccgtgatgcgtcggcggaggagcatgctcgcgcaacccagtctcaccaccacctcctggcatcgatcctccggcggcgacgacgaccaccaccatgagacgggcgcggcagtccatcttctactcctacaccaagagcagcatcaatgggcttcgcgcgncanctgggnaggagtcggtcgcgcagcagatcgcgagcaccctggaggggggtgggcggntgctggagagcaagatgctcaagctgancaccacgcggtcctggggacttcatggactggaagcgcggacggtcacgtcctcccggggctcatctggaacaacggctagggtcggacaggacgtcatcatcgccagtctcgaaaaggggaagtgttccccgagtcccacagcttccaagacgacggcggccaaggcca

SEQ ID NO: 22206 - DNA, 647 bp, Zea mays
  misc_feature: Ceres CLONE 1391807-F
  misc_feature: Encodes the peptide sequence at SEQ ID NO. 22207
  misc_feature (331)..(331): n is a, c, t, g, unknown, or other
  misc_feature (393)..(393): n is a, c, t, g, unknown, or other
tccccgcggtggcggccgctctagaactagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcantccgagcacgcagctagtaggggaagtatccgagaaaagtgcagattttgctgggggcacgnagcgagaacagttactgcagaagaaagggcaagggtggggaggcgccgaagatgagggagctatcagctctgatggattatttgaatctttggtcgggtccggcatcaccggttgggcgtccccgcaaaagatcggatgcccccgggccgcaggacgggctcctgtgggacaagacggcgggcaggtcgcccaatggtgagtcctccttggccgggggccaggccaataacctatggagggaccataagccggt

SEQ ID NO: 22207 - protein, 67 aa, Zea mays
  misc_feature: Ceres CLONE 1391807-F
MRELSALMDYLNLWSGPASPVGRPRKRSDAPGPQDGLLWDKTAGRSPNGESSLAGGQANNLWRDHKP

SEQ ID NO: 22208 - DNA, 646 bp, Zea mays
  misc_feature: Ceres CLONE 1391810-F
  misc_feature: Translation starting site: 181
  misc_feature (370)..(370): n is a, c, t, g, unknown, or other
  misc_feature (403)..(403): n is a, c, t, g, unknown, or other
  misc_feature (404)..(404): n is a, c, t, g, unknown, or other
  misc_feature (423)..(423): n is a, c, t, g, unknown, or other
  misc_feature (439)..(439): n is a, c, t, g, unknown, or other
  misc_feature (535)..(535): n is a, c, t, g, unknown, or other
  misc_feature (542)..(542): n is a, c, t, g, unknown, or other
ggagctccccgcggtggcggccgctctagaactagtggatcccccgggctgcaggaattcgcacgagaccattacctagaacatcctaatcgaaaaacagaaaagggaccaaatcgaatccgtggtgcactgcccctccccctccctcacaagccgccgccgccgtgaggactccggcgaatggcgtcccgcgtcgcctcgggcctcctccgccgccgcgccgtcgccactctagggctactaaggagtcatacacatgtcagaaactacagcagtcaactttcagctttgattccagctacttctcaatgctcaaatctgacaagaagacgctattacttacctaatccatctctgtaccaagttttgnagtaggtcatttgcctcagacagcggagacagnnttcgaggctgttgtgcccnttcatggggtgaatcntgtaactggatggaactcttgctaacttcttaaagaagcctggagacagaagtcgaggccgatgaacccatagcgcagattgaaactgataaggcnactatgnatgtcgcagtccttgaagctggtgttatttgaaagctcattgctagtgaaggcgacacagttactccaggcactaaagtgcattcatatcccagtctgctcaag

SEQ ID NO: 22209 - DNA, 669 bp, Zea mays
  misc_feature: Ceres CLONE 1391811-F
  misc_feature: Pfam Name: Oxidored_FMN Pfam Description: NADH:flavin oxidoreductase / NADH oxidase family
  misc_feature (312)..(312): n is a, c, t, g, unknown, or other
  misc_feature (386)..(386): n is a, c, t, g, unknown, or other
  misc_feature (463)..(463): n is a, c, t, g, unknown, or other
  misc_feature (474)..(474): n is a, c, t, g, unknown, or other
  misc_feature (497)..(497): n is a, c, t, g, unknown, or other
  misc_feature (553)..(553): n is a, c, t, g, unknown, or other
aaagctggagctccccgcggtggcggccgctctagaactagtggatcccccgggctgcaggaattcgcacgagaccattacctagaacatcctaatcatagcactcgttgctcgccttggtcccaactacccgctccctgtccagcgcccagcgtgcaaccaacacctcccacgagtccgcgacgcgtcagcgtcaccgtccgtcggcgcaaacgaggccagtgtcgattcgctttcaaaccgcactcgccctcctccgttctcttctctccctcctcctatagttggcttctcgcaaccctctgctttcgnagtcagatttctccgctccccatttccctctccaactccaatccatggcctccacggatcgctcccacgccggnggaggacgagcaacagcagaagcgcccgtctctcttctcgccgtaccagatgccccgcttccgctccccaaacgggnttggtgctggncgccgatgaccaggtgcaggcgnccccgacgcggtccaggccccgcggctcgcggagactaccccgcagcggtccacgnaacggcggcttgctcatctccgagggcactttcatctcgccgtccgggccctgggtttccctcgtggtcctgggatatacaatcaaaaaaagactgatgcatggaagaaaaggtgg

SEQ ID NO: 22210 - DNA, 680 bp, Zea mays
  misc_feature: Ceres CLONE 1391816-F
  misc_feature (331)..(331): n is a, c, t, g, unknown, or other
  misc_feature (405)..(405): n is a, c, t, g, unknown, or other
  misc_feature (444)..(444): n is a, c, t, g, unknown, or other
  misc_feature (485)..(485): n is a, c, t, g, unknown, or other
  misc_feature (486)..(486): n is a, c, t, g, unknown, or other
  misc_feature (618)..(618): n is a, c, t, g, unknown, or other
  misc_feature (680)..(680): n is a, c, t, g, unknown, or other
tccccgcggtggcggccgctctagaactagtggatcccccgggctgcaggaattcgcacgagaccattacctagaacatcctaatcgaaaagtagcggttacctccctttcgctctactgctctctctctctctctggaccttgccgttctctccctcgtcggcaatcagcccgcttcctgtgctctctatgctccccttccgttcgtagcctcggccttcgtctccctccatggacccgcgctaaatgcatcgcgagattccaaaccggtagcgtttcttcctgctccatccgccgcaagatgtaagcaagggcctcacttcacacccgngagtgggagaccatccagaatacatcctcagatcgttcttgtgtctgagaaaaaagcgacgcccttccaatggnaggagagcttcgtgggcccttgcggggcatcaagaacgnacctccacggggaggctcgcctgctacaagcaggatggggnncgggaagggtttccgtgccgggtatcaggatcctgggcgccgacgacctacataattcttcgcgtccgcgataccgggtcataatcgttcggggagcaaattggagaggaacactgatggagccctcacggncagtgcagacgttggatcccactgcggctgtgcggcgtaatccactcccattcgtgggaggn

SEQ ID NO: 22211 - DNA, 630 bp, Zea mays
  misc_feature: Ceres CLONE 1391818-F
  misc_feature: Pfam Name: GMC_oxred_N Pfam Description: GMC oxidoreductase
  misc_feature (271)..(271): n is a, c, t, g, unknown, or other
  misc_feature (321)..(321): n is a, c, t, g, unknown, or other
  misc_feature (322)..(322): n is a, c, t, g, unknown, or other
  misc_feature (343)..(343): n is a, c, t, g, unknown, or other
  misc_feature (429)..(429): n is a, c, t, g, unknown, or other
tggagctccccgcggtggcggccgctctagaactagtggatcccccgggctgcaggaattcgcacgagaccattacctagaacatcctaatcgaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctgncgcccagcgtgtcgaatacacaccatcatcgtgggcggcggcacgaccgnntgcccgctggcccgcacgctngtcgagcgcttaagcgtgctgctggctggagagcgacgcctccccctacgacgacgaccgcatcggaggaatggtcccgctcaagnacacgttggcggaaaccttccccggttcggccgggcagcgcttcctggcggaaggatggtttcatcacttacggcccgggggttgttggtcggggacaattttttcacaggggggtttcaaagggggggcggggaaaaaaaattggggggagttcgagagaaccctggaacaccccccgggtgggggacgaggaccttccg

SEQ ID NO: 22212 - DNA, 670 bp, Zea mays
  misc_feature: Ceres CLONE 1391819-F
  misc_feature: Encodes the peptide sequence at SEQ ID NO. 22213
  misc_feature (566)..(566): n is a, c, t, g, unknown, or other
  misc_feature (567)..(567): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (594)..(594): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (619)..(619): n is a, c, t, g, unknown, or other
tggagctccccgcggtggcggccgctctagaactagtggatcccccgggctgcaggaattcgcacgagaccattacctagaacatcctaatcgaaaaaaaaaaaaataaaaatcgcagccaaaacacgcttctcccttcccatcttttcctttcccctcctccctcctcggctcgtctctgttcccctttccctcctgcgcacccgtcttctcctccccgcgtcaaaccccagcacaaaaagctaccgcccgccgcctcctcgttcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaactacgtcaaggcgttccctctctacatgaacgcgctcgagtacttcaaaacccacctcaagtacgagaagaaccccaagatcaaggaggccatcaccgccaagttcaccgagtacctccgccgcgccgaggannatccgggcggtcctcgatgnnnnncgncgcaaggctggnnnccccaaagggntgggccaaaaccaacttgtcgcccacgcgccccaagacagggggccagggg

SEQ ID NO: 22213 - protein, 102 aa, Zea mays
  misc_feature: Ceres CLONE 1391819-F
  misc_feature (5)..(68): Pfam Name: MIT Pfam Description: MIT (microtubule interacting and transport) domain
  misc_feature: SWISSPROT Homolog: EC 2.7.11.1 Non-specific serine/threonine protein kinase
  misc_feature (68)..(68): Xaa is any aa, unknown, or other
  misc_feature (69)..(69): Xaa is any aa, unknown, or other
  misc_feature (75)..(75): Xaa is any aa, unknown, or other
  misc_feature (76)..(76): Xaa is any aa, unknown, or other
  misc_feature (77)..(77): Xaa is any aa, unknown, or other
  misc_feature (78)..(78): Xaa is any aa, unknown, or other
  misc_feature (82)..(82): Xaa is any aa, unknown, or other
  misc_feature (86)..(86): Xaa is any aa, unknown, or other
MYSNFKEQAIEYVKQAVQEDNAGNYVKAFPLYMNALEYFKTHLKYEKNPKIKEAITAKFTEYLRRAEXXPGGPRXXXXQGWXPQRXGPKPTCRPRAPRQGAR

SEQ ID NO: 22214 - DNA, 642 bp, Zea mays
  misc_feature: Ceres CLONE 1391823-F
  misc_feature: Translation starting site: 167
  misc_feature: SWISSPROT Homolog: EC 1.11.1.6 Catalase
  misc_feature (244)..(244): n is a, c, t, g, unknown, or other
  misc_feature (251)..(251): n is a, c, t, g, unknown, or other
  misc_feature (272)..(272): n is a, c, t, g, unknown, or other
  misc_feature (292)..(292): n is a, c, t, g, unknown, or other
  misc_feature (447)..(447): n is a, c, t, g, unknown, or other
tggagctccccgcggtggcggccgctctagaactagtggatcccccgggctgcaggaattcgcacgagaccattacctagaacatcctaatcgaaaagtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtgnaacgacnacgaggcgctgactgtggggnctcgcggcccatcctgctgnaggactaccacctgatcgaggaggtggcgcacttcgcgcgcgagcgcatcccggagcgcgtggtgcacgcgcgcggggcctccggcaagggcttcttcgagtgcaccaccacgtgacgtctcctgacgtgcggcgacttcctgcggcggccgggngtgcggagcccccgggaacgtggcttttccgacggtgatcacgaggggggggtcccccgggaaagattcgcgacccgcggggggtttcccccggaaaattcacacccccggggggggaattgggacccggggggggaaaaaaatttccccgggtttttttattggggggggattcaggttccccccgcgggggcc

SEQ ID NO: 22215 - DNA, 664 bp, Zea mays
  misc_feature: Ceres CLONE 1391824-F
  misc_feature: Encodes the peptide sequence at SEQ ID NO. 22216
  misc_feature (283)..(283): n is a, c, t, g, unknown, or other
  misc_feature (284)..(284): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (425)..(425): n is a, c, t, g, unknown, or other
gctggagctccccgcggtggcggccgctctagaactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgccgnncgggttcgcgggggnnngccccgtcgtacaacagcgtgccaccggccccccgatgagatccagctcgcgaagcagcgcgcgcaggagatccgcggcggcggatctttaacgccgcagaggccaagcgtcctcgcgtcgacnacgggcgacgatgacagcggcgggctttcggtgtaggcctgggcagcactgggtgggcggtggccgcatccgggcggcggaggactcggcttctcgtcctctggccggtggtgggcacgggctttctatcccacaattatcttctcagagcagcgcacctcagtactccctcttatggggggatatcaggaaccagcaaaaagattgaatcccaaaggggaagggttggtggtaatatg

SEQ ID NO: 22216 - protein, 90 aa, Zea mays
  misc_feature: Ceres CLONE 1391824-F
  misc_feature (32)..(32): Xaa is any aa, unknown, or other
  misc_feature (38)..(38): Xaa is any aa, unknown, or other
MADDHYSSKRKYDDPSPPPRRTGFSSGPPPAXRVRGGXPRRTTACHRPPDEIQLAKQRAQEIRGGGSLTPQRPSVLASTTGDDDSGGLSV

SEQ ID NO: 22217 - DNA, 666 bp, Zea mays
  misc_feature: Ceres CLONE 1391825-F
  misc_feature: Encodes the peptide sequence at SEQ ID NO. 22218
  misc_feature (459)..(459): n is a, c, t, g, unknown, or other
  misc_feature (524)..(524): n is a, c, t, g, unknown, or other
  misc_feature (525)..(525): n is a, c, t, g, unknown, or other
  misc_feature (552)..(552): n is a, c, t, g, unknown, or other
  misc_feature (589)..(589): n is a, c, t, g, unknown, or other
  misc_feature (590)..(590): n is a, c, t, g, unknown, or other
  misc_feature (642)..(642): n is a, c, t, g, unknown, or other
  misc_feature (666)..(666): n is a, c, t, g, unknown, or other
tggagctccccgcggtggcggccgctctagaactagtggatcccccgggctgcaggaattcgcacgagaccattacctagaacatcctaatcgaaaacactcgctttccggcgggcgactggcctaaaatcgcctcttgtttgtttgcttccgtcgtcccctctccacgtagagcacgcccccggaccaccttttataagcaccaaccatctggccttgccgcgccgattcgccacgaagccgcactgtgagagagggacgcggcctgttgtcccggcttttagacgcaacttccatcgctgcgaagctatccattcgtgttcgtcatggccgccagcgtcaccgtggaaaacctcaaccccaaggtcttaaaatgggagtatgcagtccggggggggagattgtcatccatgctcagcgcctgcagcaacaactacaacacaaccagggtctcttccntttttgatgagatcctctattgcaacattgggaatccccaatctcttggtcagaacctggaatcnnttcttgggggaaggtcttggctcttgntgatcatccgtgcctcttgggaaaaagaggaaccaannccatgggttcagtgctgatgcaatttctcgagcaaagcagattcttgcaacnaatttcctggaaggggcaacaggn

SEQ ID NO: 22218 - protein, 93 aa, Zea mays
  misc_feature: Ceres CLONE 1391825-F
  misc_feature: SWISSPROT Homolog: EC 2.6.1.2 Alanine transaminase
  misc_feature (45)..(45): Xaa is any aa, unknown, or other
  misc_feature (67)..(67): Xaa is any aa, unknown, or other
  misc_feature (76)..(76): Xaa is any aa, unknown, or other
  misc_feature (88)..(88): Xaa is any aa, unknown, or other
MAASVTVENLNPKVLKWEYAVRGGRLSSMLSACSNNYNTTRVSSXFDEILYCNIGNPQSLGQNLESXLGGRSWLLXIIRASWEKEEPXPWVQC

SEQ ID NO: 22219 - DNA, 666 bp, Zea mays
  misc_feature: Ceres CLONE 1391827-F
  misc_feature: Encodes the peptide sequence at SEQ ID NO. 22220
  misc_feature (297)..(297): n is a, c, t, g, unknown, or other
  misc_feature (353)..(353): n is a, c, t, g, unknown, or other
  misc_feature (354)..(354): n is a, c, t, g, unknown, or other
  misc_feature (542)..(542): n is a, c, t, g, unknown, or other
  misc_feature (552)..(552): n is a, c, t, g, unknown, or other
tggagctccccgcggtggcggccgctctagaactagtggatcccccgggctgcaggaattcgcacgagaccattacctagaacatcctaatcgaaaactcctcttctccagcgtccgatccccgtttcccacgaatcccactctactcctccatctgcggcctcctccatgctcctgcccccttctctctcctccttgcttccccgcgcgcacgtttttacaagggtttcggcggaggcgaccggtcgccgacgatggcggacgacagcggcagccacgagggcggcggcggcggcnggcgacgacgtccgggagcaggacatgttcttgcctattaccaacatcaccggttnnattgaaagaagcccgtcccggccaatgccaagatcactaaggacgctaaggaagataatgcagtactgccgtctccgagttcatattctttgtgacgagcgaggccgagggagaaaagcaaaaaggaggagcgtaagagaaatcaacgtggacgatttggctctggtcagtggatacggcaagaatcngagtacgtgnagcttctcaggatttgcctaacaaagacagaaaaaacggggaagtgcacggtgtacacgaacgtggatcgggttattaacctgtaacacccttagggagaaaacatgaggcact

SEQ ID NO: 22220 - protein, 134 aa, Zea mays
  misc_feature: Ceres CLONE 1391827-F
  misc_feature (62)..(62): Xaa is any aa, unknown, or other
  misc_feature (125)..(125): Xaa is any aa, unknown, or other
  misc_feature (128)..(128): Xaa is any aa, unknown, or other
MLLPPSLSSLLPRAHVFTRVSAEATGRRRWRTTAAATRAAAAAGDDVREQDMFLPITNITGXIERSPSRPMPRSLRTLRKIMQYCRLRVHILCDERGRGRKAKRRSVREINVDDLALVSGYGKNXSTXSFSGFA

SEQ ID NO: 22221 - DNA, 701 bp, Zea mays
  misc_feature: Ceres CLONE 1391830-F
  misc_feature (314)..(314): n is a, c, t, g, unknown, or other
  misc_feature (357)..(357): n is a, c, t, g, unknown, or other
  misc_feature (360)..(360): n is a, c, t, g, unknown, or other
  misc_feature (377)..(377): n is a, c, t, g, unknown, or other
  misc_feature (393)..(393): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
  misc_feature (401)..(401): n is a, c, t, g, unknown, or other
  misc_feature (403)..(403): n is a, c, t, g, unknown, or other
  misc_feature (404)..(404): n is a, c, t, g, unknown, or other
  misc_feature (408)..(408): n is a, c, t, g, unknown, or other
  misc_feature (565)..(565): n is a, c, t, g, unknown, or other
  misc_feature (582)..(582): n is a, c, t, g, unknown, or other
  misc_feature (584)..(584): n is a, c, t, g, unknown, or other
  misc_feature (624)..(624): n is a, c, t, g, unknown, or other
  misc_feature (634)..(634): n is a, c, t, g, unknown, or other
  misc_feature (635)..(635): n is a, c, t, g, unknown, or other
  misc_feature (684)..(684): n is a, c, t, g, unknown, or other
  misc_feature (688)..(688): n is a, c, t, g, unknown, or other
  misc_feature (694)..(694): n is a, c, t, g, unknown, or other
  misc_feature (696)..(696): n is a, c, t, g, unknown, or other
  misc_feature (698)..(698): n is a, c, t, g, unknown, or other
  misc_feature (699)..(699): n is a, c, t, g, unknown, or other
tggagctccccgcggtggcggccgctctagaactagtggatcccccgggctgcaggaattcgcacgagaccattacctagaacatcctaatcgaaaaaagttaacctctcgtgctcgggcactttctttttccttcccccctgtgcgctcggccgcctccgccgctgcctcgctccctccgcgcccaccacggaggcgcacgcgcgggcgcagcgtccctcgcgtgcctcgccttccgcactgctctgtccgcccgcctggctcctgcctcctcctcctcctcctcctctagggttagggaacgctgtcgcggngtgcccgtggcgcccggcgcaatgctggaggccgtcggggggncgncgatgccgacccgccgncagccgcgagatccanntnnctcntnnacgncctccctcccctacgcaggcacaggggctgttccctcgaaggggaccctgggggtctgactcccctggcccgggggcgggggggttccgcccgggggctcgggcggaaccctcccccctccaacggcaagctggaaaaggcccgtggacagaggggncgcccggcgccgccccncnaaatccccccccgcccggcgaacccctctgcggcggcagngggggggggnngacggcgcggcccgggtgggggcggcgcggggcggggggcgtggcgagncccncacggngngnngt

SEQ ID NO: 22222 - DNA, 652 bp, Zea mays
  misc_feature: Ceres CLONE 1391844-F
  misc_feature: Encodes the peptide sequence at SEQ ID NO. 22223
  misc_feature (462)..(462): n is a, c, t, g, unknown, or other
  misc_feature (489)..(489): n is a, c, t, g, unknown, or other
  misc_feature (560)..(560): n is a, c, t, g, unknown, or other
  misc_feature (649)..(649): n is a, c, t, g, unknown, or other
  misc_feature (650)..(650): n is a, c, t, g, unknown, or other
tccccgcggtggcggccgctctagaactagtggatcccccgggctgcaggaattcgcacgagaccattacctagaacatcctaatcgaaaaaattgtaaactgtgatcttccaggctgcaccaactccatctccaggtggaatggagttagcttgcctgcacactcagtcacggtggcgtccctataaggcgtaggcctgacgtcacccacgccctcgcctcgcacggggcggcgcggcggccggcggagggaatggcgaggcgaagcagaggcagcggcagcgtcacggacgcggcgtcgaaggcggacgcggcggcgatgcggatggtgtcccgcaggggcgccgtgcggctggtgctcgtgtcggccaccgcctgggccatgctcgggctcgtcgcgctcgccttccacctccggcatgcagctcccgcgtcgcattcctctcagctctttgcaaaaangacagtaaagttctcctctgtgttggnactcgatggggctctcatccaaaccactccaccgctgcccgaaactggttggcggatgatcaaaatgttgntgtcataccaaagaggactcccacacagtttggggaagaagttggcatatataactggtgacaaccaggataagacccctcacggctgnntg

SEQ ID NO: 22223 - protein, 131 aa, Zea mays
  misc_feature: Ceres CLONE 1391844-F
  misc_feature (70)..(70): Xaa is any aa, unknown, or other
  misc_feature (79)..(79): Xaa is any aa, unknown, or other
  misc_feature (103)..(103): Xaa is any aa, unknown, or other
MARRSRGSGSVTDAASKADAAAMRMVSRRGAVRLVLVSATAWAMLGLVALAFHLRHAAPASHSSQLFAKXTVKFSSVLXLDGALIQTTPPLPETGWRMIKMLXSYQRGLPHSLGKKLAYITGDNQDKTPHG

SEQ ID NO: 22224 - DNA, 641 bp, Zea mays
  misc_feature: Ceres CLONE 1391846-F
  misc_feature (275)..(275): n is a, c, t, g, unknown, or other
  misc_feature (280)..(280): n is a, c, t, g, unknown, or other
  misc_feature (281)..(281): n is a, c, t, g, unknown, or other
  misc_feature (336)..(336): n is a, c, t, g, unknown, or other
  misc_feature (356)..(356): n is a, c, t, g, unknown, or other
  misc_feature (400)..(400): n is a, c, t, g, unknown, or other
  misc_feature (401)..(401): n is a, c, t, g, unknown, or other
tggagctccccgcggtggcggccgctctagaactagtggatcccccgggctgcaggaattcgcacgagaccattacctagaacatcctaatcgaaaagacgagaaaaccccacagcctgcacctcggggacgccggcgcggagggatggagtgccacgccctacagtgatttctcccccgctccgatccccggcgcatgaccgggtcggctggcctatgcatcgcagcaggagttgtcgtcgattgcccctggctgccacagttatcccgccggntcgcnnatcagtattagaggcgccgatctcctgcccccgtctgccctggtggatatcgacngcggcgccgattacacggangaagaggagaaaaagggagggggccgaacttacttggcttgtcnncgggcaagaccaaaattgagggcacccgaaccggtacccgaaaatctaggggggatggcaaggggagggttccccaataagagataaccaatgggtcgggggggggggtttccaaaaaaaagaaattaaacggggtaaaagggtggacctcttcggaatctcccggggggggtttttaaagaaaattttctgggggtggtggcaaaaaaaaaaagtgggaaaaaaaggggttttgggagg

SEQ ID NO: 22225 - DNA, 584 bp, Zea mays
  misc_feature: Ceres CLONE 1391852-F
  misc_feature (202)..(202): n is a, c, t, g, unknown, or other
  misc_feature (254)..(254): n is a, c, t, g, unknown, or other
  misc_feature (336)..(336): n is a, c, t, g, unknown, or other
  misc_feature (436)..(436): n is a, c, t, g, unknown, or other
aagctggagctccccgcggtggcggccgctctagaactagtggatcccccgggctgcaggaattcgcacgagaccattacctagaacatcctaatcgaaaaatctgaagcaaatgtaccgggaatgttgaagagcgggactcttaagcagtagtgagatgcggcggtggtggtcgccggcgttggcggctgtggagccgcgntccgtgcagctcctgctcctgggcgtcgctctcgtcgcagcttctttctacngcggcaccctctttcgctcctccgcgtcccctgcgctcgtactgcccccttcgcgcccccgatcgcccgattccttcagggncaaagatattccagtgtttaccaacagagtttctcgtacgtaccgggcaaatcagtgacagttccagatcacggagttgatgtgtgtcctttggaatacnatggagtatgtcccctggcatgatggagcctatataagcagcttgaagagcctggatacatctagggatggaggatcttggaaagtatttgtcctccatgggaagaaagcggtggtttttgttggcggcccccttcaaagggactaca

SEQ ID NO: 22226 - DNA, 647 bp, Zea mays
  misc_feature: Ceres CLONE 1391853-F
  misc_feature: Encodes the peptide sequence at SEQ ID NO. 22227
  misc_feature (496)..(496): n is a, c, t, g, unknown, or other
  misc_feature (563)..(563): n is a, c, t, g, unknown, or other
  misc_feature (579)..(579): n is a, c, t, g, unknown, or other
  misc_feature (607)..(607): n is a, c, t, g, unknown, or other
aaagctggagctccccgcggtggcggccgctctagaactagtggatcccccgggctgcaggaattcgcacgagaccattacctagaacatcctaatcgaaaaaaaatccccacaaaccgctctctccctctcgcctcccgcccctaattcccatcccccacctccaaatcccacatcactcaaaaccctcgccgcgcccctgctgcgcgcccccccgatggcagccgtcgcgtcctcggaggaggccgtcaaggcggcaaaggtgctgatggtcggagcgggtggcatcggctgtgagctgctcaagacgctcgctctctccggattcagcgacatacacatcattgatttggatacaattgaagttagcaatctgaatagacagtttttgtttcgacagagccatgttgggcaatcaaaagctaaagttgctcgggatgccgtgttgaaatttaggccaaatatcaatataacaccataccatgcgaacgtgaangattctcatttcaatgttgattttttcaagcagtttaatggttgtctgaaatgtcttaataacttgnatgctagacgccatgntaatcgccctttgctttgctgctgaagntcctttggttgaaaagtgtactactggttttttgcaacag

SEQ ID NO: 22227 - protein, 128 aa, Zea mays
  misc_feature: Ceres CLONE 1391853-F
  misc_feature (12)..(129): Pfam Name: ThiF Pfam Description: ThiF family
  misc_feature (93)..(93): Xaa is any aa, unknown, or other
  misc_feature (116)..(116): Xaa is any aa, unknown, or other
  misc_feature (121)..(121): Xaa is any aa, unknown, or other
MAAVASSEEAVKAAKVLMVGAGGIGCELLKTLALSGFSDIHIIDLDTIEVSNLNRQFLFRQSHVGQSKAKVARDAVLKFRPNINITPYHANVXDSHFNVDFFKQFNGCLKCLNNLXARRHXNRPLLCC

SEQ ID NO: 22228 - DNA, 662 bp, Zea mays
  misc_feature: Ceres CLONE 1391860-F
  misc_feature: Encodes the peptide sequence at SEQ ID NO. 22229
  misc_feature (339)..(339): n is a, c, t, g, unknown, or other
  misc_feature (349)..(349): n is a, c, t, g, unknown, or other
  misc_feature (350)..(350): n is a, c, t, g, unknown, or other
  misc_feature (355)..(355): n is a, c, t, g, unknown, or other
  misc_feature (377)..(377): n is a, c, t, g, unknown, or other
  misc_feature (398)..(398): n is a, c, t, g, unknown, or other
  misc_feature (407)..(407): n is a, c, t, g, unknown, or other
  misc_feature (418)..(418): n is a, c, t, g, unknown, or other
  misc_feature (647)..(647): n is a, c, t, g, unknown, or other
caaagctggagctccccgcggtggcggccgctctagaactagtggatcccccgggctgcaggaattcgcacgagaccattacctagaacatcctaatcgaaaaacccgagaatcctcgcgctggcgcactccaaattcctcgcccccacgccggttcgaccgttgccaatctccccgcgcgcacgcgctctccatctcgcgatccccaccccgagccgcgagcactttcccgggcgggggcgtatggcctgcgccgcgacgatgccgatcgacttactccccgctccagccccggcggaggaggaggtgaaggcggttgaggaggacgaggagatggtnggtggagggnnagggnaagaaagggtgcggcgaagggncccgtgggtggtgggccgtgncgaacgcgnaaggcggaggntcacccctacgacttccacgtggtccgggccgcgcaacctgccaccgcccaactggaaggacataatcagggtcgagctggaagggtccaaattacaaaaggatgggagatgggctgcttcattcaagcagtctacctgcttgaactggacaggcaggaccagaaaaggcgaagaggatggccttgctccaaaatggtggaaaccccttcaatacaggtcacacagacnttggggggatgaaaa

SEQ ID NO: 22229 - protein, 133 aa, Zea mays
  misc_feature: Ceres CLONE 1391860-F
  misc_feature (30)..(30): Xaa is any aa, unknown, or other
  misc_feature (32)..(32): Xaa is any aa, unknown, or other
  misc_feature (39)..(39): Xaa is any aa, unknown, or other
  misc_feature (46)..(46): Xaa is any aa, unknown, or other
  misc_feature (49)..(49): Xaa is any aa, unknown, or other
  misc_feature (53)..(53): Xaa is any aa, unknown, or other
  misc_feature (129)..(129): Xaa is any aa, unknown, or other
MPIDLLPAPAPAEEEVKAVEEDEEMVGGGXGXERVRRRXPWVVGRXERXRRRXTPTTSTWSGPRNLPPPNWKDIIRVELEGSKLQKDGRWAASFKQSTCLNWTGRTRKGEEDGLAPKWWKPLQYRSHRXWGDE

SEQ ID NO: 22230 - DNA, 638 bp, Zea mays
  misc_feature: Ceres CLONE 1391861-F
  misc_feature (396)..(396): n is a, c, t, g, unknown, or other
  misc_feature (499)..(499): n is a, c, t, g, unknown, or other
tggagctccccgcggtggcggccgctctagaactagtggatcccccgggctgcaggaattcgcacgagaccattacctagaacatcctaatcgaaaaaaaacaggcacaggctccctcctccactgtccagtgtccactcctcgtcccgagaagcagacaaagcgcggcgctgcagatttcggtacggttcccaatgcctcccatgcccgccgtcgtcccgtgctagcacccggcgccgctcctccacctgccgcgtcgcgccgcctggatccggcgggcacgtggctaggagcctcagatccgggcgaaacccagccttccgtgcggacgtcttcactctacctccagactggcggctgccatttccccccctcttcttgctgtttttttttggngggggtggggggtggaatctgcggtggagtcttgccgtcgctcgctgtaaacgtagagctctctctctctcttggcgagtaatcctgggtcttgctccatttnccgtgtagtgctggcgtgtgagtggcaagttttacgtgtaggattgtggaaacagtcctgagcagctggccccgggagtcgtcggcctccggggactcggaacatgcagcagggggcgcggcatacagggacgagcagt

SEQ ID NO: 22231 - DNA, 714 bp, Zea mays
  misc_feature: Ceres CLONE 1391863-F
  misc_feature: Encodes the peptide sequence at SEQ ID NO. 22232
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (368)..(368): n is a, c, t, g, unknown, or other
  misc_feature (377)..(377): n is a, c, t, g, unknown, or other
  misc_feature (547)..(547): n is a, c, t, g, unknown, or other
  misc_feature (579)..(579): n is a, c, t, g, unknown, or other
  misc_feature (608)..(608): n is a, c, t, g, unknown, or other
  misc_feature (623)..(623): n is a, c, t, g, unknown, or other
  misc_feature (643)..(643): n is a, c, t, g, unknown, or other
  misc_feature (648)..(648): n is a, c, t, g, unknown, or other
  misc_feature (669)..(669): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (714)..(714): n is a, c, t, g, unknown, or other
aaagctggagctccccgcggtggcggccgctctagaactagtggatcccccgggctgcaggaattcgcacgagaccattacctagaacatcctaatcgaaaactccgacccgcagcagcgcctccattgctctctctcacgagtcccggcgttccagtggggggcattcatggcggggcagtccgacccgcacctctccatcttctcgccctccgaggtggagttcgtggctgaggatgagattgtcgaaatcgtccccaacatccgcatggacgccctcaacatgatctgcggggatttcgggcccttcttcccccagattcccacagggtgcctctccgggggggctcgttgnnnnnnntnnnnangcgcaggcnggtggcggcgggctgccccccggtcctggttgtctggctgtccgccttggcggccgtcgttcgtccgtccccttccggtcgtcgttccggggacttccccgctcctgcgcccttctctctggtgtcggacgtgtcggccggggtcctgcttcgttccctcggcggccgtnggtcctcctcccctcgcccttccggggggggntttcggctcctttttgtcttggggccccnttggtccgggtgtcnccggccccccttttcggggntgggnccccgggggtttcggggcttncggtcggcccggggtttcgggggggccnnnngggggccccttctn

SEQ ID NO: 22232 - protein, 181 aa, Zea mays
  misc_feature: Ceres CLONE 1391863-F
  misc_feature (62)..(62): Xaa is any aa, unknown, or other
  misc_feature (63)..(63): Xaa is any aa, unknown, or other
  misc_feature (64)..(64): Xaa is any aa, unknown, or other
  misc_feature (65)..(65): Xaa is any aa, unknown, or other
  misc_feature (66)..(66): Xaa is any aa, unknown, or other
  misc_feature (67)..(67): Xaa is any aa, unknown, or other
  misc_feature (70)..(70): Xaa is any aa, unknown, or other
  misc_feature (137)..(137): Xaa is any aa, unknown, or other
  misc_feature (147)..(147): Xaa is any aa, unknown, or other
  misc_feature (152)..(152): Xaa is any aa, unknown, or other
  misc_feature (160)..(160): Xaa is any aa, unknown, or other
  misc_feature (167)..(167): Xaa is any aa, unknown, or other
  misc_feature (177)..(177): Xaa is any aa, unknown, or other
MAGQSDPHLSIFSPSEVEFVAEDEIVEIVPNIRMDALNMICGDFGPFFPQIPTGCLSGGARXXXXXXAGXWRRAAPRSWLSGCPPWRPSFVRPLPVVVPGTSPLLRPSLWCRTCRPGSCFVPSAAVGPPPLALPGGXFGSFLSWGPXGPGVXGPPFRGWXPGGFGAXGRPGVSGGPXGGPF

SEQ ID NO: 22233 - DNA, 662 bp, Zea mays
  misc_feature: Ceres CLONE 1391864-F
  misc_feature: Encodes the peptide sequence at SEQ ID NO. 22234
  misc_feature (364)..(364): n is a, c, t, g, unknown, or other
  misc_feature (397)..(397): n is a, c, t, g, unknown, or other
  misc_feature (417)..(417): n is a, c, t, g, unknown, or other
  misc_feature (466)..(466): n is a, c, t, g, unknown, or other
  misc_feature (537)..(537): n is a, c, t, g, unknown, or other
  misc_feature (543)..(543): n is a, c, t, g, unknown, or other
  misc_feature (636)..(636): n is a, c, t, g, unknown, or other
aaagctggagctccccgcggtggcggccgctctagaactagtggatcccccgggctgcaggaattcgcacgagaccattacctagaacatcctaatcgaaaactacatgccaaatctggaggcaagagaaccgggagagggcgtgttgggttgctcgtcgtgatcccggacggcaatacctgcccttgcctacttgccactgcttgcgtacactgatgtccttgttcaatcccctctagaaagtagaaacattgcttaattggcttggctattgctgttagctccacacaaaagagagaaccggcggcgagctaggagctagccatggacggacacggcgcggtctcaccgtggagcgtgctangcggggcggcggctgtgctgctcctgtggttgncgtccaggtggctgaggggncccctggtgggcgccccggcgcgtgaaccgtgcgctgagggcgcagggncctgagggggcacccggtaccgcctcctctggcgcgaccctcatcgaggagcagcgtctcccgcgcgcggncctggncaggcccgtccccccgtggatcggccacacgacttcgtccctcgcgtcgcggctttcctttcacgcgtcctccaggagcacggaaagtctcgntttaacagggtttgggccgaacccca

SEQ ID NO: 22234 - protein, 47 aa, Zea mays
  misc_feature: Ceres CLONE 1391864-F
  misc_feature (14)..(14): Xaa is any aa, unknown, or other
  misc_feature (25)..(25): Xaa is any aa, unknown, or other
MDGHGAVSPWSVLXGAAAVLLLWLXSRWLRGPLVGAPAREPCAEGAG

SEQ ID NO: 22235 - DNA, 671 bp, Zea mays
  misc_feature: Ceres CLONE 1391869-F
  misc_feature: Translation starting site: 156
  misc_feature: SWISSPROT Homolog: EC 2.3.3.1 Citrate (Si)-synthase
  misc_feature (1)..(1): n is a, c, t, g, unknown, or other
  misc_feature (286)..(286): n is a, c, t, g, unknown, or other
  misc_feature (360)..(360): n is a, c, t, g, unknown, or other
  misc_feature (397)..(397): n is a, c, t, g, unknown, or other
  misc_feature (400)..(400): n is a, c, t, g, unknown, or other
  misc_feature (402)..(402): n is a, c, t, g, unknown, or other
  misc_feature (508)..(508): n is a, c, t, g, unknown, or other
  misc_feature (616)..(616): n is a, c, t, g, unknown, or other
naaagctggagctccccgcggtggcggccgctctagaactagtggatcccccgggctgcaggaattcgcacgagaccattacctagaacatcctaatcgaaaaattttgcttggctgctgctcccttctcccaccgaccaactcgatcccgcgccatggatcgcgccgaccccgcgcggggccgccttgccgtgctctcctcccacctccgtggtgcaggggccgaggaggcgacggatctggagaggtcgtcgatatccgcgccggcgcccggtccccgcgccgncgcgcttggcgtggtgaacggtaggaccgtaaagcgtcacgatgtcaaggtctccgaagacggcaccgtgcgcngcaccgacttctagatgataccagctggaaggacgancangntcttaagaattatgatgctggttaccttagcactggccctggtcgctcgtcatctgctacatcgatggagatgagggaatcctccggtatagggggtatcccatcnaagaatggctgaaagcaggtcggtttggttgggtggactaccttttaagggatggggaccttgcctactcaaaatcaatgggaaggcttgggaatttgcatttctcancatgctgctggtccccaaaggaatggtggaaataaataaaaccaagggcccatgg

SEQ ID NO: 22236 - DNA, 635 bp, Zea mays
  misc_feature: Ceres CLONE 1391870-F
  misc_feature: Encodes the peptide sequence at SEQ ID NO. 22237
  misc_feature (351)..(351): n is a, c, t, g, unknown, or other
  misc_feature (406)..(406): n is a, c, t, g, unknown, or other
aaagctggagctccccgcggtggcggccgctctagaactagtggatcccccgggctgcaggaattcgcacgagaccattacctagaacatcctaatcgaaaaaaggccgcaacagcaagggcagcactgccgaaaccgcaggccgcagcactcgagagcgcagccaggcggcggcgctccgcctccgactccacaccaggccgctgcgtccatggacccctccccgcagtcgacgccgcccaccggagacgacccggcagcggcggcggatcccgacctaccgaggctcacggtgacgcaggtggagcagatgaaggtggaggccaggggtggcgacatctaccgctcccntctcggggccgcgcccaacacgaaatccatcatgctagagctgtggcgtgatcancatatcgagtatctgacgcctgggctgaggcatatgggaccagcctttcatggtctagatgccaatcgccctggctatgctactgggatggtcatccacttgcttgggctgaaggacgacttgatgatgatctttgaaaggaaatcctaaacttcttactcgaggcaggaaaagggggggaaaaagggggggggaccgggagggtgccccacccaatacgaattaggtg

SEQ ID NO: 22237 - protein, 114 aa, Zea mays
  misc_feature: Ceres CLONE 1391870-F
  misc_feature: SWISSPROT Homolog: EC 2.5.1.58 Protein farnesyltransferase
  misc_feature: The sequence is a functional homolog of SEQ ID NO 12 in US patent 7109391
  misc_feature (47)..(47): Xaa is any aa, unknown, or other
  misc_feature (65)..(65): Xaa is any aa, unknown, or other
MDPSPQSTPPTGDDPAAAADPDLPRLTVTQVEQMKVEARGGDIYRSXLGAAPNTKSIMLELWRDXHIEYLTPGLRHMGPAFHGLDANRPGYATGMVIHLLGLKDDLMMIFERKS

SEQ ID NO: 22238 - DNA, 676 bp, Zea mays
  misc_feature: Ceres CLONE 1391871-F
  misc_feature: Encodes the peptide sequence at SEQ ID NO. 22239
  misc_feature (312)..(312): n is a, c, t, g, unknown, or other
  misc_feature (317)..(317): n is a, c, t, g, unknown, or other
  misc_feature (320)..(320): n is a, c, t, g, unknown, or other
  misc_feature (323)..(323): n is a, c, t, g, unknown, or other
  misc_feature (324)..(324): n is a, c, t, g, unknown, or other
  misc_feature (368)..(368): n is a, c, t, g, unknown, or other
  misc_feature (371)..(371): n is a, c, t, g, unknown, or other
  misc_feature (388)..(388): n is a, c, t, g, unknown, or other
  misc_feature (389)..(389): n is a, c, t, g, unknown, or other
  misc_feature (527)..(527): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaagatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacggnagtgncgncgnnaggcgcgctccctcgaccatcgcgggcatcgtcacctcactcgncgnaggccctgcagcggtgnngatcgtgcggatctccggccccgatggcgtcgccgtcgccgaccgcgtttcccgccaggcgggaccaggagggcgtcgacgccgtggcaaccgcgcagccactttggtggagaaggactcgcgctcgaaggggaaggnagggttattgaggaggttttggggggcgccaatgctccccccgagggcctaaccggggagaggatgtgggggaagcttcagggccttggcaaccatccccggcttgggccgcggggcccttcgtttggtttggaaantggaggcccaaa

SEQ ID NO: 22239 - protein, 156 aa, Zea mays
  misc_feature: Ceres CLONE 1391871-F
  misc_feature (70)..(70): Xaa is any aa, unknown, or other
  misc_feature (71)..(71): Xaa is any aa, unknown, or other
  misc_feature (72)..(72): Xaa is any aa, unknown, or other
  misc_feature (87)..(87): Xaa is any aa, unknown, or other
  misc_feature (88)..(88): Xaa is any aa, unknown, or other
  misc_feature (94)..(94): Xaa is any aa, unknown, or other
  misc_feature (140)..(140): Xaa is any aa, unknown, or other
MARAAARLLPIFLPWRRPPPPCLLRRGFLNPSSPRTSARVDTLVLPGDERLPFPSPPRLPNQLRPDYGSXXXRRAPSTIAGIVTSLXXGPAAVXIVRISGPDGVAVADRVSRQAGPGGRRRRGNRAATLVEKDSRSKGKXGLLRRFWGAPMLPPRA

SEQ ID NO: 22240 - DNA, 655 bp, Zea mays
  misc_feature: Ceres CLONE 1391873-F
  misc_feature: Encodes the peptide sequence at SEQ ID NO. 22241
  misc_feature (253)..(253): n is a, c, t, g, unknown, or other
  misc_feature (261)..(261): n is a, c, t, g, unknown, or other
  misc_feature (297)..(297): n is a, c, t, g, unknown, or other
  misc_feature (341)..(341): n is a, c, t, g, unknown, or other
  misc_feature (415)..(415): n is a, c, t, g, unknown, or other
  misc_feature (484)..(484): n is a, c, t, g, unknown, or other
  misc_feature (497)..(497): n is a, c, t, g, unknown, or other
  misc_feature (507)..(507): n is a, c, t, g, unknown, or other
  misc_feature (549)..(549): n is a, c, t, g, unknown, or other
  misc_feature (553)..(553): n is a, c, t, g, unknown, or other
  misc_feature (570)..(570): n is a, c, t, g, unknown, or other
aaagctggagctccccgcggtggcggccgctctagaactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagcgngggctagncggtggcggcgtgcctgtccctgcgcggcgtgcggncgctggtcctggagcgcgacgactgcgtggggtcgctgtggcgnaagcgcgcctacgaccgcctccacctccacctcaccaagaagtactgcgcgctgccgcacgcgccgcacccggncgaggcccccgcgtacctgcaccgcgacgacttcgcgcggtacctggacggtaacgccggcgcggttcngccgtcgcccgcngctcccgcgngaggtccgggtcggcgcgggtacgaccccgcgagcgcgccgntggnaaagtggaagcccctgnacctcgggcacgggccaggggcggagggggaccgcgggggagggttcctgggtgggccccggtccgggggaaaaacccccaaaaa

SEQ ID NO: 22241 - protein, 88 aa, Zea mays
  misc_feature: Ceres CLONE 1391873-F
  misc_feature (20)..(20): Xaa is any aa, unknown, or other
  misc_feature (32)..(32): Xaa is any aa, unknown, or other
  misc_feature (47)..(47): Xaa is any aa, unknown, or other
MAAVAEEEVIVVGAGQRGLXGGGVPVPARRAXAGPGARRLRGVAVAXARLRPPPPPPHQEVLRAAARAAPGRGPRVPAPRRLRAVPGR

SEQ ID NO: 22242 - DNA, 683 bp, Zea mays
  misc_feature: Ceres CLONE 1391875-F
  misc_feature: Encodes the peptide sequence at SEQ ID NO. 22243
  misc_feature (496)..(496): n is a, c, t, g, unknown, or other
  misc_feature (506)..(506): n is a, c, t, g, unknown, or other
  misc_feature (531)..(531): n is a, c, t, g, unknown, or other
  misc_feature (551)..(551): n is a, c, t, g, unknown, or other
aaagctggagctccccgcggtggcggccgctctagaactagtggatcccccgggctgcaggaattcgcacgagaccattacctagaacatcctaatcgaaaaacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaactgctaggaagatgatccgatctacggaaggctgtgcaaagagcattactttcgagaggaacaacaaatcagacgctgtgcagcttcacgatctgccgaatgacgtcctaggtagcatactatcacggttgacattcagagaatcctcacagatgggccttgtttctcatacctgggcggcggctggtggaagaagctgttgcccggaaactggntcttcaccangtgccaccatgttccaacccggganataggagcatcaaacatacnagggacaactttggcatgaggagtcaaacagttttcttgcgtcagctacacactcatctactcctttaaaagaagttggggaaaaataaaagtttgggggctggcgcaaggaagcacaactcgccatgtcaa

SEQ ID NO: 22243 - protein, 94 aa, Zea mays
  misc_feature: Ceres CLONE 1391875-F
  misc_feature (87)..(87): Xaa is any aa, unknown, or other
MAKQKEGVDKRTARKMIRSTEGCAKSITFERNNKSDAVQLHDLPNDVLGSILSRLTFRESSQMGLVSHTWAAAGGRSCCPETGSSPXATMFQPG

SEQ ID NO: 22244 - DNA, 679 bp, Zea mays
  misc_feature: Ceres CLONE 1391881-F
  misc_feature: Translation starting site: 289
  misc_feature (343)..(343): n is a, c, t, g, unknown, or other
aaagctggagctccccgcggtggcggccgctctataactagtggatcccccgggctgcaggaattcgcacgagaccattacctagaacatcctaatcgaaaagtggcttctcattcattgttgattgattgatcctccccgcctcactcctttgtctcctcgcctcgtgctcgctcgctcccctcgccctggcgaggagggcagcagaaaccctagcggctcaggccgggcggggttagatgctccaaggttcgagagggaaggtaggttagtggtgcgccatcgactatgggctgcgtcttccgccgggcggctgcgtcgtcctctggcagcgcgaaaaagnaagtgggaaaggggaagtctctcccgcaagcccgaaggggggtcgccctccgcagtccccggccacgacgggggacggaaggccgggccggcggttcgggggccccagggcctccggaaccaagaagggttgggtccccggggttgccgcggaagaagaagatcccccccggttggccccacttggatcccccaaaacccccgggaaaggccctccgcgggtggggacacccccccccaccaaaaggcttccaaaacctatacaaccacaggggccggggccccaaccgcccaagggggaaccggccgaaaggaaacccccttcctgtgtgaggat

SEQ ID NO: 22245 - DNA, 776 bp, Zea mays
  misc_feature: Ceres CLONE 1391882-F
  misc_feature (18)..(18): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (52)..(52): n is a, c, t, g, unknown, or other
  misc_feature (397)..(397): n is a, c, t, g, unknown, or other
ggttgttggggtacgggntccagcgccccgcactaaanannnnntnnnncnnccaagctggggctccccgcggtggcggccgctctttaatagtggatcccccgggctgcaggaattcgcacgagaccattacctagaacatcctaatcgaaaaacacaaaaacccagcatcagtcaagctcgctcacacgaccatggtcgcggcgatgaccggtagtactcgcgccagcggcggctccttcctcgtgcttctctttgtcgtggtggccggtgtcgtcgacgtcgcgtccgctgccaccactgcggcgagtgctactgttgccactaacagcggtgacagcaacgcggtggcgcttctgacgatgccggcgtcggcgtccacggggcagctgaatantgctccagctcggccccccctctgcacaacacgcggcagggaccgcttctccccacgggcccggcatggctcaccccccgtagctcccccccggccacatctggccggcaactccccagcggaggaggggcggccccatcccggcgcccacggaggtccccccccccacacccccacacacggaaaaagaggaggggtcaccaaaggggataatggcggtaaagggcgccccacggggggaagggagccttcacccccaacagggcggagagccacccgccctctctcgaacaccgcgccccgccaccctgagacgcgccgacagccggtcctaaagcgtttcggagcgctaccggaaagcccaccacgcacgcaaccg

SEQ ID NO: 22246 - DNA, 648 bp, Zea mays
  misc_feature: Ceres CLONE 1391884-F
  misc_feature: Encodes the peptide sequence at SEQ ID NO. 22247
  misc_feature (350)..(350): n is a, c, t, g, unknown, or other
  misc_feature (385)..(385): n is a, c, t, g, unknown, or other
  misc_feature (396)..(396): n is a, c, t, g, unknown, or other
  misc_feature (421)..(421): n is a, c, t, g, unknown, or other
  misc_feature (433)..(433): n is a, c, t, g, unknown, or other
tggagctccccgcggtggcggccgctctagaactagtggatcccccgggctgcaggaattcgcacgagaccattacctagaacatcctaatcgaaaaccattaagtttttatcgcttcgttatttctctgttgtgcttgtcttgttcttttgttgctctaaccatggacgcaggctcccgctcgatctcctcggagaagaaccgcgccgccgccgcgccccggccgccgctgcaggaggcgggctcccgcccctacatgccatcgctgagctcgggaccccgcaacccgtcggccaagtgctacggcgacaggttcatcccggacaggtcggcgatggacatggacttgncgcactacttgcttactgagccccaggaggacaangagaacgcgtncggcatggcggcgtccccgtccaanggagcgtaccgnaggctgctcgccgagaagctgctcaacaacgggacacggatcctcgctttcaggagcaagcccgcggagcccgagacgtttcttttgcggacacgacttcctccagctgcaggccaagccggccaaacagcgtcgccacattccccagtctgccgagaggaccctagacgcacagagctaggtgacgactactacctcaacttgcttgactggga

SEQ ID NO: 22247 - protein, 161 aa, Zea mays
  misc_feature: Ceres CLONE 1391884-F
  misc_feature (63)..(63): Xaa is any aa, unknown, or other
  misc_feature (74)..(74): Xaa is any aa, unknown, or other
  misc_feature (78)..(78): Xaa is any aa, unknown, or other
  misc_feature (86)..(86): Xaa is any aa, unknown, or other
MDAGSRSISSEKNRAAAAPRPPLQEAGSRPYMPSLSSGPRNPSAKCYGDRFIPDRSAMDMDLXHYLLTEPQEDXENAXGMAASPSXGAYRRLLAEKLLNNGTRILAFRSKPAEPETFLLRTRLPPAAGQAGQTASPHSPVCREDPRRTELGDDYYLNLLDW

SEQ ID NO: 22248 - DNA, 663 bp, Zea mays
  misc_feature: Ceres CLONE 1391885-F
  misc_feature: Pfam Name: IFRD Pfam Description: Interferon-related developmental regulator (IFRD)
  misc_feature (499)..(499): n is a, c, t, g, unknown, or other
gctggagctccccgcggtggcggccgctctagaactagtggatcccccgggctgcaggaattcgcacgagaccattacctagaacatcctaatcgaaaatcgagaggaacggcccccgcttctatttatccggcccttgtccctgcgccgacccgcgttgccccagtcccgatctcgccgcccccttctcctcccttcgcgtccatcgcacccgctcctgatcccgcttgcttgctctggttctgcttccgccgtttgtctcgcgggtcctgggagctcctgagccctggttctgtctctagcctgtcttgccatggggaagagcaagaagagcaaggcccgcggcggcagggacgacctgctcgacagcagcgacgccgacagcgtcagctcctcgtccacccgcactgtcggatctctccatctcgtacgctaccgagcacgtcaactcgcagtaattcgttcctggacaagtacatcgacggcgctctacgagaangagggggtctaaccagagaggaagcatttggtaaactggttgatgcctttgaaaagttttatgctccatggccctgggggaggacaagtatgccacctctgaggagtcaaataaaataattcccgggaaaaaggggatctacctaagggaggttttttctgggc

SEQ ID NO: 22249 - DNA, 673 bp, Zea mays
  misc_feature: Ceres CLONE 1391888-F
  misc_feature: Encodes the peptide sequence at SEQ ID NO. 22250
  misc_feature (184)..(184): n is a, c, t, g, unknown, or other
  misc_feature (187)..(187): n is a, c, t, g, unknown, or other
  misc_feature (252)..(252): n is a, c, t, g, unknown, or other
aaagctggagctccccgcggtggcggccgctctagaactagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggnggnatctccatccactcccccctcgcccccctccactggtgctacttctagaagcgctggtgccaggncaggcggtatcccggccgctgggcgctgcgcgagagttgtttgtgggtgatgtcagcccccctccctctcaggttagggtggaacgatcctggcaggcaacgcggggtgcgtgacccaaaaagaaacccgccgccttttttttctcgggcgccgcgtttttcaacccctcctaaacttattcggccgcgccggacaataaacaaaaagggccccgctttttttttcccctttccccaggcccggggtggggtttggttgggccccccccccccctttttaattaaacaggggtctttccgggggggggggggccccattgggaaagtgggggggaaaaaaaaaatttcaaaacccctccccgggggggctcccccccggggagggggggcccaaatgtgagaaaaaaaaagggggcggccc

SEQ ID NO: 22250 - protein, 41 aa, Zea mays
  misc_feature: Ceres CLONE 1391888-F
  misc_feature (3)..(3): Xaa is any aa, unknown, or other
  misc_feature (4)..(4): Xaa is any aa, unknown, or other
  misc_feature (26)..(26): Xaa is any aa, unknown, or other
MAXXSPSTPPSPPSTGATSRSAGARXGGIPAAGRCARVVCG

SEQ ID NO: 22251 - DNA, 655 bp, Zea mays
  misc_feature: Ceres CLONE 1391889-F
  misc_feature: SWISSPROT Homolog: EC 2.7.11.1 Non-specific serine/threonine protein kinase
tggagctccccgcggtggcggccgctctagaactagtggatcccccgggctgcaggaattcgcacgagaccattacctagaacatcctaatcgaaaaataccgaaaggggtaggagagtgagcagccagagaacagggaggtagagaggaggaggaggtagaaggcgaaagaaggggaaccaaatcttggacgggaacacatagatttctttggtggaggaaggaggagggcaacaagaggaggttacaggtagcccaatagatctactgctgttgagggagttgatgcaaagctgagttgctgcgcgttggctttctttagagatggcttcagctggtgttgccccttctgggtacaagaacagcagcagcaccagcattggtgccgaaaagttgcaagatcacatgaacgagctaaagattagagatgatagggaagttgaagcaaccataattagtggggaaagggaccgaaactgggcacataattgtcaccactactggtgggcagaatggtcaaccaaaacagacagtgagctacatggctgagcgcatggtagggcaagggtcttttgggattgtcctccaggccaggtgtttggaaacgggtgagactgttgccataaaggaggttcttcaaggacagggttacaaa

SEQ ID NO: 22252 - DNA, 639 bp, Zea mays
  misc_feature: Ceres CLONE 1391890-F
  misc_feature: Encodes the peptide sequence at SEQ ID NO. 22253
  misc_feature (353)..(353): n is a, c, t, g, unknown, or other
  misc_feature (639)..(639): n is a, c, t, g, unknown, or other
aaagctggagctccccgcggtggcggccgctctagaactagtggatcccccgggctgcaggaattcgcacgagaccattacctagaacatcctaatcgaaaacgggatcgctctctctttgggctaccggctccgccgccgctccgccgccctaagccaggtgctgaaggccttcgtcggtcttttcaccggcgacgacgacccactagggaaagaattttcctggcatatttttgtttccagaaatattcgtgtcaagttggtatgtcaggaatcacagcaatttggcgtcggtcatgtccattagctgctagtcagattctaatggagacatattttggcccatctgtatnctctgggtgtctgaggtggttcagcagcggcactaagcactcaagaaaacctgaattttctgttgctaacatatcagggtggtggatttgcattctgcttctgcagttaattatgtgtcaacgatcagaaggttgcccctttcatgccgtatggacactaagtggttgattacttcaaagcccagacatggtgcattgccagggattctaggggggttcaggcttctatcgtggatactcttcagatactgggatcaagccagaagcttcgcagagtggtgtctcn

SEQ ID NO: 22253 - protein, 85 aa, Zea mays
  misc_feature: Ceres CLONE 1391890-F
  misc_feature (30)..(30): Xaa is any aa, unknown, or other
MSGITAIWRRSCPLAASQILMETYFGPSVXSGCLRWFSSGTKHSRKPEFSVANISGWWICILLLQLIMCQRSEGCPFHAVWTLSG

SEQ ID NO: 22254 - DNA, 651 bp, Zea mays
  misc_feature: Ceres CLONE 1391891-F
  misc_feature: Encodes the peptide sequence at SEQ ID NO. 22255
  misc_feature (285)..(285): n is a, c, t, g, unknown, or other
  misc_feature (354)..(354): n is a, c, t, g, unknown, or other
  misc_feature (407)..(407): n is a, c, t, g, unknown, or other
  misc_feature (457)..(457): n is a, c, t, g, unknown, or other
  misc_feature (458)..(458): n is a, c, t, g, unknown, or other
  misc_feature (549)..(549): n is a, c, t, g, unknown, or other
aaagctggagctccccgcggtggcggccgctctagaactagtggatcccccgggctgcaggaattcgcacgagaccattacctagaacatcctaatcgaaaaaggactcagcgggctccaaagccgacgaggataaagaggagcccggctccgcacgcggaagcgagaggatcgccggcgcaggatgtggtgcgcatcgtgcttggcgtccgcctgcgcgggctgcacctgcaacctctgcacgtcggcggcatcggccgtgtcccgccgctccgcgcgcctcgnttactgcgggctcttcgccgcctcccttatcctctccttcttgctccgccagttcgccgcgccgctccntcagcatatcctatgggataatgcgtttgatcaaacaccaccagaagaatggnttcaaatgaatgctggtcttcgtgtaagcctggggaacttcttgttcttnngcatattttctctcgtgatggatggtgtgaaagaccaaaatgaccggcgagatgcctggcaccatggtggctgggatgcaaaagatgctgnatggcctgtctccatgggtctatggtcggggggccgacattgtcatactattacagggacttccaaagttgggtctggttccttctccaagaagggtggggg

SEQ ID NO: 22255 - protein, 155 aa, Zea mays
  misc_feature: Ceres CLONE 1391891-F
  misc_feature (34)..(34): Xaa is any aa, unknown, or other
  misc_feature (57)..(57): Xaa is any aa, unknown, or other
  misc_feature (75)..(75): Xaa is any aa, unknown, or other
  misc_feature (91)..(91): Xaa is any aa, unknown, or other
  misc_feature (92)..(92): Xaa is any aa, unknown, or other
  misc_feature (122)..(122): Xaa is any aa, unknown, or other
MWCASCLASACAGCTCNLCTSAASAVSRRSARLXYCGLFAASLILSFLLRQFAAPLXQHILWDNAFDQTPPEEWXQMNAGLRVSLGNFLFXXIFSLVMDGVKDQNDRRDAWHHGGWDAKDAXWPVSMGLWSGGRHCHTITGTSKVGSGSFSKKGG

SEQ ID NO: 22256 - DNA, 602 bp, Zea mays
  misc_feature: Ceres CLONE 1391895-F
  misc_feature (476)..(476): n is a, c, t, g, unknown, or other
  misc_feature (575)..(575): n is a, c, t, g, unknown, or other
agagctggagcgccccgcggtggcggccgctctagaactagtggatcccccgggctgcaggaattcgcacgagaccattacctagaacatcctaatcgaaaaccccagttgatgcgcgtcggatttgcttgtccgctatgggacgctggttcaagcccctttctcacccgccacactccatcacttgtcgctactcaccagattgccccgcgcccatgctgctgtggccgcctagctcgtgatcctgttctcctacccacaagttgcgattcgatctctggcgcagccatcgaatccatcctttgtccttgactcatacttctgttgcaatttgcgtgctggttcctccggtggtgcatgtgcacgggccatgttcgacgaggtgggtttgagaaaagtctgtacatggtaatccccgtccttgggcttgtcatggtcgattgggaacagtaggattggttgctgagcatggctgnaccggagaagactggtgtttgggtcaggagaagactcaggatccaggacaacccggcccttggaggcgccggcgaaggggggctctggcctccctatcntcatatggggcccctcaaactacggga

SEQ ID NO: 22257 - DNA, 597 bp, Zea mays
  misc_feature: Ceres CLONE 1391914-F
  misc_feature: Encodes the peptide sequence at SEQ ID NO. 22258
  misc_feature (414)..(414): n is a, c, t, g, unknown, or other
  misc_feature (425)..(425): n is a, c, t, g, unknown, or other
aaatttgtagctctcttaggtggcggccgctctagtctagtggatcccccgggctgcaggaatttgcacgagaccattacctagaacatcctaatcgaaaagccgccaccgtcaccgtggcccgccgccatataagtaaaccctcgcctcgtcctcctcccaggctcgccaccctccgcctccgacacatggcccacccgcacctcgtgctcccctccccgaagtccctcctccccgccgccgcaactccatcgcgccgcgccgtcgccatccgcgcggcgctctccaccactttgtctccggccaaggcggcagctggagcagaggcggtgcgatcgatccgcgcgcggcagatcgtggacagccgcgggaaccccaccgtcgaggtcgacctcgtcgcccggggacgaacgnctcccaccggntccgcggggcccagggggccgtccacgggaactaccaggggctggacttccccaccgggacaagggccgataacggggggaaggggggacctccaactgggggcaaatttaacgagggtatccggcccaaaattccaaagggctcaatgggagggaaccaaaagggagggtt

SEQ ID NO: 22258 - protein, 136 aa, Zea mays
  misc_feature: Ceres CLONE 1391914-F
  misc_feature: SWISSPROT Homolog: EC 4.2.1.11 Phosphopyruvate hydratase
  misc_feature (76)..(76): Xaa is any aa, unknown, or other
MAHPHLVLPSPKSLLPAAATPSRRAVAIRAALSTTLSPAKAAAGAEAVRSIRARQIVDSRGNPTVEVDLVARGRTXPTGSAGPRGPSTGTTRGWTSPPGQGPITGGRGDLQLGANLTRVSGPKFQRAQWEGTKREG

SEQ ID NO: 22259 - DNA, 624 bp, Zea mays
  misc_feature: Ceres CLONE 1391915-F
  misc_feature: Encodes the peptide sequence at SEQ ID NO. 22260
  misc_feature (590)..(590): n is a, c, t, g, unknown, or other
  misc_feature (591)..(591): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaactgggaggcagagacgaaagcctactagcttccctttgggtcggtctcgcgctcccgctgcgcgtctgtctgtctgtctgtcttggagcctcatcaatggctaccatcagagaggagtccgactacgacagcagccggtcctcgctgacggcgccgggcggctcccgccggagctggatcagcgacattggcagcgccagctcggtctcggcgcgctccgtggcggggcgaggctgggacgcgccggcgtgccgccaccgccacaagcctcacaaggcgaaccaggccgagtgggaggccatcgggcgcgtccgcgccgccgcgggccgcgtcggcctggagcacttccgcctggtgcggcgcctgggcagcggcgacctcgggaacgtctacctctgccagctgcgcgagccctggtccaccacggggtgcctgtacgccatgaaggtggtggacaaggacgcgctggcgttcccaagaagctgcgnncgcgcggaggtgggagcgcgagatcctccgcgn

SEQ ID NO: 22260 - protein, 142 aa, Zea mays
  misc_feature: Ceres CLONE 1391915-F
  misc_feature: SWISSPROT Homolog: EC 2.7.11.1 Non-specific serine/threonine protein kinase
  misc_feature (131)..(131): Xaa is any aa, unknown, or other
MATIREESDYDSSRSSLTAPGGSRRSWISDIGSASSVSARSVAGRGWDAPACRHRHKPHKANQAEWEAIGRVRAAAGRVGLEHFRLVRRLGSGDLGNVYLCQLREPWSTTGCLYAMKVVDKDALAFPRSCXRAEVGARDPPR

SEQ ID NO: 22261 - DNA, 625 bp, Zea mays
  misc_feature: Ceres CLONE 1391917-F
  misc_feature: Encodes the peptide sequence at SEQ ID NO. 22262
aaagctggagctccccgcggtggcggccgctctagaactagtggatcccccgggctgcaggaattcgcacgagaccattacctagaacatcctaatcaaaaaatccagctttgctttgtagttgtagcgctagcagcttaattggtctctgagctgaggtgcactactagctagctagtcgtgcaggaagaggaaggaatataatggctgagcgggaggtcgtcgaaggcgggacgacgacgggaggcgggctgtggcggaggtatgcgccgcacgtccagatggtgctggcgcagctgtgctacacgctcatgtacttcatcaccgaggccgccttcaaccaggggctcaacccctacgtctacatcacctaccgccatctgctcgtcgccgtcctcatctggcccttcgcatactacctggagaaggggctgaggcctaaaatgacgctcatgctgttcgttgagatattcgtgctctcccttctcggggtgagcttaactctgaacatgtacttcgcgagcctgaagtacacgtccccaacgttcgtcacttccgtggtgaacaccatcgcctcgatgacgttcgtcatcgccatcatcctcaggtgacaaaaggccggacc

SEQ ID NO: 22262 - protein, 135 aa, Zea mays
  misc_feature: Ceres CLONE 1391917-F
MAEREVVEGGTTTGGGLWRRYAPHVQMVLAQLCYTLMYFITEAAFNQGLNPYVYITYRHLLVAVLIWPFAYYLEKGLRPKMTLMLFVEIFVLSLLGVSLTLNMYFASLKYTSPTFVTSVVNTIASMTFVIAIILR

SEQ ID NO: 22263 - DNA, 658 bp, Zea mays
  misc_feature: Ceres CLONE 1391918-F
  misc_feature: Encodes the peptide sequence at SEQ ID NO. 22264
  misc_feature (556)..(556): n is a, c, t, g, unknown, or other
  misc_feature (580)..(580): n is a, c, t, g, unknown, or other
  misc_feature (581)..(581): n is a, c, t, g, unknown, or other
  misc_feature (605)..(605): n is a, c, t, g, unknown, or other
  misc_feature (606)..(606): n is a, c, t, g, unknown, or other
  misc_feature (608)..(608): n is a, c, t, g, unknown, or other
  misc_feature (609)..(609): n is a, c, t, g, unknown, or other
aaagctggagctccccgcggtggcggccgctctataactagtggatcccccgggctgcaggaattcgcacgagaccattacctagaacatcctaatcgaaaagctcaagtcaattcataaactcacaatggcggcaacggcataccccactgtggtgctcatcccactatgcgtcccaggccacctcgcgtccatgatcgaagccggcaagcggctgctcggcagaagccgctgccccatgtccctcaccgtgctcatcacgcagatgaccatgtccgccaacctgatgtccgacgtcgacgacatcatgcgacgggaagccgactccggcctggacatccgcttcgtccacctccccgccgtggagctccccaccgtccaccacggcctcgaggacttcatgatgcgcttcatacagctccacgcgacgcacgtcaaggaggccgtctccggcatgtcgtccccggtcgcccgcggtcgtggtggactacttctgcacccccctaattcgacgtcgcgcgcgaagctcgcgctgccggcgtacgcctacatgccngtccggcggcgtcgatggtcgcgnntcatgctgcggttaccggcgtggnnanncggggaaggtgtcccggggacttcgaggcgatggggaaggaacggtcga

SEQ ID NO: 22264 - protein, 177 aa, Zea mays
  misc_feature: Ceres CLONE 1391918-F
  misc_feature (152)..(152): Xaa is any aa, unknown, or other
  misc_feature (160)..(160): Xaa is any aa, unknown, or other
  misc_feature (161)..(161): Xaa is any aa, unknown, or other
MAATAYPTVVLIPLCVPGHLASMIEAGKRLLGRSRCPMSLTVLITQMTMSANLMSDVDDIMRREADSGLDIRFVHLPAVELPTVHHGLEDFMMRFIQLHATHVKEAVSGMSSPVARGRGGLLLHPPNSTSRAKLALPAYAYMPVRRRRWSRXMLRLPAWXXGEGVPGTSRRWGRNGR

SEQ ID NO: 22265 - DNA, 632 bp, Zea mays
  misc_feature: Ceres CLONE 1391921-F
  misc_feature: Encodes the peptide sequence at SEQ ID NO. 22266
aagctggagctccccgcggtggcggccgctctagaactagtggatcccccgggctgcaggaattcgcacgagaccattacctagaacatcctaatcgaaaaagttcttctccacctcgtcctcctcctgctcctgcattctcgcccgtcccccaaattcaccttggccaccctccaccacctcgtcgacgcgggcagcagttcgcctcatcgtcctcccacctgacgacgtcgcggttcgcgctctcgcggcgtgccgcgcacccacgtctcccgcgagttccacgccttctgtgccacgcgcggacgcgccacctggagccactgttcgccgcgccctccgcatctccgacctctacatctccatccgcggaagcagaccacctccaatccttctttttcacgcagtcattgcttgcctccttagcccaactgttggtaccagaggttcatgtttcatcataaggaatgaacagtagtcgacaaatggaactccactacataaacactggatttccatacacaatcaccgagagcttcatggatttctttgagggtctcacttttgctcatgctgactttgctctcacggatggctttcaggatcagggtaatccatactgggaaatgatg

SEQ ID NO: 22266 - protein, 55 aa, Zea mays
  misc_feature: Ceres CLONE 1391921-F
MNSSRQMELHYINTGFPYTITESFMDFFEGLTFAHADFALTDGFQDQGNPYWEMM

SEQ ID NO: 22267 - DNA, 649 bp, Zea mays
  misc_feature: Ceres CLONE 1391931-F
  misc_feature: Encodes the peptide sequence at SEQ ID NO. 22268
aaagctggagctccccgcggtggcggccgctctagaactagtggatcccccgggctgcaggaattcgcacgagaccattacctagaacatcctaatcaaaaaattaatttccagggatgcacgcaggcaagtttaatttggaggatcaatggtagctagctagagctactagagacatacatggcggatcctctggtgcgagcgcgacccaaaaggaagaaggtcttagcggactacttggtgcgactccgatggattcctgccctcttcgtggcccttccaatatctgcgctgatctacctgagcgtcttcctggggaacacgtggtccgccatgaaatccgagaagcgtcgacagaaggaacaccaggagaacgtagagaggctgagagggtcgtgaagcgtctcaaggagagggatccgaagagggacggcctcgtctgcaccgcgaggaagccatgggtggtcgtgggcatgcgcaacgtggactacaagcgcgccagacgcttcgaggtcgacctctccgcgttgaggaacatcctcgagatcgacgcggagaggatggtcgccagggtggagtctctcgtcagcatggcccagataaccaaggctacctgccccatgaacctctcgctcgccgtggctcctga

SEQ ID NO: 22268 - protein, 132 aa, Zea mays
  misc_feature: Ceres CLONE 1391931-F
MDSCPLRGPSNICADLPERLPGEHVVRHEIREASTEGTPGERREAERVVKRLKERDPKRDGLVCTARKPWVVVGMRNVDYKRARRFEVDLSALRNILEIDAERMVARVESLVSMAQITKATCPMNLSLAVAP

SEQ ID NO: 22269 - DNA, 629 bp, Zea mays
  misc_feature: Ceres CLONE 1391941-F
  misc_feature: Encodes the peptide sequence at SEQ ID NO. 22270
agagctggagctccccgcggtggcggccgctctattctagtggatcccccgggctgcaggaattcgcacgagaccattacctagaacatcctaatcgaaaaacggaagggcccggacagttttgcgcacaagccccccattcccattctaccaccgacccgtcccgtcccactgcctgccagcgtctcccccgctccctctcctcgagagatctcgcgctccggcgatcgggcgcggcgggcggagggtctcgaagtgccctgcccacccccgatgctcttcccgaagcgcatcaactacgtggccccgatgctcgcctccgccggcatcctgctcctcctcctctcgggctacttcgagctcccctccatctccaccccggcgccgctcctcgcgggcgcagcgcgcttccccaccgcgctcgactccgacagatcgcgcgaccgcgacatcttcacctagctccgcaaggccttcgcgtcctgagacgaccgacgtttgctgcccccgcgacggcaccaagctcgccaccgggttgatggcgatatcaccggcactgcaaatgaagagtagcctccacttgtgctgaagctaaaggaccaatggatgaccctgacattgccactcta

SEQ ID NO: 22270 - protein, 62 aa, Zea mays
  misc_feature: Ceres CLONE 1391941-F
MLFPKRINYVAPMLASAGILLLLLSGYFELPSISTPAPLLAGAARFPTALDSDRSRDRDIFT

SEQ ID NO: 22271 - DNA, 631 bp, Zea mays
  misc_feature: Ceres CLONE 1391949-F
  misc_feature: Encodes the peptide sequence at SEQ ID NO. 22272
gctttagaactagtggatcccccgggctgcaggaattcgcacgagaccattacctagaacatcctaatcgaaaagtctttgggtgagcacaccgcgcagcaacgagaggggcaaacaagcttgctactgtgatttctcgtccgagcagcggcggaggagagagagagagcatggccgaccacaaggaggagcctgtgccggagtctgtgatggacaagatcaccgagaagttccacggcggggactcgtcgtcgtcgtcgtctgactcggacgacgagaagaaggggtcctcgttggcgtcgaccccggaagccatgaaggccaagatctaccgccttttcggccgggagaggcccgtccactccgacctcggcggcggcaagcctgccgatcttatcctatggaggaacaggaagatctctggcggggtacttgctggtgccacggccatctggctcctattcgaggtcatggagtaccatctcctcaccttggtgtggcactgtctcatcctctcgctggcccttcctcttcctggggtccaaggccctcactttcttcaacaaggcccccacgaaaaattcctgaggtcaaaatcccccgagggagggggtttgtttatggtggcccg

SEQ ID NO: 22272 - protein, 153 aa, Zea mays
  misc_feature: Ceres CLONE 1391949-F
MADHKEEPVPESVMDKITEKFHGGDSSSSSSDSDDEKKGSSLASTPEAMKAKIYRLFGRERPVHSDLGGGKPADLILWRNRKISGGVLAGATAIWLLFEVMEYHLLTLVWHCLILSLALPLPGVQGPHFLQQGPHEKFLRSKSPEGGGLFMVA

SEQ ID NO: 22273 - DNA, 735 bp, Zea mays
  misc_feature: Ceres CLONE 1391954-F
  misc_feature: Encodes the peptide sequence at SEQ ID NO. 22274
  misc_feature (22)..(22): n is a, c, t, g, unknown, or other
  misc_feature (33)..(33): n is a, c, t, g, unknown, or other
  misc_feature (35)..(35): n is a, c, t, g, unknown, or other
  misc_feature (85)..(85): n is a, c, t, g, unknown, or other
gtttttccccccccctttcccnccttctgggtnantttagggggcgggggggaaagctggaactccccgcggtggcggccgctcnatacctagtggatcccccgggctgcaggatttcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagcagcagagagcgtcgccgaaggtgtgaccgagttccaagccgggggaccacgttctcccctgtcttcattgggggaaggccagaggcggcgaggcactgacggtctcacggaaaagagccaacctggggcccagaaagcctcgggt

SEQ ID NO: 22274 - protein, 66 aa, Zea mays
  misc_feature: Ceres CLONE 1391954-F
  misc_feature: SWISSPROT Homolog: EC 1.1.1.1 Alcohol dehydrogenase
MAAADASSLPPSAITCRAAVAWGPGQPLVMEEVEVAPPGPMEIRVKVVSTSVCRSDVTAWQSKLRA

SEQ ID NO: 22275 - DNA, 644 bp, Zea mays
  misc_feature: Ceres CLONE 1391955-F
  misc_feature: Encodes the peptide sequence at SEQ ID NO. 22276
  misc_feature (320)..(320): n is a, c, t, g, unknown, or other
aaagctggagctccccgcggtggcggccgctctataatagtggatcccccgggctgcaggaattcgcacgagaccattacctagaacatcctaatcgaaaaatattattgagaccaactagcaacatagaaagcacaatagtgtaccaacaatggcagccaatattttgcctccttatgctccttggtctttctgcaagtgctgctacggcgaccattttcccgcaatgctcacaagctcctatagcttcccttcttcccccgtacctctcaccagtggtgtcttcggtatgtcaaaacccaattctttgaccctacagnatccaacaggcaatcgcagctggcatcttacctttatcaccctttgtcctccacaatcatcagccctataacaggcagtaccctttggtgcattttattggaacaaacatcagggcacaacaactaccacaaattgggttaaaaaaccttggtgcctaatctcaaaaaaaggaatttctttcctttaaacacaaaaagggattggaaaccgggttctttatttgggaaaaaaaaaaattactttttggccgttttctgggtggcaaaccccccaaaattttttttcttttccccaagtggggaaattttagccccccccctatt

SEQ ID NO: 22276 - protein, 102 aa, Zea mays
  misc_feature: Ceres CLONE 1391955-F
SWSSPRWRPLYNSGSPGLQEFARDHYLEHPNRKILLRPTSNIESTIVYQQWQPIFCLLMLLGLSASAATATIFPQCSQAPIASLLPPYLSPVVSSVCQNPIL

SEQ ID NO: 22277 - DNA, 823 bp, Zea mays
  misc_feature: Ceres CLONE 1391958-F
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (15)..(15): n is a, c, t, g, unknown, or other
  misc_feature (43)..(43): n is a, c, t, g, unknown, or other
ccccccnntcccncntcccccccccccttcccccccaattggntaattaaaaactggagctccccgcggtggcggccgctctagaatagtggatcccccgggctgcaggaattcgcacgagaccattacctagaacatcctaatcgaaaaagtcgtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtaggggtggaagagatccatcaggcggtgagtgggaagggccggcgtccacacaaccgtaaggtcagcttccacaaacggcttatcttttacaatccccacccaacgaaacggactcaatccagcgcccggtgactactccgcaccactgctaacaactacaaccacccccaacagcacacccctattctctcctatgccaacaaactttctatactttgtgccgccggcttgctacacaatctactcacactacatgttcgttgactgacgaaaacacccacccacacctacctttcatggccataactgccttccagtcaccacccaacccaccatacccataataccaaaccctccataccctctgagttatgag

SEQ ID NO: 22278 - DNA, 669 bp, Zea mays
  misc_feature: Ceres CLONE 1391960-F
  misc_feature (603)..(603): n is a, c, t, g, unknown, or other
  misc_feature (604)..(604): n is a, c, t, g, unknown, or other
aaagctggagctccccgcggtggcggccgctctacaactagtggatcccccgggctgcaggaattcgcacgagaccattacctagaacatcctaatcgaaaaaccagtactagcagtggcgcaaaaacttttttattacaacttcccggcaggacccgtttcgttcggtccaagtctccaacccctagcagcccacccacatacaattccgtttgcccgggtcctctcctcgcccgcgaccgccgtttgactcccggacccgacccactcccaccaatcggaggcaaagatcgcgtgaaatcccgggtctcgcgcgcccatttcagccggacgctgaccaagacaaccccggcgatccccacacccgcacacacaaagacgcagaccacacaacggctcggcaagcggcagcaagcccagaccagagcgaaaacccaccgttccagcacccgattttgaaccaccgcgacactcccaagtcccaaccaaatctacgacccctccgaccgaaacgagatctccgcctcccctcacggaaaggaaagaaacgctctccccccggggcaaagggaaccgtcgccgcgtcgcggaaaactgaggcgnngcacaggaggaggagaggccgaggcagggagagggttccggcggcgatggagcggtacaacccct

SEQ ID NO: 22279 - DNA, 725 bp, Zea mays
  misc_feature: Ceres CLONE 1391962-F
  misc_feature: Translation starting site: 287
  misc_feature (437)..(437): n is a, c, t, g, unknown, or other
  misc_feature (459)..(459): n is a, c, t, g, unknown, or other
  misc_feature (460)..(460): n is a, c, t, g, unknown, or other
  misc_feature (471)..(471): n is a, c, t, g, unknown, or other
  misc_feature (514)..(514): n is a, c, t, g, unknown, or other
  misc_feature (519)..(519): n is a, c, t, g, unknown, or other
  misc_feature (559)..(559): n is a, c, t, g, unknown, or other
cgcggtggcggctgctctataactagtggatcccccgggctgcaggaattcgcacgagaccattacctagaacatcctaatcgaaaaagagccgccgcgcaccctccagttcgtctccccagctctgtctctaaaatccactcgtccaccacctcctcggcgcttcgcatcctttccccctccgcaagaaagaagcgaagcaactctccgccgtctccgtttttctccacaccacccaaagctctctccgaccacagcctcgcccccagcgcctccttccgcagtcatgtaccgcgcggccgctagcctcgcctccaaggcgcggcaagccgggaacagcctcgccgcccgccaggttggaagcaggcttgcctggagcaggaattatgctgcgaaaggacatcaagtttgggtgttgaggcccgtgctctgatggntgaggggtgtttgaggagttgnnagatggcgtcnaagtgacaatggggacctaagggccgcaatgtggttattgagnaaagntttggtgcaccgaaagtcacaaaggatggtgtgactgtantaaagagcattgaaattaagggtagagtaaagaatggctgtgcaagccttgggaaacaggtcgctaatgcaaataatgacactggtggcgacggcaccacattgtgcacttgtttcgacaaaccctatatttcactgaggggtggaaattctgttgcggcgtggct

SEQ ID NO: 22280 - DNA, 751 bp, Zea mays
  misc_feature: Ceres CLONE 1391976-F
  misc_feature: Encodes the peptide sequence at SEQ ID NO. 22281
tccccgcggtggcggccgctctattactagtggatcccccgggctgcaggaattcgcacgagaccattacctagaacatcctaatcgaaaaaagcttttgctttggtttaggtgcttcttttccacccctttactgttccccccacttttgcttgctttgtcacgcacacgaaaagctcctgcctttaccttatctccgcacccgtagtgggatttggtggaagctgcgctgctcgcccctcgcgtttctttgctcaattgggggtcacggtcacggcccgcgggtgctgcgcgtgctcgtgggcggcgagaattcggggttcttgcgcggtcccggtcccctcggcgattgcggacgctctcctgcagatcttcgcgtaactccgggagcgcgccggagatgaactgcgggccgcccgaccagctggccgccggggaacggcgtcgacgagctccctcaccctgacctgctcaccggcctatggcccccccacccagctccacccgcccccccagtcccgcggccccaccccccccgcccgccacccccccacctcccccctgactcgcacacccgccgcgtcctcctcccttacccgccgatcccccccccccgcactcacacccgaccgccacagtctcaccaaataccccctcacaccccccacgacccgcggccacctctgcccccccccccacctaccccccaaccctcccacccctcctccgcagcgccccgcctgctcctcct

SEQ ID NO: 22281 - protein, 68 aa, Zea mays
  misc_feature: Ceres CLONE 1391976-F
PRGGGRSITSGSPGLQEFARDHYLEHPNRKKLLLWFRCFFSTPLLFPPLLLALSRTRKAPAFTLSPHP

SEQ ID NO: 22282 - DNA, 724 bp, Zea mays
  misc_feature: Ceres CLONE 1391977-F
gctctagaactagtggatcccccgggctgcaggaattcgcacgagaccattacctagaacatcctaatcaaaaaacgtctcgtcagtttttttccctttttcccgtggcccgtgggtgtgcgtcctaggtgtgcggcgggcggtgcgccgtgcgcctcctctcctcgccgcgacgctgccgtgttcgcgattcagcgccgtgctcgacgcccctcctcccttcagaagtcagcgccgcatctccggttgcagagacttgcgctgccacctctccgcttttcgtccttcagttgctcgacgcccctcctcccctcagaagtcagcgcagcgtctccactctccacgccgtcgcgtcggcgacgcgggtccttcgaataagacggtttgttctcgcatcgggcgtcagccggattcgagggacatagatgatggaagtcgatcttgggtgccaccacgtcgaagcgggttgtgctgtgtagatccggcgaaagcgcgcaggttaagcccgggtccggcgccgtccttggccctcatggtcttcgaattgccactcgcgtaaagggtaacgacggccacctggccttaacactttgatttgaaatatgccccatacgtaaattgcctgtcatctaactggctagaaaatcattcattggctcgggtcagcacaaacatagtcttcgtaaccgccttctcatacttatcacttgcggccccatactcg

SEQ ID NO: 22283 - DNA, 777 bp, Zea mays
  misc_feature: Ceres CLONE 1391981-F
  misc_feature (37)..(37): n is a, c, t, g, unknown, or other
  misc_feature (38)..(38): n is a, c, t, g, unknown, or other
gggtgccccccccccccccccccaaaaccaccaccannaaagaccaacacacccacaccaaccctccccggggtggggggggcttttcaaaaaaggcccccccgggctgcatttttcccgcacgagaccattacctagaacatcctaatcgaaaaatacttttcctccttcagcctttatcacacgccaatggagtggggctaggaatggtatggtaacttttccaatctttttgcattaaaaaagaaatcctaaagaaaaaggattactaaacgagcacgctcgccggcgctgggaccaggctctgggtctcgcatcacgatcagatccaatccaaggccgcgccccagcccggcggatggattccgccgccgtggccatcgtgacggagccgttcccgccgcctggccacctgaaacagctgctgcacctgaccctgctcctggcatcgcgagcggcttcccgcccacttccccgacccggatccccccctccggaaggcccgccggcgccttgtcggcccgggagcccgaccccgcgtcggcgcgtcttaggagcgccgcaagagcccgaacaacgaatcccccctcaacgaaacacatcatcccccgatccccgcggaaaacgcaacacccccgcccccaaggccctcctgctccgcgcgccgcgcgacccactaccaaaacccccccctcctgacccacgaacagagacaccagaatagccactcccccccaacaacctccgtccccccccctaccatccacgtcggcgcgg

SEQ ID NO: 22284 - DNA, 683 bp, Zea mays
  misc_feature: Ceres CLONE 1391982-F
  misc_feature: Translation starting site: 221
  misc_feature: SWISSPROT Homolog: EC 1.1.1.1 Alcohol dehydrogenase
  misc_feature (629)..(629): n is a, c, t, g, unknown, or other
ggagctccccgcggtggcggccgctctataactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagtagtagagagtggtcggtgaaggtgtgaccgagttccaagtcggtgaccacgttctcactgtcttccattggggaatgcaagagctgcaagcactgcngtctcagggaagagcaacatgtgccagaagctcggtcttggaaaaggaaaggtg

SEQ ID NO: 22285 - DNA, 678 bp, Zea mays
  misc_feature: Ceres CLONE 1391984-F
  misc_feature: Encodes the peptide sequence at SEQ ID NO. 22286
  misc_feature (528)..(528): n is a, c, t, g, unknown, or other
  misc_feature (544)..(544): n is a, c, t, g, unknown, or other
  misc_feature (560)..(560): n is a, c, t, g, unknown, or other
  misc_feature (572)..(572): n is a, c, t, g, unknown, or other
aaagctggagctccccgcggtggcggccgctctatcaatagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggccgtcatggggttcctcacgtcggncgcgctggggctcggnggcctgccctcgctcncgtggctcgccntcccggggcggcggccgttcctccgcccccccggtcttcgtggcgggggcgcccccttgtctggtgccggccccttccctcgcccgccccctcgcccgcgccggtc

SEQ ID NO: 22286 - protein, 157 aa, Zea mays
  misc_feature: Ceres CLONE 1391984-F
  misc_feature (44)..(146): Pfam Name: Oleosin Pfam Description: Oleosin
  misc_feature (108)..(108): Xaa is any aa, unknown, or other
  misc_feature (119)..(119): Xaa is any aa, unknown, or other
  misc_feature (123)..(123): Xaa is any aa, unknown, or other
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTAVMGFLTSXALGLGGLPSLXWLAXPGRRPFLRPPGLRGGGAPLSGAGPFPRPPPRPRR

SEQ ID NO: 22287 - DNA, 735 bp, Zea mays
  misc_feature: Ceres CLONE 1391985-F
  misc_feature: Encodes the peptide sequence at SEQ ID NO. 22288
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (20)..(20): n is a, c, t, g, unknown, or other
  misc_feature (25)..(25): n is a, c, t, g, unknown, or other
nnttttttnnnccaaaaaanccccntccccccccatgcccccccctacccatgcatgagtggagctccccgcggtggcggccgctttacaatagtggatcccccgggctgcaggaattcgcacgagaccattacctagaacatcctaatcgaaaaaccagtctcgtcgtgtccgttcgcgatcgggcaaacctgcaaccctttcctcttcgtccccccgctatctcgttgccccaagccggagtacggagtacggcagtcgcacccccgtcgtcccgttccttgctcgccccaacttcgccgccgcatccccctcggctgctcgctcctcgtctgcccctagtgatgtctggtggtaacgcgtggtcgccgctcccttcgcacggatttgacgacgactcctgcttgctcttttttattttgctcgtgccgtcggatcgcggcttgattgatctccgcatcccgcagatacgactccggcggcatggggagccgcgcaggcgagcctgtggcgacgaacaacagcggtggcggtagcagcagtatggaccccgacagcttcgagcgcaccatctgtctggaacctgacccagcaatacccgcgaacacccacatccagccacccacatcaagttgggagatgacggtctaggaggaggagaccccacgcggctaggcgcacaaccaccgaaaacggaccccaacgcggaaagcgcccctcgtccacaacccacac

SEQ ID NO: 22288 - protein, 55 aa, Zea mays
  misc_feature: Ceres CLONE 1391985-F
MGSRAGEPVATNNSGGGSSSMDPDSFERTICLEPDPAIPANTHIQPPTSSWEMTV

SEQ ID NO: 22289 - DNA, 724 bp, Zea mays
  misc_feature: Ceres CLONE 1391993-F
  misc_feature: Encodes the peptide sequence at SEQ ID NO. 22290
  misc_feature (24)..(24): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (75)..(75): n is a, c, t, g, unknown, or other
tttccctccctccccttctttttnataangnnnaaggcagcccaccaacaagctggggctccccgcggaggaggncggctttcaaaagaggatcccccgggctgcagtatccgcacgagaccattacctagaacatcctaatcgaaaaaccaggcagcatttttccctccccactcgaggctccgagctttattttttcttgttttggtttgttttcttggtaggagtaacaatagtttctggcagccttcttcctcctcgctctctacccgaggagagaggagaggagagaaatccggaggcaaagcttcagggtttgtataaagggattctagatctaatcgactaaccacagagaaaaaaaaacaaaaaataacgcgagaaagcatgagccacttcgccgtcgtcgccgtgaagagccccctcgccgtggccgcgcccgccgccggcgacgccaagagcccgctcttctgccccaagccgcggcgccccgcggagcccctgcggtgccaccagggcggcgacgccggcatggatctgcgcgacctcctcctgtcaaagcacagtgtttagggtgatgaacagtgacacactgacacgctatatctgggggagagagaaggggaccgactcgcagggggtgttgaagggacaccgctggcggacaaaaaacagtgtggaagggatggacttcaattcattcatctaccgtaattgctatggg

SEQ ID NO: 22290 - protein, 61 aa, Zea mays
  misc_feature: Ceres CLONE 1391993-F
MSHFAVVAVKSPLAVAAPAAGDAKSPLFCPKPRRPAEPLRCHQGGDAGMDLRDLLLSKHSV

SEQ ID NO: 22291 - DNA, 742 bp, Zea mays
  misc_feature: Ceres CLONE 1391994-F
  misc_feature: Encodes the peptide sequence at SEQ ID NO. 22292
aagctggagctccccgcggtggcggccgctctagaactagtggatcccccgggctgcaggaattcgcacgagaccattacctagaacatcctaatcgaaaaactctctcttctccctccaataattctctccacccctgcttgctgcagcttcaagcactaccgaatcagggcgagtgggagcagaggagggaatcccatgtctccgcccctcgctggagcagatcgttgtcgagccgacgtggagctgctgcggtagaaagctagcggagcctgcgagctagcctgatccgtccgcagtccgatcgggatcgatgggtggggaggcgccggagccgcggcggctgacccgggcgctgagcatcggcggcggtgacggcggctgggttcccgaggagatgctgcaactcgtgatgaggttcgtcgaggacccgcgcgacccggaggccgcgtcgctgctgcgtccccggtgaaaccgcgtccacccgctcttcgcggaaatcacgcgccgtcgtcctttctgtatacctatttccctgtatcccttcgccatactccttcttcctatcccaacccctcacctcacacttgaatcacatatcgcagtctccccccgccacacctacgacgatcacgcttcgctcctgacatctcttcccatccgcaccccagttattatcatccttaactcccccaccgacccctacatacaccaacgaccttagtatcacctacttccccgt

SEQ ID NO: 22292 - protein, 52 aa, Zea mays
  misc_feature: Ceres CLONE 1391994-F
MGGEAPEPRRLTRALSIGGGDGGWVPEEMLQLVMRFVEDPRDPEAASLLRPR

SEQ ID NO: 22293 - DNA, 683 bp, Zea mays
  misc_feature: Ceres CLONE 1391999-F
  misc_feature: Translation starting site: 207
aaagctggagctccccgcggtggcggccgctctagaactagtggatcccccgggctgcaggaattcgcacgagaccattacctagaacatcctaatcgaaaaaactactccgtcactttgtttgcaaaggtcctcctcgatccatcgatcactgcaccggccggcgggaccgcgctcgcaggggctagcgcaacgagacggcagcaatggcggaccgtgaccgcagcggtatctacggtggcgcccacgccacctacgggcagcagcagcagcagggaggaggtggccgcccgatgggtgagcaggtgaagggcatgctccacgacaaggggccgacggcgtcgcaggcgctgacggtggcgacgctgttcccgctgggcgagctgctgctggtgctgtcggggctggccgctgacggcctccgtggtggggctggccgtggccacgccggtgttcctgatcgttcagccccgtgctcgaccccgccgcgctgctcatcgggacggccgtcatggggttcctcacgacgggcgcgctggggctcgcgggcctgtcctcgctcacgtgcctcgtcaacacggcgcggaaggcgttccagagcaccccggactaacgcgcaggaggcgcaccgtgtgtatggcggaggccgcggccgcacgctaagcataagaccgctcatgcag

SEQ ID NO: 22294 - DNA, 713 bp, Zea mays
  misc_feature: Ceres CLONE 1392004-F
  misc_feature (297)..(297): n is a, c, t, g, unknown, or other
cgctctttactagtggatcccccgggctgcaggaattcgcacgagaccattacctagaacatcctaatcgaaaacaattgctgcactgaagcgttataataatgttctacttgatggaaaagctatgaagatagaagtcatcggaaatgacttaggattgcctatgacacctcgtataaatgttgttggggcttctaatggcagagctacaagaacagttgttatgacgcctgagtttagtcaacgtggcagaggttcaagcagtagacctctaagtaatcccagcaacaggtttanacaaccgtggtggtttccaagctggtcgaggccgtggccagttccagagctgggggagaggccgtggtcagttccagagccgggggagaggccgtgcccagttccagggacgagggagaggcaggaagcctgagaagactgcacatgagctggatcaagacctggaaagctatcacgcggaggcaatgaaaaccgattgattgcacggccggccgtgccacgaggctgtgtgtttatccattctcttcctggtaccaacacacctcgcttcgagcgtttggcttccggtgcgccaaatgcccgtgggcgggcagtgcatactatggcacggcccctctccgaccccgtggccgccaacctcttacgccgccgacccttctgacgctcactcgttagcctccaattcactcattcca

SEQ ID NO: 22295 - DNA, 763 bp, Zea mays
  misc_feature: Ceres CLONE 1392006-F
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (199)..(199): n is a, c, t, g, unknown, or other
acccgcggtggcggccgctctatacactagtggatcccccgggctgcaggaattcgcacgagaccattacctagaacatcctaatcgaaaacagtcccagtcccagtcccagtcccaggacagtcccgtcagcagccacttccccggcccctcccgctcctgctcgccggaggccgggccggcggcgatgnnnnagggnaattgctggggccgatcgcccaagaaggcactattgttggctgcactctggagataacacagaggaaggcggaaggcgatggttggcgtgggaagccccgtgctcaggctccgaccgagagccgcctctacgtcggggatctaatcctccgggcctcctcgctgtggcgtggtggtccttgtcgtactccggttgtcgggtacgccagtttattgctcgggaaggataggagaagggggggaagaagaatgacttaccggcgatcgtcggggccggggggaggcagtgagctgcggcactagaaaagcgcacgccgcgcaggatggacgtgtgtacctccagccacgcaaaactggagtgatagagattccatagttctatgcccgaaacctcgttagcagtatttgtatgtgggtgtgccatgaccctcgacaggtgcatgtcaggcggcgagcgaaagatgtgcgccaccatgcgagctactagtggtgcttcggcgatctgcgacgcccgtagctctcgatctccccttgtaagcgtatgagcctaatgtataattgcgtt

SEQ ID NO: 22296 - DNA, 700 bp, Zea mays
  misc_feature: Ceres CLONE 1392007-F
  misc_feature: Encodes the peptide sequence at SEQ ID NO. 22297
  misc_feature (356)..(356): n is a, c, t, g, unknown, or other
cgctcagatctagtggatcccccgggctgcaggaattcgcacgagaccattacctagaacatcctaatcgaaaacgggatcgctctctctttgggctaccggctccgccgccgctccgccgccctaagccaggtgctgaaggccttcgtcggtcttttcaccggcgacgacgacccactaggaaaagaattttcctggcatatttttgtttccagaaatattcgtgtcaagttggtatgtcagggatcacagcaatttggcgtcggtcatgtccattagctgctagtcagattctaatggagacatattttggcccatctgtatcttctggtgttctgaggtggttcagcagcggnactaagcactcaagaaaacctgaattttctgcccccaaccatatcagggtggtggatttgcattctgcttctgcagttaattatgtgtcaacgatcagaaggctgcccctttcatgccgcaaggacactaattgggtgattacttcccaagcccagagatgggggcatgtgccaggattcttaaaggggttcacggctccaatcgccgataccttcaccaactgaccaccagcccaaccggagcaatgagctgtcgctctgacgcttccggcacccgggagccctgtcgttcggcgccggcagcgggagagggcggccactgtactcacgcccggtagcccagg

SEQ ID NO: 22297 - protein, 114 aa, Zea mays
  misc_feature: Ceres CLONE 1392007-F
MSGITAIWRRSCPLAASQILMETYFGPSVSSGVLRWFSSGTKHSRKPEFSAPNHIRVVDLHSASAVNYVSTIRRLPLSCRKDTNWVITSQAQRWGHVPGFLKGFTAPIADTFTN

SEQ ID NO: 22298 - DNA, 697 bp, Zea mays
  misc_feature: Ceres CLONE 1392022-F
  misc_feature: Encodes the peptide sequence at SEQ ID NO. 22299
gctcttcactagtggatcccccgggctgcaggaattcgcacgagaccattacctagaacatcctaatcgaaaaaacaagggcgaccgccgtcgctaaacgcccagctgcccaggtcttcgtcgggcccctcgccggcgacgagcacccaacacaccaggatggcgctgaggggggtctggcagctccagaagctcgtggtaaactactgcgactggggagggagcagcaggggcatcagagccttcatggaggcacatcttccagcgtttaaggaaaagattccacacttagaagtggtgacagagcttgtccgcggtcaacatcctaacttgaagggaatttacaagaaccataacgagcgagtggtctgcgtgagaaatttaccgccagaagaaatactcctgcaagccaccaggctaaggaactctctgggcaggaaagtggtgaagctgcggaccagacacgtaacgaagcggcccagtgtccaggggacgtggacgacggagctgaagatgggaaccaagctagcaggcaagggggttcgttgttctggggggggggtccgaaaaaaatggcagtgggtcaataccttcgaagaaagctgccgttatgcccccctttttcgagcggacctttttccccttttggtccaatatccaggggaaggcaaacgcccccccggagctttctggctcg

SEQ ID NO: 22299 - protein, 179 aa, Zea mays
  misc_feature: Ceres CLONE 1392022-F
  misc_feature (18)..(91): Pfam Name: L51_S25_CI-B8 Pfam Description: Mitochondrial ribosomal protein L51 / S25 / CI-B8 domain
MALRGVWQLQKLVVNYCDWGGSSRGIRAFMEAHLPAFKEKIPHLEVVTELVRGQHPNLKGIYKNHNERVVCVRNLPPEEILLQATRLRNSLGRKVVKLRTRHVTKRPSVQGTWTTELKMGTKLAGKGVRCSGGGVRKKWQWVNTFEESCRYAPLFRADLFPLLVQYPGEGKRPPGAFWL

SEQ ID NO: 22300 - DNA, 718 bp, Zea mays
  misc_feature: Ceres CLONE 1392024-F
  misc_feature (261)..(261): n is a, c, t, g, unknown, or other
  misc_feature (330)..(330): n is a, c, t, g, unknown, or other
  misc_feature (342)..(342): n is a, c, t, g, unknown, or other
  misc_feature (346)..(346): n is a, c, t, g, unknown, or other
  misc_feature (371)..(371): n is a, c, t, g, unknown, or other
  misc_feature (387)..(387): n is a, c, t, g, unknown, or other
gctctagaactagtggatcccccgggctgcaggaattcgcacgagaccattacctagaacatcctaatcgaaaaattcccttccttccttgctcctcccctgcctcgcctctctctctcccctctcctcgcctccagctcctgctcggcccgctcgcgtcgagctgcgcgcgcgcctgcggtggtcgtgaaggacagcccgagggacgcgccgggtgcactgatctgggggccgcgtgtccccggtggtggggcgaggcgncgccggcttccaggaatggggcacttgtagcgtcggtttcttttgcatatgcactttctattgttgctngcacttcaaggnaggncatagcctcctggatttgtatggcntggtatctggaattgngaacataaatgtcattccgtaaaatattccgggatgttaggaatggtttttgccctttgccaaggaaaaattttggggggccccccgaagtattttaggccctaagggcccccaaaagggaaacaccaaagctccttcaggtgtttccgagaaccccccttccataatccggaaagggagggggacaccaccccccagaaacctcgggggaaaaaacaagaaaagtggggggtctagaaacactcctccgcacccgaaaaccctttctttttctcacatctgccttaaatacagcaaaacaataaataaaaatctgtgtcgcacccccacc

SEQ ID NO: 22301 - DNA, 719 bp, Zea mays
  misc_feature: Ceres CLONE 1392027-F
  misc_feature: Encodes the peptide sequence at SEQ ID NO. 22302
ggcggccgctctataatagtggatcccccgggctgcaggaattcgcacgagaccattacctagaacttcctaatcgaaaaatgatccaatagccgccgccttgtggttgtgtcatatatgggggccgaccagtggccgtggccgtggccgtgggcgacgccgccgccgccggccctgctgcttctggcctcactactgccggcgctgctgctcgcgctgtggcgcctggtgtggcaaccgcgggccgtggcgcggtcgttcgcgaggcagggcatccgggggccgccctactgtttcctggccggatccttgtcggaggcgaagcggctggcgcgtgccagccggagaagggttccgcagctggacgtcgcttcacatgacatcatgcccatcttgctgccaccgttccaccgatgggtcgtccagtatggtaggaaattcctcgcctggatcgtgcccatacctgcattcttactccgtaactaaccgctccttattagagtgctttagtgacccccccccccacctgagatgatattattcttcaccgtttccacaccattgtaaggacaaaagcctccccattattaaataatccttcacgcacaccgcacccaataactatccctccaccctcccaccccgtacctctctatacctttccgaccctaccgattctcctctcttaccgttttccacttatcggtcctatctctaca

SEQ ID NO: 22302 - protein, 122 aa, Zea mays
  misc_feature: Ceres CLONE 1392027-F
  misc_feature: SWISSPROT Homolog: EC 1.3.3.9 Secologanin synthase
MGADQWPWPWPWATPPPPALLLLASLLPALLLALWRLVWQPRAVARSFARQGIRGPPYCFLAGSLSEAKRLARASRRRVPQLDVASHDIMPILLPPFHRWVVQYGRKFLAWIVPIPAFLLRN

SEQ ID NO: 22303 - DNA, 719 bp, Zea mays
  misc_feature: Ceres CLONE 1392028-F
  misc_feature: Translation starting site: 210
  misc_feature: SWISSPROT Homolog: EC 2.4.2.30 NAD(+) ADP-ribosyltransferase
  misc_feature (394)..(394): n is a, c, t, g, unknown, or other
  misc_feature (500)..(500): n is a, c, t, g, unknown, or other
  misc_feature (503)..(503): n is a, c, t, g, unknown, or other
gctctagaactagtggatcccccgggctgcaggaattcgcacgagaccattacctagaacatcctaatcgaaaaaaaaaccccctcgattcgtccatccctcgcacgcgctggccgcccgccccccatctccacttctcctcgccgctctcctgaatccttcgcccgaaagcctccgaccgcagaaccttagcgttgccgtccacctccatggaatcgaagcctcacgcgccggcgtctgggctggcaacgccgcggttcaggctgggtaaacagtcgtcgctggcgcccgagcgcggcggcgagggcggtggtgcggggtcggcagatgggtcggccgaggcgaacggcgtcatgagcttccagctcatgtacctggcccacgagggcagcgncggaggggatccgcgagctcctcgacggcggcgtcgaccccaatttccgcgactccgacggccgcacggctctgcacatcgccgcctgcgagggccacgccgaggncgncgagctgctgcttcagagcggcccggaggccgccgcggaggaccagtggagcagcacgcctttggcggatggcagggatgatccgaatcagggggggatcaagatcttggaggaaggaggtttcccaggagaagaatgccccggatgcatgggaaaaatggtcgagaaagtcctgaaaatgatgaatgaccggtgtgaacgtggtttcaggtaagg

SEQ ID NO: 22304 - DNA, 731 bp, Zea mays
  misc_feature: Ceres CLONE 1392029-F
  misc_feature: Encodes the peptide sequence at SEQ ID NO. 22305
tccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctccccttcctcggcgtcctcgccctcaccatctccgtccacatgctgccacggcccacgcccgtcgatcctctgctctttcgcggctcacacgccgccgcacgtccctcctgggccacctcggtgactcgccgacactggtcctcggcttctccgctctcctcctccgagccctgcgccaccccccccctttagctcacctcgaacgagccgtgacactctccctgtccct

SEQ ID NO: 22305 - protein, 165 aa, Zea mays
  misc_feature: Ceres CLONE 1392029-F
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLPFLGVLALTISVHMLPRPTPVDPLLFRGSHAAARPSWATSVTRRHWSSASPLSSSEPCATPPL

SEQ ID NO: 22306 - DNA, 679 bp, Zea mays
  misc_feature: Ceres CLONE 1392031-F
  misc_feature: Encodes the peptide sequence at SEQ ID NO. 22307
  misc_feature (404)..(404): n is a, c, t, g, unknown, or other
  misc_feature (414)..(414): n is a, c, t, g, unknown, or other
  misc_feature (416)..(416): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
aagctggagctccccgcggtggcggccgctctagaactagtggatcccccgggctgcaggaattcgcacgagaccattacctagaacatcctaatcgaaaagggggtgttaaaccgcatcgcatcgtcttctagggtttcctcctcccgccgccacttgctgccccacgagcccattcccctcagcccttcaccatctccggcggtcgcagtggcatcagcagctccggctcacgcgcagcaaaggaacgacaatatggcgaccatcgtaaacacgacggaggaggagccgatgctggccgtggtccgcttcaccgctgagctcgcctgggccgaccgggggcccggaagtcgcggaccccgaggtcgcccgcctatgtctcgaggcgcaggagatatcctcgncgggggcggngnctcgacatggcctcccttatgctcgcctccgccgacctcctcctcacctccccgtcgcgcgtctcggacaaagaccctggagtgcgttctctccgtcatctgcagcctcgtcaccaaggccggatccgaggaccaggcgctgcagatcaccgaactcatctgcgctaagctcacccagcaacacggggacaagccagcgctgcggcctcaagttcttttcagcttgaacaatctgctcccgagccggcnnnnnnnnnnnnnnn

SEQ ID NO: 22307 - protein, 136 aa, Zea mays
  misc_feature: Ceres CLONE 1392031-F
  misc_feature (50)..(50): Xaa is any aa, unknown, or other
  misc_feature (54)..(54): Xaa is any aa, unknown, or other
MATIVNTTEEEPMLAVVRFTAELAWADRGPGSRGPRGRPPMSRGAGDILXGGGXSTWPPLCSPPPTSSSPPRRASRTKTLECVLSVICSLVTKAGSEDQALQITELICAKLTQQHGDKPALRPQVLFSLNNLLPSR

SEQ ID NO: 22308 - DNA, 664 bp, Zea mays
  misc_feature: Ceres CLONE 1392033-F
  misc_feature (196)..(196): n is a, c, t, g, unknown, or other
  misc_feature (211)..(211): n is a, c, t, g, unknown, or other
  misc_feature (213)..(213): n is a, c, t, g, unknown, or other
  misc_feature (219)..(219): n is a, c, t, g, unknown, or other
  misc_feature (246)..(246): n is a, c, t, g, unknown, or other
  misc_feature (378)..(378): n is a, c, t, g, unknown, or other
aaagctggagctccccgcggtggcggccgctctataatagtggatcccccgggctgcaggaattcgcacgagaccattacctagaacatcctaatcgaaaagacgggggcgtttctcgatctgacgctcgcctgggcctgcctctgcctcgccgcgcttcgccgccgccgccgcgcgcctcctcgcgctcctcggnctcccgctcccctgnanctgtgngcgcccgaacctgccctgcctcctcgncttcctggtgggctaccctccccgcggccggcggataacttataggcgccctcccgggccgttttccctttgccgggccccaccgaggaagaaggaaggccttttaaaaaggggggggaaggaaaaaggggncccccccaaggccctctctttgggggaaaaaaagaaaaaaataccttttctctctccctcccccgcgaagcagctagcctacaaattttaaaaaaagtattctttaaaaaaaaaaaaacaacccgcccccaccacccccattctccacagcaatcacccccccaccacaaatatgccgtcccacaaaaaaaaacaaccccccattcctttaataatcaaccacaccccccaaccaccccctcaccatcaacacaaaccttattattctcttccttaatgagcacac

SEQ ID NO: 22309 - DNA, 816 bp, Zea mays
  misc_feature: Ceres CLONE 1392034-F
  misc_feature: Encodes the peptide sequence at SEQ ID NO. 22310
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (15)..(15): n is a, c, t, g, unknown, or other
  misc_feature (16)..(16): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (45)..(45): n is a, c, t, g, unknown, or other
  misc_feature (46)..(46): n is a, c, t, g, unknown, or other
nnnnncccccccccnntcncnntttccccctctccttgtttgagnncgccccaagctggagctccccgcggtggcggccgctctataactagtggatcccccgggctgcaggaattcgcacgagaccattacctagaacatcctaatcgaaaaagaacttctgccactgcccttccatctcgtcccttagctacaagtcatctcgccgcaaccggaacccgcagccatggggacggaggcggagcagccggacatggacagccaccgaaacgacggcgtcgtggtggtgccagcgccgcgcccgcgtaaggggctcgcctcctgggcgcttgacctgctcgagtccctcgccgtgcgcctcggccacgacaagaccaagccgctccactggctctccggaaacttcgcccccgtcgtcgaagaagaacccgccggcccccaaacctttaacgcccgcgggacacctcccgggaagtgctttgaatgggagaagtttgtccaaggtttggcgcctaaattccgaaaggtttggctcccgggttggggggggatatcacctgggttttggatggggaaaacgggaaatggattcattggcccttggcgtaatttaaagggatgggaaaaaagctaccctaatggtattcaacgaaaatgggggaataactgggcccccccctccaaacaagaaagggagctattttttgggggggaacaaaagttcttatgaaaagaatggcagaaccttaaaaggggatttttttggggaattggtttaaggggccccaaatggggaacaacccttccgaaaacaaa

SEQ ID NO: 22310 - protein, 167 aa, Zea mays
  misc_feature: Ceres CLONE 1392034-F
MGTEAEQPDMDSHRNDGVVVVPAPRPRKGLASWALDLLESLAVRLGHDKTKPLHWLSGNFAPVVEEEPAGPQTFNARGTPPGKCFEWEKFVQGLAPKFRKVWLPGWGGISPGFWMGKTGNGFIGPWRNLKGWEKSYPNGIQRKWGNNWAPPSKQERELFFGGEQKFL

SEQ ID NO: 22311 - DNA, 683 bp, Zea mays
  misc_feature: Ceres CLONE 1392035-F
  misc_feature: Encodes the peptide sequence at SEQ ID NO. 22312
  misc_feature (360)..(360): n is a, c, t, g, unknown, or other
  misc_feature (466)..(466): n is a, c, t, g, unknown, or other
atagctggagctccccgcggtggcggccgctctagaactagtggatcccccgggctgcaggaattcgcacgagaccattacctagaacatcctaatcgaaaaaaaaagctggcagtgtcggtgtcggtgtcgtcgtcggcgtcggtgctggggagcgggcgagcggcgcgtcgcatgattctgtcctcctgacgtggcagctaacgattccgattccctttggttgcagtgcgacgacattgacatggacatggcgcagctggagtggctgtcggggctcttcgacgacgcatccatcccgcacgagccggcgttccccggcgcggcgcccatcatcaagagctccgcgctggcggccgncgcgctgctgcccgccggacagatgggggacgcgctgctgttccgcagctccagccccatctcggtgctggagcacggaagctttcacaaacgccacggcggtggncggcggctgctccgcgtcgtcggagtcgtcctcggcgtcctcgtcctcggagtctttctccggcagcgggagccgcgaaggccattgctgggtcggcgcccgtgtccccgccacccgggttctgtataacggggcgggggggggaagaaagggctcccgcccgttcgggtttacggggggccggggggggagggggccacccattcttggggcggag

SEQ ID NO: 22312 - protein, 116 aa, Zea mays
  misc_feature: Ceres CLONE 1392035-F
  misc_feature (39)..(39): Xaa is any aa, unknown, or other
MDMAQLEWLSGLFDDASIPHEPAFPGAAPIIKSSALAAXALLPAGQMGDALLFRSSSPISVLEHGSFHKRHGGGRRLLRVVGVVLGVLVLGVFLRQREPRRPLLGRRPCPRHPGSV

SEQ ID NO: 22313 - DNA, 710 bp, Zea mays
  misc_feature: Ceres CLONE 1392036-F
  misc_feature: Encodes the peptide sequence at SEQ ID NO. 22314
  misc_feature (606)..(606): n is a, c, t, g, unknown, or other
  misc_feature (637)..(637): n is a, c, t, g, unknown, or other
cgcggtggcggccgctctagaactagtggatcccccgggctgcaggaattcgcacgagaccattacctagaacatcctaatcgaaaaaaccccaccagaccttcaaccgctacatttccgtcactaccggagccgccactccgacgaacgcgggcggcggagcggaagcgaaccagagcaccggtaaaaagaaaaggatgaggcttgggagtataaacggcttgcggttcacgcagcttaaacttgtcatccttgcgttcttcatgttgtttgttctctggaaatgggagaagggctcgtcatactacgattccgaaatcctccagccagatccgttggttctgactcatccagctaactcgaagtttgtagaccagcatacatccccagaagaagactttccaagtgcagatcgatcacaccggtcagtaggtaaagtagaaaagccggttactagtgcgctgccaccattgtctacgataggctattctgttgatgttgcagatggggaatgaagtgccacctcctgagaagaaagaatgcgagtacaggaatggggaagtgggtttctgacaatcgtagacactaattactccaggggttggnttgaaagcaatgggctttcagagaggttggncctgcaaactaaccccagcgaaaagattccgcgtatgaaaaaatcagatggcagcctggaagctggtgagaag

SEQ ID NO: 22314 - protein, 105 aa, Zea mays
  misc_feature: Ceres CLONE 1392036-F
MRLGSINGLRFTQLKLVILAFFMLFVLWKWEKGSSYYDSEILQPDPLVLTHPANSKFVDQHTSPEEDFPSADRSHRSVGKVEKPVTSALPPLSTIGYSVDVADGE

SEQ ID NO: 22315 - DNA, 884 bp, Zea mays
  misc_feature: Ceres CLONE 1392037-F
  misc_feature (14)..(14): n is a, c, t, g, unknown, or other
  misc_feature (15)..(15): n is a, c, t, g, unknown, or other
  misc_feature (37)..(37): n is a, c, t, g, unknown, or other
  misc_feature (48)..(48): n is a, c, t, g, unknown, or other
  misc_feature (49)..(49): n is a, c, t, g, unknown, or other
tttccccccccttnnttttttttccttctgagaaagncccccgccttnntctagctggtgctccaccgcggtggcggccgctctagaatagtggatcccccgggctgcaggaattcgcacgagaccattacctagaacatcctaatcgaaaagtggcttctcattcattgttgattgattgatcctcccccgcctcactcctttgtctcctcgcctcgtgctcgctcgctcccctccgccctgggggaggagggcagcagaaaccctagcggctcaggcccggggcgggggttagatgctccaaggttccagaagaaaagggaaggttaatgctgcccccttcaattatgggcttggggccttcccgccggggggggcttcgctttacctctgtggaggcccataaaaataatggggccaaagggggaaagccctctccccccacccccaaaagggggtggccctccatccgaaagcccccccccaaacccaacaaaaaaacgggtggtcctcccccccgcgcccccccgctatcacaccccaagaatatccatgaaaccacaaagaagaatttcgacctccccccgcccttctccccccggcaatcacaaacctctttcccccccctctttttccaaaaccatttgctcctcttcattcaaaacctccggggagaccccccctcccctcgatttgtgcgagccctcccctcccgcgtagaaaatttaataaagccactctttataaaagaataaccctcgcgaaaccacaatcaacaaccctgccccccccacgcccacccacacccctttatgccagcgcaccctcgcttcttaacaaaataaaatgctcttcctcaccttactggtctagaacagacaccg

SEQ ID NO: 22316 - DNA, 670 bp, Zea mays
  misc_feature: Ceres CLONE 1392038-F
  misc_feature: Encodes the peptide sequence at SEQ ID NO. 22317
  misc_feature (199)..(199): n is a, c, t, g, unknown, or other
tccccgcggtggcggccgctctataactagtggatcccccgggctgcaggaattcgcacgagaccattacctagaacatcctaatcgaaaaatagagatagagatagacagctagcttcatcagtaggatgggcagcgacgaggaagcgccgctgctggtgccggcggtggaggaggtttgccccgggtgcgtgatggnacgcggaaggcgaccaccaacggcaggatccccctacgggaggttgttttcgggggcggccacctccctcggctaagttttacggacccggggcccctcccccttcttggatttccgggaaaggacttccccgggcccttaaaaaaaaggaaaaattcccgatttcttgggggggttttcttggggggggccacatggggggggaaaaaggttttcccttccccttttggggggggccttcccaaacccccggttggaagagaaaccccgccaccacccttttccaaaaacgggccgggggggggttatctcgcggcgggttttttggtcaaacaccccccctctgggggggggtggccccccccccgaggggggggggggggggggctcaacaaaggggcggcctccccccaaaaaaagagggccttttggttttttttcttcccccacccccccccccacgggggtttt

SEQ ID NO: 22317 - protein, 48 aa, Zea mays
  misc_feature: Ceres CLONE 1392038-F
  misc_feature (24)..(24): Xaa is any aa, unknown, or other
MGSDEEAPLLVPAVEEVCPGCVMXRGRRPPTAGSPYGRLFSGAATSLG

SEQ ID NO: 22318 - DNA, 671 bp, Zea mays
  misc_feature: Ceres CLONE 1392039-F
  misc_feature: Encodes the peptide sequence at SEQ ID NO. 22319
  misc_feature (247)..(247): n is a, c, t, g, unknown, or other
  misc_feature (285)..(285): n is a, c, t, g, unknown, or other
  misc_feature (345)..(345): n is a, c, t, g, unknown, or other
  misc_feature (392)..(392): n is a, c, t, g, unknown, or other
  misc_feature (482)..(482): n is a, c, t, g, unknown, or other
  misc_feature (533)..(533): n is a, c, t, g, unknown, or other
aaagctggagctccccgcggtggcggccgctctagaactagtggatcccccgggctgcaggaattcgcacgagaccattacctagaacatcctaatcaaaaaaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcnggcggaaagcagcagcaggcgggcgacatgccgagcgncagcgtgttctcccggtcggtgaacctcaagcacgtcaagctggggtaccagtacctggntgaccacttcctgacgctgctgctggtgccggtgatggccgccacgncgctggagctggcgcgcctcggccccggcgagctgctctcgctgtggcgctcgctggagctggacctgggtcacatcctctgctccgcgntcctggtcgtcttcgtcggcaccgtgtacgtgatgtcgcgccccaggccgntgtacctggtggactacgcctgctacaagcccccgccagctggcgcgtgcccttcgccacctcatgaagcacacgcgctcatcagcgacgacgacaagagcgtgcgcttccagaacaggatcctggaccgctcggggc

SEQ ID NO: 22319 - protein, 132 aa, Zea mays
  misc_feature: Ceres CLONE 1392039-F
  misc_feature: SWISSPROT Homolog: EC 2.3.1.119 Icosanoyl-CoA synthase
  misc_feature (4)..(4): Xaa is any aa, unknown, or other
  misc_feature (24)..(24): Xaa is any aa, unknown, or other
  misc_feature (40)..(40): Xaa is any aa, unknown, or other
  misc_feature (70)..(70): Xaa is any aa, unknown, or other
  misc_feature (87)..(87): Xaa is any aa, unknown, or other
MPSXSVFSRSVNLKHVKLGYQYLXDHFLTLLLVPVMAATXLELARLGPGELLSLWRSLELDLGHILCSAXLVVFVGTVYVMSRPRPXYLVDYACYKPPPAGACPSPPHEAHALISDDDKSVRFQNRILDRSG

SEQ ID NO: 22320 - DNA, 830 bp, Zea mays
  misc_feature: Ceres CLONE 1392041-F
  misc_feature: Encodes the peptide sequence at SEQ ID NO. 22321
  misc_feature (14)..(14): n is a, c, t, g, unknown, or other
  misc_feature (34)..(34): n is a, c, t, g, unknown, or other
ttttcccccccccncccccccccacaccttttantattatccatattatacaaagctggcactccccgcggtggcggccgctctattaatagtggatcccccgggctgcaggaattcgcacgagaccattacctagaacatcctaaaaaaaaacaaaacctccactcttcctcccaccaaggcaccaacccgacgcaaagccgccggctttccccgatggcgacgacgatgtcagtttcggcgaagaccccgcccgccgcggatgtcacgcgaccccggacgatggtctgcgtgccggcgaccgcgcggccgccgcgtgagaatgcgtttgaactggacgccgccgacgagatcgacgcccacctgatggaacctccgccccacggccccgccggtttcacgccgggaaaggaactggcccgccttccccgccgaaggcccgtcggctccccggccctccaaaccttccgggcccaaggggggaaggggggcggaaaaacgaaagggaaattaccaaatccccgggtgagaaggctcctcacattatgggacaaagggcacacccggcgaaaacaaaaaaaacgggggagagccccccgacttaaagggggggccccacaaaactcaaccaaacattttttttcgggggaggaaaaacacggagtgaaagtggggagactcttatagtggtccccccccgccagctttgtgggggcccccccctcctccccccccagagaaactctcggatatttgtggggcgtccaaagtcacccaccaagggtcctccttctttacttcaaaaaaaaatacccccccccccccccccg

SEQ ID NO: 22321 - protein, 156 aa, Zea mays
  misc_feature: Ceres CLONE 1392041-F
MATTMSVSAKTPPAADVTRPRTMVCVPATARPPRENAFELDAADEIDAHLMEPPPHGPAGFTPGKELARLPRRRPVGSPALQTFRAQGGKGGGKTKGKLPNPRVRRLLTLWDKGHTRRKQKKRGRAPRLKGGAPQNSTKHFFSGEEKHGVKVGRLL

SEQ ID NO: 22322 - DNA, 811 bp, Zea mays
  misc_feature: Ceres CLONE 1392043-F
  misc_feature: Encodes the peptide sequence at SEQ ID NO. 22323
  misc_feature (11)..(11): n is a, c, t, g, unknown, or other
  misc_feature (12)..(12): n is a, c, t, g, unknown, or other
  misc_feature (30)..(30): n is a, c, t, g, unknown, or other
  misc_feature (44)..(44): n is a, c, t, g, unknown, or other
  misc_feature (218)..(218): n is a, c, t, g, unknown, or other
atttttttttnnttttttttttaattttcnttttcacaaaacanaaaaaagctggagctccccgcggtggcggccgctctagaactagtggatcccccgggctgcaggaattcgcacgagaccattacctagaacatcctaatcgaaaaacccacgctgccctcggcgctgcgcctggacccggcacctacctcccccctccccacctcgccgccggngggtggagtcgggctggagcagccgctctcctctgttacccccctaaccccctataaagaaaaagaaaaaaaaacagagagagagagcgagcgaccggcgtctcggcagccatggggcacggcgtcagctgcgcccgcaccggcgacgagcacgactacttccgcgcggcgcaggtcggggacctcgaggccctgaacgcgctccctcgacgccgacccctctctcgcccggcggggccacgtttctacgaccgccttctccgcggcttcacatcgccgcccgcgaatgccccgcctccgagggtgctggcaaagggccttggaatccacggggtggcccgccggaaaggtggtggaaaccgggcaacaagcaaaaccgccgctgtagtgctccgcggggaatgcaccggcaaaaaaatgaacttgccgtgcttgaaaacctcctgggaaaggcccggcggccaaaaaatcccccctggtatccgaattccccaaagaaggggggcggaaacccggctctgggaacacaacggggttccctaaattttctcggccaaaacgtccgagcttgtgccttgggaaggggcccattc

SEQ ID NO: 22323 - protein, 143 aa, Zea mays
  misc_feature: Ceres CLONE 1392043-F
MGHGVSCARTGDEHDYFRAAQVGDLEALNALPRRRPLSRPAGPRFYDRLLRGFTSPPANAPPPRVLAKGLGIHGVARRKGGGNRATSKTAAVVLRGECTGKKMNLPCLKTSWERPGGQKIPPGIRIPQRRGAETRLWEHNGVP

SEQ ID NO: 22324 - DNA, 628 bp, Zea mays
  misc_feature: Ceres CLONE 1392049-F
  misc_feature: Encodes the peptide sequence at SEQ ID NO. 22325
aaagctggagctccccgcggtggcggccgctctagaactagtggatcccccgggctgcaggaattcgcacgagaccattacctagaacatcctaatcgaaaactcgtgttcttgttcgtctccgcctcaggcaactccacacggtcacacctcgctcgctctcgctcccgtatcgcggtttccttttcgaagccttgctaggtttagctggggcctctgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcggtcacttctctggacgggtgttgcagatcgagatcgtcgctggggatgacgccctcggggccaagggcgcaccgggcgaggggtgctcatctcctgccgactgggccgtgcaccgcaagcgacgacgggaggagctccgacgcgacaaagaatctagaaaatacttgccagatccaggaaactggaaaagttgaacctgaaaaaggggatggcccacaaaggaaggcaatggccctgtaaatcttaaaaa

SEQ ID NO: 22325 - protein, 99 aa, Zea mays
  misc_feature: Ceres CLONE 1392049-F
MDPDFSPASGGPSFEFAFNSVTSLDGCCRSRSSLGMTPSGPRAHRARGAHLLPTGPCTASDDGRSSDATKNLENTCQIQETGKVEPEKGDGPQRKAMAL

SEQ ID NO: 22326 - DNA, 667 bp, Zea mays
  misc_feature: Ceres CLONE 1392050-F
  misc_feature: Encodes the peptide sequence at SEQ ID NO. 22327
  misc_feature (438)..(438): n is a, c, t, g, unknown, or other
  misc_feature (459)..(459): n is a, c, t, g, unknown, or other
  misc_feature (502)..(502): n is a, c, t, g, unknown, or other
  misc_feature (506)..(506): n is a, c, t, g, unknown, or other
  misc_feature (519)..(519): n is a, c, t, g, unknown, or other
  misc_feature (590)..(590): n is a, c, t, g, unknown, or other
  misc_feature (594)..(594): n is a, c, t, g, unknown, or other
tccccgcggtggcggccgctctagaactagtggatcccccgggctgcaggaattcgcacgagaccattacctagaacatcctaatcgaaaacattttctcggccgggagccgcaattccatcctgctgctagagttacatactcacccaatagaacaattctatgcccggtgattgtacctcctgaagtagaagagcatactgaagcagaactcgagtggtgttggatcgaaatggaaggcgggatgtcaagtttggaagccgccatgaaagcttcttcatcgatggcaagcagcatggcaaggaatgctgaccctaaccaacagactctccgccccaatttaagtggagcagttctattttccaagacctggtcaatctttgccaggcattcctccattttttgggcctccctctagtttgtatcttcctaatgacnatgaagctaaatttggcaacnactttgaatcaaatccttcacagaatacagattggaacccacnagcnatagtgagcaccntaaccttccttgagcagaagatcagcaggtaaaggataattgtgcagtccatgagtaaccgagagaccagnaaanctgggggttcccggggagaggaaactgcaaagcagcagctcataaccgctgacctcactagcattataatcag

SEQ ID NO: 22327 - protein, 61 aa, Zea mays
  misc_feature: Ceres CLONE 1392050-F
MEGGMSSLEAAMKASSSMASSMARNADPNQQTLRPNLSGAVLFSKTWSIFARHSSIFWASL

SEQ ID NO: 22328 - DNA, 686 bp, Zea mays
  misc_feature: Ceres CLONE 1392052-F
  misc_feature: Encodes the peptide sequence at SEQ ID NO. 22329
  misc_feature (196)..(196): n is a, c, t, g, unknown, or other
  misc_feature (457)..(457): n is a, c, t, g, unknown, or other
  misc_feature (570)..(570): n is a, c, t, g, unknown, or other
tccccgcggtggcggccgctctacaactagtggatcccccgggctgcaggaattcgcacgagaccattacctagaacatcctaatcgaaaaagtcgtgcccgcttgtttcccttgctcgccttcacccctcgccgccgccgccgccgtcgccgtcgcaagcgacgatgctcgacatcaacttgttccgcaccgacnagggcggcaacccagaccttattcgcgagtcccagcgcagtcggttcgcctccgtcgagctcgtcgacgaggtcatcgccctcgacaaggcatggcgcgaaaggcagttcgagctggacaagatccggcaggagctcaacgctaccagcaagaagatcggcaagctcaaagccagcaagcaagaggaggaagcgaagaagctcatggagagcacagacgaaattaagaaaagggttgcaggcaaagaagttgagggtgcangagggcaagagcaccctcgacgcccaggtcacgacgattggcaacatcgtgcatgaatccctgccagtccagcgacgaacgaggaaaacaataatattggacggacattttgnaaagaaaaaaagtaaagggatattttggaagaacccccggggacctttggaagaaggcttggattttggcccaattgaaaaaaaggggtgctatagggggtttgaggggaaaaaag

SEQ ID NO: 22329 - protein, 115 aa, Zea mays
  misc_feature: Ceres CLONE 1392052-F
  misc_feature (1)..(98): Pfam Name: Seryl_tRNA_N Pfam Description: Seryl-tRNA synthetase N-terminal domain
  misc_feature: SWISSPROT Homolog: EC 6.1.1.11 Serine--tRNA ligase
  misc_feature (11)..(11): Xaa is any aa, unknown, or other
  misc_feature (98)..(98): Xaa is any aa, unknown, or other
MLDINLFRTDXGGNPDLIRESQRSRFASVELVDEVIALDKAWRERQFELDKIRQELNATSKKIGKLKASKQEEEAKKLMESTDEIKKRVAGKEVEGAXGQEHPRRPGHDDWQHRA

SEQ ID NO: 22330 - DNA, 699 bp, Zea mays
  misc_feature: Ceres CLONE 1392053-F
  misc_feature: Encodes the peptide sequence at SEQ ID NO. 22331
ggagctccccgcggtggcggccgctctatgaactagtggatcccccgggctgcaggaattcgcacgagaccattacctagaacatcctaatcgaaaaaaccttcgcctctcctcccgttgtcagccgccgtgcctgttctctctgcctttctaaaagtgcggcgactggttgggctgccgccgactgccggggccttcgccgacctcttcgccggcgaagaggtcccatcaggagaaggagtagatcgtcgacccagaaccctcgctgatggcgactttcgcgaaacctgagaacgcgctgaagagagccgaagaattaatccatgttggtcaaaagcagtcagccctgcaggctttacatgatctcattacctcgaagaggtacaggtcatggcagaagcctctcgaaaagatcatgatgaagtatgtagaactctgtgttgacctgaggaaaggcagatttgcaaaagatggtcttattcagtataggattgtctgccagcaagtaaacgtgtcatccttgggaggaggtcataaagcacttcatgcagctttcaaatgagaaagctgaacaagctaaaaagtcagggtcgaacaactggaagattgctctggggatggccaaaaatctttgaagcaagacaagccgccccgaggaccctcagtggttcagtttttggtccagggggcggaaaaaag

SEQ ID NO: 22331 - protein, 97 aa, Zea mays
  misc_feature: Ceres CLONE 1392053-F
MATFAKPENALKRAEELIHVGQKQSALQALHDLITSKRYRSWQKPLEKIMMKYVELCVDLRKGRFAKDGLIQYRIVCQQVNVSSLGGGHKALHAAFK

SEQ ID NO: 22332 - DNA, 665 bp, Zea mays
  misc_feature: Ceres CLONE 1392054-F
  misc_feature: Encodes the peptide sequence at SEQ ID NO. 22333
  misc_feature (494)..(494): n is a, c, t, g, unknown, or other
  misc_feature (495)..(495): n is a, c, t, g, unknown, or other
  misc_feature (503)..(503): n is a, c, t, g, unknown, or other
  misc_feature (515)..(515): n is a, c, t, g, unknown, or other
  misc_feature (534)..(534): n is a, c, t, g, unknown, or other
  misc_feature (544)..(544): n is a, c, t, g, unknown, or other
  misc_feature (564)..(564): n is a, c, t, g, unknown, or other
  misc_feature (571)..(571): n is a, c, t, g, unknown, or other
  misc_feature (584)..(584): n is a, c, t, g, unknown, or other
tcaccgcggtggcggccgctctagaactagtggatcccccgggctgcaggaattcgcacgagaccattacctagaacatcctaatcgaaaaaacccaacccaaccgcgctttttgtcacctctcacctggaaagggaagacaagtcgagattcgagaaggcaaatcgaattcgccatgggcatggctgctccgcgcgcgccgctgcctctcccccaactgctgctcctcctcgttgctgcgctcctcgccgccgctcccctccctagggcggccggggcggacgagttcgacgtccgccgccacctctccaccgtcaccaggtatgatgtggccagggagtccagtagtgtcatctccatgccgtcaatcccagacgggtgccgtgtcattcaccctcatctagtggcaagacatggggactcgtgctcctaccaagaagcgcatcaaggagctggatagatggcccagtcgactggaagcccttctgaaaganngcaatcangtcccttgatangtgatctctgaagaaaatnccatcctggnataaagggctggatcacgcntgaaggntaggactaaaggntgtgagctgattaatggaggggaaaaaggagctgtacaattagctacagatgaggggaaaagtttcagatttatttgagac

SEQ ID NO: 22333 - protein, 94 aa, Zea mays
  misc_feature: Ceres CLONE 1392054-F
MGMAAPRAPLPLPQLLLLLVAALLAAAPLPRAAGADEFDVRRHLSTVTRYDVARESSSVISMPSIPDGCRVIHPHLVARHGDSCSYQEAHQGAG

SEQ ID NO: 22334 - DNA, 753 bp, Zea mays
  misc_feature: Ceres CLONE 1392055-F
  misc_feature: Encodes the peptide sequence at SEQ ID NO. 22335
  misc_feature (1)..(1): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (34)..(34): n is a, c, t, g, unknown, or other
  misc_feature (36)..(36): n is a, c, t, g, unknown, or other
ntttccccccccccccccccnnnnnnnnnntatntngggggcaaaccccggccaaagctggagctcaccgcggtggcggccgctcttcaactagtggatcccccgggctgcaggaattcgcacgagaccattacctagaacatcctaatcgaaaagatccgccactacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatctcccgcgccttccgcctcaccgtcgcgctccgtcgccgcctcgccgcgcgggacgtctccgccttcctcgccttcgcgctacccgcgtcctccgaagcctacggacgcctcactgccctggtgcccaaggaagatgatactggagatggatgttgatgctgcagctccagcaactcagatttcaatcaaacatggtctccccctgagattgaaatatattgctacttgctccgaactgattcttccttattgattataaagaaatatgatggagggttaagggatggcgcaaggtgggaccaattgcctccgcctgaagaaatccaaacccggaggaaactgggttgatggtgtattgggcatcctacgacttgtcactta

SEQ ID NO: 22335 - protein, 102 aa, Zea mays
  misc_feature: Ceres CLONE 1392055-F
MTEDVQMNDSEPQPAASAPAVGAPALSTLHHLKEIASVIEAGSLSKEVRRISRAFRLTVALRRRLAARDVSAFLAFALPASSEAYGRLTALVPKEDDTGDGC

SEQ ID NO: 22336 - DNA, 652 bp, Zea mays
  misc_feature: Ceres CLONE 1392060-F
  misc_feature: Encodes the peptide sequence at SEQ ID NO. 22337
  misc_feature (556)..(556): n is a, c, t, g, unknown, or other
  misc_feature (592)..(592): n is a, c, t, g, unknown, or other
  misc_feature (616)..(616): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
gctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgtcctacggcgccgaggtgtcggcggtggccgacaagggccggctcaagaagatcacgggcgtcaaggccaaggagatgctgctgtgggtcaccctccacgagatctgcgtcgacgacccgcccactggtaagctccactggcaggccatcggcggcctggtccgcagcttccccgtcgaggncttcgagggccgagagcccgcgccgccgggagccgncggtgtcgtccccagggacgcgangaannnnnngagannnnnnnnnnnnnnnnnnnnnnn

SEQ ID NO: 22337 - protein, 161 aa, Zea mays
  misc_feature: Ceres CLONE 1392060-F
  misc_feature (2)..(149): Pfam Name: DUF538 Pfam Description: Protein of unknown function, DUF538
  misc_feature (137)..(137): Xaa is any aa, unknown, or other
  misc_feature (149)..(149): Xaa is any aa, unknown, or other
  misc_feature (157)..(157): Xaa is any aa, unknown, or other
  misc_feature (158)..(158): Xaa is any aa, unknown, or other
  misc_feature (159)..(159): Xaa is any aa, unknown, or other
  misc_feature (160)..(160): Xaa is any aa, unknown, or other
MTLTIPDEVRAKAEVYVGDAAGQEKTRLLLQETGLPSGLLPLRDIIECGYVEETGFVWLRQRRKVDHYFAKAGRHVSYGAEVSAVADKGRLKKITGVKAKEMLLWVTLHEICVDDPPTGKLHWQAIGGLVRSFPVEXFEGREPAPPGAXGVVPRDAXXXXR

SEQ ID NO: 22338 - DNA, 669 bp, Zea mays
  misc_feature: Ceres CLONE 1392061-F
  misc_feature (266)..(266): n is a, c, t, g, unknown, or other
  misc_feature (476)..(476): n is a, c, t, g, unknown, or other
  misc_feature (478)..(478): n is a, c, t, g, unknown, or other
  misc_feature (479)..(479): n is a, c, t, g, unknown, or other
  misc_feature (482)..(482): n is a, c, t, g, unknown, or other
  misc_feature (484)..(484): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (519)..(519): n is a, c, t, g, unknown, or other
  misc_feature (520)..(520): n is a, c, t, g, unknown, or other
  misc_feature (653)..(653): n is a, c, t, g, unknown, or other
ccccgcggtggcggccgctctagaactagtggatcccccgggctgcaggaattcgcacgagaccattacctagaacatcctaatcgaaaagtatctcgcccgcctccttttgctttgctttgctttgctttccctgctgcatgggcacgcaacgcagcggagcagagcatcacgtgcagctccggctggagtactccctgctcccgcctcccatggatgggtgggctcatggcctgtatccgattccgaggaccgagacgacgacnactacgacgaacacggaggtcctatacttacgtggccggttggcgggtacggctgaacccaattatcacatgcgtgtgcggctgtgcgccgccgctacactcgccggcgacgagccttcgtgtcggctcagagaaacagacagacatgcagagtccagaaatccaacagagaaacagggctccgacccactcgcgcgctggctcgctggnanncgngngtccctcgccacctccgnnnacgccgcgcgctcgnncgccgggttgcagggcctcatcgacgcgtcccctgcggcggggcgagtcgcagaacatccacgcgcagctcctagcgtcgggactcgtcggcagtgccgacctctctgtcagctccctcgtctgcaaatacgntgggggctcctgcaca

SEQ ID NO: 22339 - DNA, 737 bp, Zea mays
  misc_feature: Ceres CLONE 1392063-F
  misc_feature: Encodes the peptide sequence at SEQ ID NO. 22340
  misc_feature (34)..(34): n is a, c, t, g, unknown, or other
  misc_feature (43)..(43): n is a, c, t, g, unknown, or other
ccttcccccccctccccccctcctctttttctcntataacccnaaaccaaaactggagctccccgcggtggcggccgctctagaatagtggatcccccgggctgcaggaattcgcacgagaccattacctagaacatcctaatcaaaaactgtctcgtcggctcgtcgctccgtagaccccgcgcctccgcctccccgccactcgccggaggctgccgccatcgttatgccatggccgtcatcctctcctccgcggcgccaacgatactgactcgtcccacgcgccctcggaggcagccgaggagcggcctccgcgggggcctcgcgcgcctctcagctgcgctcggcctcgcgcacgcgggcgccggcgccggcgccgcactcgccgcgccgctctcctacgaggagatgctgcgcctctcgtccgactccggcggtgatgttggcgggttcgcgctcccggagctcggcctcgacgggctcgttgacttcgtcaacgataaccctctcgccgtcgcggcaggcgtcgcggccatcgcagtgccgcttctccttgcgcagcttcctcggcggaaggcggaaggttcaaagcccttactccggtcctgtcggccaaagccggccttaccagggggtttgctccagggaaccccgaacgggcaagttcgtccaacatcaagggcggttcaaaggatggaccgcaaaagggcgcgaacacgccttggatctctaagggg

SEQ ID NO: 22340 - protein, 168 aa, Zea mays
  misc_feature: Ceres CLONE 1392063-F
MAVILSSAAPTILTRPTRPRRQPRSGLRGGLARLSAALGLAHAGAGAGAALAAPLSYEEMLRLSSDSGGDVGGFALPELGLDGLVDFVNDNPLAVAAGVAAIAVPLLLAQLPRRKAEGSKPLLRSCRPKPALPGGLLQGTPNGQVRPTSRAVQRMDRKRARTRLGSLR

SEQ ID NO: 22341 - DNA, 678 bp, Zea mays
  misc_feature: Ceres CLONE 1392065-F
  misc_feature: Encodes the peptide sequence at SEQ ID NO. 22342
  misc_feature (392)..(392): n is a, c, t, g, unknown, or other
  misc_feature (393)..(393): n is a, c, t, g, unknown, or other
  misc_feature (412)..(412): n is a, c, t, g, unknown, or other
  misc_feature (462)..(462): n is a, c, t, g, unknown, or other
  misc_feature (518)..(518): n is a, c, t, g, unknown, or other
tccccgcggtggcggccgctctataactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccaccgccccccgatgagatccagctcgcgaagcagcgcgcgcaggagatcgcggcgcggatctttaacgccgcagaggnncagcgtcctcgcgtcgacnacggcgacgatgacagcggcggctttcgtgtaggcctgggcagcactggntggccgtggccgcatcgggcggcggaggactcgggttctcggcccctggcgggggnggggaccgggggttctatcccacaatatcctctcaagagaggggaactcagtactccccttaggggggataccagggcacaaggaaaaggtggaatttccaaagggagggggggggggtattctttggaaaagcggggaaatattttgggtatccccctt

SEQ ID NO: 22342 - protein, 166 aa, Zea mays
  misc_feature: Ceres CLONE 1392065-F
  misc_feature (71)..(71): Xaa is any aa, unknown, or other
  misc_feature (78)..(78): Xaa is any aa, unknown, or other
  misc_feature (113)..(113): Xaa is any aa, unknown, or other
MADDHYSSKRKYDDPSPPPRRTGFSSGPPPASPLAGGAPSYNSVPPPPDEIQLAKQRAQEIAARIFNAAEXQRPRVDXGDDDSGGFRVGLGSTGWPWPHRAAEDSGSRPLAGXGTGGSIPQYPLKRGELSTPLRGDTRAQGKGGISKGRGGGYSLEKRGNILGIPL

SEQ ID NO: 22343 - DNA, 630 bp, Zea mays
  misc_feature: Ceres CLONE 1392067-F
  misc_feature: Encodes the peptide sequence at SEQ ID NO. 22344
  misc_feature (333)..(333): n is a, c, t, g, unknown, or other
cgctcttcactagtggatcccccgggctgcaggaattcgcacgagaccattacctagacatcctaaaaaaaactgaggcgagggagagagagagagagtgagtgagtgagtaatgggcggttcatcaggccttgtggactggagaggacggccggtgaacaccaagaagcatggaggagtgagagcttcaattttcattcatgcgctggtgctgctcagcaacgtagcccacattgccagtatactgaatcttgtaagctatctgcgcgaggagatgcacatggatgtcgcgagggcgacgacgatggcgagcaatttctttgccgcgctgcnaatgttctccatcccagcagcctttccttgctgactcctaacttaagcgtttctacactgtcctcatctttgggcccaatgaaatactgggcttactcccgggtccggggccaaggaaatgggcccattccctggaccccaccaccgggggggcccctggaaaaaaaaaaaaaaaaccgtgggggaaccccgggggggggggttcaaaaaccgggagcccggcctcccccccgggggggcccccacaccgtggaccccccctgtgggggggggggggggggggggccccccgcggcc

SEQ ID NO: 22344 - protein, 84 aa, Zea mays
  misc_feature: Ceres CLONE 1392067-F
  misc_feature (74)..(74): Xaa is any aa, unknown, or other
MGGSSGLVDWRGRPVNTKKHGGVRASIFIHALVLLSNVAHIASILNLVSYLREEMHMDVARATTMASNFFAALXMFSIPAAFPC

SEQ ID NO: 22345 - DNA, 671 bp, Zea mays
  misc_feature: Ceres CLONE 1392069-F
  misc_feature: Translation starting site: 225
  misc_feature (533)..(533): n is a, c, t, g, unknown, or other
  misc_feature (565)..(565): n is a, c, t, g, unknown, or other
  misc_feature (571)..(571): n is a, c, t, g, unknown, or other
  misc_feature (631)..(631): n is a, c, t, g, unknown, or other
ggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctcccggaagaagtacgggcccatcttccccatgcggatggggcagcgcaccctcatcgtggtcacctcggcggagctcatccacgaggcgctgggtgaagcagggccccatgttcgcgagccggnccgaggacagccccaccccgctcctcttcagngtcggnaagtgcaccgttcactcggcgcctacggcccccctggggcgtgctctgcgccgcacttcntcggcgagattgtgtccccgcaccgcgtcaaggcttcttc

SEQ ID NO: 22346 - DNA, 631 bp, Zea mays
  misc_feature: Ceres CLONE 1392073-F
  misc_feature: Translation starting site: 172
gctctcaactagtggatcccccgggctgcaggaattcgcacgagaccattacctagaacatcctaatcgaaaaacatagtcgaaggctacgagcactcgccgccactcaccagcaaattcccaagccgcccctttccccatctctttcgcgacccatttgatcgattcctgatggcgcccaaggccgagaagaagcccgcggagaaaaagccggcggaggagaaggccgagaagaagccaagggcggagaagcgcgtgccgagcaaggagggcggcgagaagaagggaaagaagaaggcgaagaagagcgtcgagacgtacaagatctacatctttaaggtgctcaagcaggtgcacccggacattggcatctcgtccaagggccatgtccatcatgaactccttcatcaacgacatcttcgagaagctcgccgccgaggccgccaagctcgcccgctacaccaagaagcccaccatcacctcccgggagatccagacctcgggtccgcctcgtccctccccggggagttcgccaagcaccgccgaatccgaaggggaccaaggcggggtaacccaggttaacctccccccttaaggggggcccccccccacggttttttaccaatcccgg

SEQ ID NO: 22347 - DNA, 670 bp, Zea mays
  misc_feature: Ceres CLONE 1392075-F
  misc_feature: Encodes the peptide sequence at SEQ ID NO. 22348
  misc_feature (331)..(331): n is a, c, t, g, unknown, or other
tggagctccccgcggtggcggccgctctagaactagtggatcccccgggctgcaggaattcgcacgagaccattacctagaacatcctaatcgaaaaatcccacgctgccctcggcgctgcgcctggccccggcacctacctcccccctccccacctcgccgccggcgggtggagtcgggctggagcagccgctctcctctgttaccccctaaccccctataaagaaaaagaaaaaaacagagagagagcgagcgaccggcggctcggcagccatggggcacggcgtcagctgcgcccgcaccggtgacgagcacgactacttccgcgcgncgcaggttcgggacctcgaggccctggaagcgctcctcgacgctgacccctcccttgcccgccgcgccacgctctacgaccgcctctccgcgctccacatcgccgccgcgaatggccgcctccaggtgctgccaatggtcttgaaacccgggttggcgccggacggtgtgaacccgcacaagcagacgccgttgatgctcgcggcgatggacggaaagaccgatggcgggttgaagctcctggcggccggggccaatatcctctgggtcgaatcccccagaaggggtgtatctggctggcccacggggttctaatttgggcacgtgggggtggctggcg

SEQ ID NO: 22348 - protein, 123 aa, Zea mays
  misc_feature: Ceres CLONE 1392075-F
  misc_feature (20)..(20): Xaa is any aa, unknown, or other
MGHGVSCARTGDEHDYFRAXQVRDLEALEALLDADPSLARRATLYDRLSALHIAAANGRLQVLPMVLKPGLAPDGVNPHKQTPLMLAAMDGKTDGGLKLLAAGANILWVESPRRGVSGWPTGF

SEQ ID NO: 22349 - DNA, 670 bp, Zea mays
  misc_feature: Ceres CLONE 1392079-F
  misc_feature: Encodes the peptide sequence at SEQ ID NO. 22350
tcaccgcggtggcggccgctctagaactagtggatcccccgggctgcaggaattcgcacgagaccattacctagaacatcttaatcgaaaaaagaattcgcacgcacagagcacttttgctaaatcgctagttcgtttcctaaaccctagcaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcggggccgatggctacctgtactgcgagggagtgcgggtggaggacgcgatgacggctgctgagcgcagccccttctacctctacagcaagccacagatcctccgcaccctcgccgcttaccgcgatgctctccaggggctccgctccatcatcgggtatgccgtgaaggccaacaacaaacctcccgtgctacgcgtcctgcgtgagcttggctggcgcgcccgtctcgtcagcggcaacgagctccgactcgccctccaggcggaattcgaccccgccagttgtatatttaacgga

SEQ ID NO: 22350 - protein, 170 aa, Zea mays
  misc_feature: Ceres CLONE 1392079-F
  misc_feature: SWISSPROT Homolog: EC 4.1.1.20 Diaminopimelate decarboxylase
MASASMLARSLLRTPDPTQTSHPNRRSAAVVSFPRRHRRLSVRASVSTASPSPPPQPAAAAAGVPKHCFRRGADGYLYCEGVRVEDAMTAAERSPFYLYSKPQILRTLAAYRDALQGLRSIIGYAVKANNKPPVLRVLRELGWRARLVSGNELRLALQAEFDPASCIFNG

SEQ ID NO: 22351 - DNA, 792 bp, Zea mays
  misc_feature: Ceres CLONE 1392081-F
  misc_feature: Encodes the peptide sequence at SEQ ID NO. 22352
  misc_feature (12)..(12): n is a, c, t, g, unknown, or other
  misc_feature (13)..(13): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
gtggcccccccnncccnnnnccccaccacacaataacgggcaccccccccaaaactgggactccaccgcggtggcggccgctctacaatagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcggacccggacgccggctcgccggccttctcggtgcgcgtgcgccgccgcctgcccgaacttcctgcagtcggtgaacctcaagtaggtgcgcctcgggtaccactacctcatcagccagggggtgtacctggcccccatccccgccatcgtggttggggggcgccgcccaacttgggccaagcttcagcccgcaacaaagctgtggccccaagggggtgggggggaaggccaacttaagaactccccccaccgggggttcgcctttccctcggccggccctccgcctttcacccttcctccgggctaacatccatggcccaggcccccagggcccggtggaaccctccatcccaactttcgccaggggcaacaagacccgcccccaacgatgacttcaagggggtcccaaaaggggcgaaccccatcccgcaacggggggggggcaaagtcacgggcccgactccccaccccg

SEQ ID NO: 22352 - protein, 99 aa, Zea mays
  misc_feature: Ceres CLONE 1392081-F
MAREEQALLSTEIVNRGVEPSDPDAGSPAFSVRVRRRLPELPAVGEPQVGAPRVPLPHQPGGVPGPHPRHRGWGAPPNLGQASARNKAVAPRGWGGRPT

SEQ ID NO: 22353 - DNA, 779 bp, Zea mays
  misc_feature: Ceres CLONE 1392085-F
  misc_feature: Encodes the peptide sequence at SEQ ID NO. 22354
  misc_feature (48)..(48): n is a, c, t, g, unknown, or other
  misc_feature (50)..(50): n is a, c, t, g, unknown, or other
agttcccctccccccccccccccctcccattagtggtgtgatataccncnaaaaactgggctacccgcggtggcggacgatctacaatagtggatcccccgagctgcaggaattcgcacgagaccattacctagaacatcctaatcaaaaaactcccaaaatcccaaaaccctagctcgctaacgaccccaggcagacgcgccgtcctcccctcccccatggcgctcaagcagaagggcaccgacgccgccgccgccaccgacaccggtaccaagacgcgccgccgcgtcttcttctccgacaccgatgctggtgttgaggcaaatgagtgtatgaaagtgtttctagtatggaatccaggcgaggtggcctctgtaaactgcactgctaatcagccatatagactaaaccattttttttgggggaagaggaaaaaatattatggttacaaaattcctaagataagggtggggataagggcgaaattctttccatggaaaatgttgatgttttcattttgacaaaacattctgatggggggaaaaggaataaaaagattctaagggccgggttcttcaagaacaattttttggaggaaaaacttgggtcagaaaaagggggagatttcctgcataacatttttacgaaaggaaagggagaatataatccataaccgggcagtggaccaaatggggcaggggcccctttaaggcagtggaggggctccaatatggaatccaaaatcccttgcccagttgaaagattgtgtcccgaggttg

SEQ ID NO: 22354 - protein, 100 aa, Zea mays
  misc_feature: Ceres CLONE 1392085-F
  misc_feature: SWISSPROT Homolog: EC 2.3.1.48 Histone acetyltransferase
MALKQKGTDAAAATDTGTKTRRRVFFSDTDAGVEANECMKVFLVWNPGEVASVNCTANQPYRLNHFFWGKRKKYYGYKIPKIRVGIRAKFFPWKMLMFSF

SEQ ID NO: 22355 - DNA, 663 bp, Zea mays
  misc_feature: Ceres CLONE 1392086-F
  misc_feature: Encodes the peptide sequence at SEQ ID NO. 22356
  misc_feature (620)..(620): n is a, c, t, g, unknown, or other
ggagctccccgcggtggcggccgctctacaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgccctcgtgtttcgtgctctgattggtgagtcttcaatgagagctgattccagttatatagaggtgaacaagcttttgattatttcttttgttaattgggtgcaacatatagaggtgaacaagcttattaaaggagatcctttgtacaatcagagttcaatacatagatgagacgatattgtgattctctcaatggtgctncatgagcaagcatcattcactttgtcactaaaatttcagactg

SEQ ID NO: 22356 - protein, 90 aa, Zea mays; identical to SEQ ID NO: 11994
  misc_feature: Ceres CLONE 1392086-F

SEQ ID NO: 22357 - DNA, 679 bp, Zea mays
  misc_feature: Ceres CLONE 1392090-F
  misc_feature: Encodes the peptide sequence at SEQ ID NO. 22358
  misc_feature (254)..(254): n is a, c, t, g, unknown, or other
  misc_feature (256)..(256): n is a, c, t, g, unknown, or other
  misc_feature (257)..(257): n is a, c, t, g, unknown, or other
tccccgcggtggcggccgctctataactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagcccctcggcgcaggcagccaagaacagagagagcgagatggatgtgaacgacgtgctgctagtgttgctgncnngcgcgctggctgccatggggtggcgtcggtgctccaagaccggcggtgtcgacggcctcccggcgggccctccgggttggccggtggtggggatctgttccaggggatcctggagcgacggccctcatgtacgtggtgcgcgacctccggaagaagaacggcccattctcccatgggggatgggcacccaccctcatcggggccccctcggcggagtcatccaccaggggttggggaacaagggccccatgttcccgagccggccccgaaggaagccccccccgcttccttctcaggggggggaaaggggacccggaaactcggggccctacggcccccccggggggggggttcttcgccccaactttcggtgcccagaagatcggggcccccgcaccccggggaaggggctttcccccggg

SEQ ID NO: 22358 - protein, 153 aa, Zea mays
  misc_feature: Ceres CLONE 1392090-F
  misc_feature (12)..(12): Xaa is any aa, unknown, or other
  misc_feature (13)..(13): Xaa is any aa, unknown, or other
MDVNDVLLVLLXXALAAMGWRRCSKTGGVDGLPAGPPGWPVVGICSRGSWSDGPHVRGARPPEEERPILPWGMGTHPHRGPLGGVIHQGLGNKGPMFPSRPRRKPPPLPSQGGERGPGNSGPYGPPGGGVLRPNFRCPEDRGPRTPGKGLSPG

SEQ ID NO: 22359 - DNA, 669 bp, Zea mays
  misc_feature: Ceres CLONE 1392093-F
  misc_feature: Translation starting site: 153
  misc_feature (376)..(376): n is a, c, t, g, unknown, or other
  misc_feature (377)..(377): n is a, c, t, g, unknown, or other
  misc_feature (380)..(380): n is a, c, t, g, unknown, or other
  misc_feature (381)..(381): n is a, c, t, g, unknown, or other
  misc_feature (384)..(384): n is a, c, t, g, unknown, or other
  misc_feature (461)..(461): n is a, c, t, g, unknown, or other
  misc_feature (522)..(522): n is a, c, t, g, unknown, or other
  misc_feature (523)..(523): n is a, c, t, g, unknown, or other
  misc_feature (530)..(530): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (539)..(539): n is a, c, t, g, unknown, or other
  misc_feature (572)..(572): n is a, c, t, g, unknown, or other
  misc_feature (669)..(669): n is a, c, t, g, unknown, or other
cgcggtggcggccgctctacaactagtggatcccccgggctgcaggaattcgcacgagaccattacctagaacatcctaatcaaaaagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagcggcgaccaaggggtggagggcggccgacctggggtacgtggccatcctcccgtcgctgctcctccgggcgctgcacaaccaggcgtggatcaccgcgtcccgcctgcagagcgcgcgcgnncgnncgncaggtcgtggacgccggcatcgagttcgagcaggtggaccgcgagcgcaactgggacgaccagatcctgctcagcgncatcctcctgtacctggctcacctaccctgggcggggggggcagcaacctgccggttgggnngccgcgnacnnncccncgctcatccgccctgctggacgccgggccccgncgaggtcggctactactggttggaccgggcggtgcaccaccactttctctaatcccggtaacacttccaccaacaggccttcattggcaccgagccn

SEQ ID NO: 22360 - DNA, 673 bp, Zea mays
  misc_feature: Ceres CLONE 1392095-F
  misc_feature: Encodes the peptide sequence at SEQ ID NO. 22361
ggagctccccgcggtggcggccgctctatcaatagtggatcccccgggctgcaggaattcgcacgagaccattacctagaacatcctaatcgaaaaatctttttcctcgtgtcactcccctgctgctgctgctgccgggaagatcaaatcccgtcaaaaggctccaaaggatcagagttctgtcaagatggcatgcccaagaggaaggacaccatttcccctttgtttctttctgatgatttgcctcatggctcagctgggagcttccaatgttgtactcatggcgataaacactaccttgtcgttggatgatgtcgaggcaacttttagtggatgttacacattattacactatctccatgtatctctgtacatgacaattaaaaatctggttagctgttgtttttatcaaacacaaaagtacgttgcatgccattatattaacaagatgaaaaacagtataaaaaccccggtcattaacacactctccagcacattgttagtaacctgttgaggttaatgatctggttttctttaataccaagttggccctgtttttagtggataaagggatggacaggccttcctcttttttttgcgttgttaagtataaatggctccccccattttcttggttaaaaagttgcatcattctggcatctttaaaggaacc

SEQ ID NO: 22361 - protein, 108 aa, Zea mays
  misc_feature: Ceres CLONE 1392095-F
MACPRGRTPFPLCFFLMICLMAQLGASNVVLMAINTTLSLDDVEATFSGCYTLLHYLHVSLYMTIKNLVSCCFYQTQKYVACHYINKMKNSIKTPVINTLSSTLLVTC

SEQ ID NO: 22362 - DNA, 916 bp, Zea mays
  misc_feature: Ceres CLONE 1392096-F
  misc_feature: Encodes the peptide sequence at SEQ ID NO. 22363
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (37)..(37): n is a, c, t, g, unknown, or other
  misc_feature (876)..(876): n is a, c, t, g, unknown, or other
tttttcccccccccccccccnntngttgtgtgggttntgtgcccccccccccaaagtggaactcaccgcggtggcggccgctctatcaatagtggatcccccgggctgcaggaattcgcacgagaccattacctagaacatcctaatcgaaaaacctcaggcctcgctcagatctctccgcccgggtccatcttcccaccccaaaccttctcccgcctctctcgtcaacgccgcccgacgagagggatggcggccttgcgggctccggccgcaacgctcctcgtcctcctcgccctagcggcggccggcggcgtgtcgtccgacggctccgatcaccggtacaagattcgcgaagcccgtcccgctctacgcccacaaggtccggcccatttcacaatccccagtggaaacattatcgatattctcgaccctggcctttctggctctccctgacaaaaggtgaaaggagaaagagccgaggccccctttggggggagggttcctccaaacggggcaaatcggcgtaaaacgtagactggcgcccattaccgtaggcttcgatttctccccggggcacccgcaagccctgctccacccccccacggcccacgttctctcctccccagacaaaaggaccttaaattaacccaggggcctgctgcgcataccggcagccgcgccaccaaaacccgacccccggtatcaaccaaagcgtattaactgcatcctactgcgagaaaacaaacaccgatagcaccaaactcccgcccgaaccaaccgcaccgcgtctgctcccccttcacacaccaacacgccagcacagagcgcggcggcagagaacgaaccggacgacccggtgaagcagcgccggggcgncgccccgtcgcaccaaggtgcaaacaataagcgacgcccc

SEQ ID NO: 22363 - protein, 68 aa, Zea mays
  misc_feature: Ceres CLONE 1392096-F
MAALRAPAATLLVLLALAAAGGVSSDGSDHRYKIREARPALRPQGPAHFTIPSGNIIDILDPGLSGSP

SEQ ID NO: 22364 - DNA, 661 bp, Zea mays
  misc_feature: Ceres CLONE 1392101-F
  misc_feature: Encodes the peptide sequence at SEQ ID NO. 22365
  misc_feature (622)..(622): n is a, c, t, g, unknown, or other
cgcggtggcggccgctctataatagtggatcccccgggctgcaggaattcgcacgagaccattacctagaacatcctaatcgaaaaatttccaagtcccaatccaccgacgaattccaaaccctgcctaggacctcggcgccactcgccgcacgtcgtccacgtccgcctccaccccaatccgatggggtatgaagagagcaaaaaacatctcctcagtctcagctaccctgagctgcaatgtttgtgcaaaaggtataaccttcctgctaagaagacccactctcagttagcaagttcgctcgcctcgctgcttgaggcatctccatctcctgctcctcctcctgtccaattagcaaatatgaaagaagcatccacatgcaatcatgctaacaacaaaagaggcccatacaatggcagggatgatggtaaaccacttgtgcatgcgaaacatcaaaaaggagatcagacacctgttgatgaaacatctaaaagggggattgacactggtacgagtatacctccagtttctatgaaccatggaagaccagaatatcatggccatctatctttctgactgagaactggtcataatttacagtcccaaagtgacgtgggaattngcactaatacacaaatctagaatttgtttgcaaacatga

SEQ ID NO: 22365 - protein, 130 aa, Zea mays
  misc_feature: Ceres CLONE 1392101-F
MGYEESKKHLLSLSYPELQCLCKRYNLPAKKTHSQLASSLASLLEASPSPAPPPVQLANMKEASTCNHANNKRGPYNGRDDGKPLVHAKHQKGDQTPVDETSKRGIDTGTSIPPVSMNHGRPEYHGHLSF

SEQ ID NO: 22366 - DNA, 677 bp, Zea mays
  misc_feature: Ceres CLONE 1392103-F
  misc_feature: Encodes the peptide sequence at SEQ ID NO. 22367
ggagctccccgcggtggcggccgctctataactagtggatcccccgggctgcaggaattcgcacgagaccattacctagaacatcctaatcgaaaagctctagcgaaggcacagccgccgctgtttcttcatcttcctcgcagcgccggcgctccatcttactctccctcccttactagcgcttgacacgcaggtgacggcggcagcgacggcgctcaggctcgggctcttagtgacggcatcagcggcttcccctcccgcctcttgccagtcccatcgcgccctcgcctcgggtcctctgcacaccgtccagtgaccttgcgtgatggactggataaagttttgcagcgattttactgcaagtgatgggaaacagcatgcattgcttgataatcttaatcaggaattgtcccagaagtctgtactattgggtgatggttttaaactgtcagctgctgataatgatgtgtttgcaactggtcatccttttgggatccgtggtaaggacagcgagttggagaaatatccacatgtactggggtggatggactacattcagaacactggtgggtgctgggacaactttgcaaaagaaaaatggggccaggtctgactttgatccaccttcccctccaaggaaaggtgataaaaaaagatgctggatcaaagttcaaaga

SEQ ID NO: 22367 - protein, 95 aa, Zea mays
  misc_feature: Ceres CLONE 1392103-F
MDWIKFCSDFTASDGKQHALLDNLNQELSQKSVLLGDGFKLSAADNDVFATGHPFGIRGKDSELEKYPHVLGWMDYIQNTGGCWDNFAKEKWGQV

SEQ ID NO: 22368 - DNA, 697 bp, Zea mays
  misc_feature: Ceres CLONE 1392104-F
  misc_feature: Encodes the peptide sequence at SEQ ID NO. 22369
acccgcggtggcggccgctctattactagtggatcccccgggctgcaggaattcgcacgagaccattacctagaacatcctaatcgaaaacaactcccccggccgtcctgctcgccggcttctggctggcccctgcatccgcccagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcggggcggcatcaccgtcttcgtgcccaaggactcggcgttcgcggcgctgaagcagaccacgttcgccaacctcacccaggaccagctcaggtcgctgctgctgtgccacgcgctgcccaagtactactcgctggccgaagtcgaccggttgagcgcgctcggcccggtggccaccctcgccggctcgcagtacacgctgaacctcacctacgacatggccacgtcccgcgtgaaaccca

SEQ ID NO: 22369 - protein, 169 aa, Zea mays
  misc_feature: Ceres CLONE 1392104-F
  misc_feature (64)..(169): Pfam Name: Fasciclin Pfam Description: Fasciclin domain
MEFKAGVFTVAMLAIVVLSTPAAPQKPKSPPAPRSPVVLAPAPAPAPAAPHHVDLADLLSVAGPFHTFLDYLQKTGVIETFQSQANDTKRGGITVFVPKDSAFAALKQTTFANLTQDQLRSLLLCHALPKYYSLAEVDRLSALGPVATLAGSQYTLNLTYDMATSRVKP

SEQ ID NO: 22370 - DNA, 609 bp, Zea mays
  misc_feature: Ceres CLONE 1392107-F
  misc_feature: Encodes the peptide sequence at SEQ ID NO. 22371
  misc_feature (320)..(320): n is a, c, t, g, unknown, or other
  misc_feature (609)..(609): n is a, c, t, g, unknown, or other
ccccgcggtggcggccgctctatcctagtggatcccccgggctgcaggaattcccacgagaccattacctaaaacatcctaatcgaaaaagaggctaaacccccgtctaaccctggctgccgtagccgctatgccactactccgcttcgttctccgccgcctccccggacgtccggaaacttctagattgaagggggatagccattggcgtcaacgtgtgtgatggaggtcaggggactggggcagctcctggcggcgctggccgcggcgttcttcgtccgcgccatcgcgggacccggacccgccctccttccgccggnggaggacacggaggtcgacgaggccgacgcggaggctggctaggaaggtggtgttggtgtgccgcccgtgaccatcgggtgggctcggatcacctgcgcactgaagaaacagcgcggggaagtgccaagttttctgttggcaaatgtgtcaggggaagccaaaccgggggaggctgctggaacaaagggggccaatcgggctcggggaaaaaaaactttgctccagggggctaagaagggaaattcggccgaatcggctttcctgggaccttttccggggttctcggan

SEQ ID NO: 22371 - protein, 46 aa, Zea mays
  misc_feature: Ceres CLONE 1392107-F
  misc_feature (33)..(33): Xaa is any aa, unknown, or other
MEVRGLGQLLAALAAAFFVRAIAGPGPALLPPXEDTEVDEADAEAG

SEQ ID NO: 22372 - DNA, 790 bp, Zea mays
  misc_feature: Ceres CLONE 1392108-F
  misc_feature: Encodes the peptide sequence at SEQ ID NO. 22373
aagctggagctccccgcggtggcggccgctcttcaatagtggatcccccgggctgcaggttttcgcacgagaccattacctagaacatcctaatcgaaaacatcaccaccactgggtcttcagaccattagctttatctactccagagcgcagaagaacccgatcgacaccatgagggtgttgctcgttgccctcgctctcctggctctcgctgcgagcgccccctccacgcatacaagcggcggctgcggctgccagccaccgccgccggttcatctaccgccgccggtgcatctgccacctccggttcacctgccacctccggtgcatctcccaccgccggtccacctgccgccggcgggtccacctggcaccgcccggtccatgtggcggccgccggttcatctgccccccgcccccatgccactaacctaattcaccggcccgggcttaacctcattcccagccaccccccatgtcccgggccaacaagcggcatccaaagcccgggccacctggaaggaaaacctgcgggggttgggaaaaaccccccaatcctgggccaaggggggccaagttttcctggaggcattaagtggaacccccaaggggaaacgcccctattggtccccccctaagggccaccctttggcgcaaaaaaagtgtttccacaacccttcccgggagggggggagcccgccaaccccgcgaaccggggcggccttctcgcgggtggcccctcccgctcaactccgtggaaaccaacaccacaaaaacggcccattcccgg

SEQ ID NO: 22373 - protein, 39 aa, Zea mays
  misc_feature: Ceres CLONE 1392108-F
MSRANKRHPKPGPPGRKTCGGWEKPPNPGPRGAKFSWRH

SEQ ID NO: 22374 - DNA, 653 bp, Zea mays
  misc_feature: Ceres CLONE 1392109-F
  misc_feature: Encodes the peptide sequence at SEQ ID NO. 22375
gctctacaactagtggatcccccgggctgcaggaattcgcacgagaccattacctagaacatcctaatcgaaaaagggctttgctcctcccaactctcgaaaccctacccacccgatgagagatcgatcggtcgagcgcgaattccccagccgcgagcggggggatcggccgccgcccggggtgctggggcccccgcgccgcgggccggcgtacaagacgaagttgtgcgcgctgtggcagcgcggcggctgttcccgcgacacatgcagcttcgcgcacggacacgccgagctccgccggttccccggatcgcgcacctcgttcccaccccgcgccgggagaagagattatagagctggtgactttagagataggtttgataggaggcgctcacctcataggaggcattcccctgatggagattccaggggccatcgctcccttcgtgaccgacggtcaaattcccaagaaagggaatctagctattcccggtctcccagtaagaagagtgaaatgaggtttgagaaaaagcctgatgatggagaaactaactcctctaggagtctcagtggctctgacaataacgatgacacacacaagcaggccctgttcaatggtgctgataaagacgtcctcaaactctgctcacaac

SEQ ID NO: 22375 - protein, 179 aa, Zea mays
  misc_feature: Ceres CLONE 1392109-F
  misc_feature (33)..(57): Pfam Name: zf-CCCH Pfam Description: Zinc finger C-x8-C-x5-C-x3-H type (and similar)
MRDRSVEREFPSRERGDRPPPGVLGPPRRGPAYKTKLCALWQRGGCSRDTCSFAHGHAELRRFPGSRTSFPPRAGRRDYRAGDFRDRFDRRRSPHRRHSPDGDSRGHRSLRDRRSNSQERESSYSRSPSKKSEMRFEKKPDDGETNSSRSLSGSDNNDDTHKQALFNGADKDVLKLCSQ

SEQ ID NO: 22376 - DNA, 792 bp, Zea mays
  misc_feature: Ceres CLONE 1392110-F
  misc_feature (28)..(28): n is a, c, t, g, unknown, or other
  misc_feature (406)..(406): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
tccagctggagctccccgcggtggcggncgctccagtaccacaaaaccccccgggctgcaggaattcccacgagaccattacctagaacatcctaatcgaaaagtgttcgagtccatcttcttgtgccatccaacccctcgtccgtagatcgatcgctgctacgcgcctgcatgctgacggttcggcgccgctgatgcgatgaagctctcgtagcccgacgttagcgagaagacgggatcgcacaagtactgaggtctcggccaggtgtcgatttggttcaaccgagggagcacctgtgcattgctataccaacaatgctggatcgggttgccatgtcagctgaggattctgccctgggttgattatttccacgctgaaagagggtctcccggttcttaattccantccggggaaaggcccgggccaattttggaaaaaaaggattcccaatcctttggaatggcccccggggaaaacccggaaaattttgggnnnnnnnnncttggccactctggatttgggccgggtttcttggccaatactgggccccctggaaaactgggggccccctgggacactccacccgggggggcggggggggaacctgggtgtttttttttttggggaaaaaaaaaaagaacccacttgggggaccccattgggcgccccgggggcgccctcttattcccctataggaaacaaccggcccccgcaagggggagaaaaacccctttgtgccccaggagggggaggtcaaagagtttttgtgaaatggcctctcggagaggggg

SEQ ID NO: 22377 - DNA, 661 bp, Zea mays
  misc_feature: Ceres CLONE 1392112-F
  misc_feature (254)..(254): n is a, c, t, g, unknown, or other
  misc_feature (263)..(263): n is a, c, t, g, unknown, or other
  misc_feature (267)..(267): n is a, c, t, g, unknown, or other
  misc_feature (268)..(268): n is a, c, t, g, unknown, or other
  misc_feature (274)..(274): n is a, c, t, g, unknown, or other
  misc_feature (325)..(325): n is a, c, t, g, unknown, or other
  misc_feature (354)..(354): n is a, c, t, g, unknown, or other
  misc_feature (377)..(377): n is a, c, t, g, unknown, or other
caccgcggtggcggccgctctataactagtggatcccccgggctgcaggaattcgcacgagaccattacctagaacatcctaatcgaaaaaaaccgtttcgcatctccgctacccccagccaagtcgctcccggtggctccgttctccgcgccttcgttccccctcggttttcctgctgtttcgcctcggtcctgcttgctggtgctgcagatctgcgttcgccggccccttctccctgctatcgcatgccagncaggcgccnacgnncacggncagcccccacccacaggcgtggcactggccctgggtcggctgttccttgcnttttgctgcctgggcctgctcctggtggnctcggcacctgcacgaggagaangaggtatacgagcccgcaggcaggaattccaatcgggacttgtggaattccgaaagccaacccaaggaaggggaggcatcccctctccggggggagttagaggaaaacccctctttcccataaaggggggggggagggtccctttcccaaaaaaaataggtagaaaaatttttaaattctcggaccaggcttcaaaaaaaaaaaaaaggacccggaaacaaacaataaaaaaggaagggaaaagaaaaaaaacaaaccccaaaccccctcccccgaaatatgtg

SEQ ID NO: 22378 - DNA, 742 bp, Zea mays
  misc_feature: Ceres CLONE 1392114-F
  misc_feature: Encodes the peptide sequence at SEQ ID NO. 22379
  misc_feature (574)..(574): n is a, c, t, g, unknown, or other
  misc_feature (638)..(638): n is a, c, t, g, unknown, or other
  misc_feature (650)..(650): n is a, c, t, g, unknown, or other
  misc_feature (732)..(732): n is a, c, t, g, unknown, or other
  misc_feature (742)..(742): n is a, c, t, g, unknown, or other
aagctggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatcccagtcgtcgtcgacgcgatcatcaacagtggcccccgtgaggatgccccaccgtatgcctccgctggntgtgtgagaaggcaggccgtggatatctcacccctgagggaggtgacccagccatctacctccntcacactggtgncagggagagtgcttttccgaacatcaaaccatttgcgagtgccttgcagatgagctgatcaacgctgcccaaggctcatccnacagttacgn

SEQ ID NO: 22379 - protein, 169 aa, Zea mays
  misc_feature: Ceres CLONE 1392114-F
  misc_feature (44)..(162): Pfam Name: Ribosomal_S7 Pfam Description: Ribosomal protein S7p/S5e
  misc_feature (149)..(149): Xaa is any aa, unknown, or other
  misc_feature (153)..(153): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIPVVVDAIINSGPREDAPPYASAGCVRRQAVDISPLREVTQPSTSXTLVXGRVLFRTSNHLRVPCR

SEQ ID NO: 22380 - DNA, 641 bp, Zea mays
  misc_feature: Ceres CLONE 1392117-F
  misc_feature: SWISSPROT Homolog: EC 3.2.1.21 Beta-glucosidase
  misc_feature (317)..(317): n is a, c, t, g, unknown, or other
  misc_feature (335)..(335): n is a, c, t, g, unknown, or other
aaagctggagctccccgcggtggcggccgctctagaactagtggatcccccgggctgcaggaattcgcacgagaccattacctagaacatcctaatcgaaaaacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacnacgatctggcaagagtanggcagcccaaaatgaagtccaaaaatgttggaggccccctcgggaaatccccccaaaaggggaggggggtccccccttgaatcccccttggggccgccccttcgggaacaaaattaaagggtttggaaaaaaaaggaaaagggaaaaaaaactgggaaccctttggcccaacccccccggaaagggaatgggggggggggaaatttcaacaattggggggggaatccctccccctttggaaaaaaaaagggggcctttttttttttcctaaaaaaaaggggggggtgggggcccccaatatgtgtc

SEQ ID NO: 22381 - DNA, 669 bp, Zea mays
  misc_feature: Ceres CLONE 1392122-F
  misc_feature: Encodes the peptide sequence at SEQ ID NO. 22382
  misc_feature (595)..(595): n is a, c, t, g, unknown, or other
  misc_feature (661)..(661): n is a, c, t, g, unknown, or other
aaagctggagctccccgcggtggcggccgctctagaactagtggatcccccgggctgcaggaattcgcacgagaccattacctagaacatcctaatcgaaaaattacggctgaagggagtcgctcgccgccgcgttcgaggcgttccctcgtcgcgctcgcgccgtcgaccttcaccgctcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggcggcgacaatggaggacgaggagatggagaagaaggtgcagcagtacttgcagcgcaagggtttccgcctcactgagcttgcgctccaggaggagtgcaaccgcctctccacctccgccatctccgacgttgcgcttgcacggtctgacaatgatccagcgagatactacgatggatatagcagattaagaacatgggcatacagttctcttgatncatataagcacgaattacttcgcgtcctttatccagttttcatccatagcttcatggatctagggncagaagga

SEQ ID NO: 22382 - protein, 94 aa, Zea mays
  misc_feature: Ceres CLONE 1392122-F
  misc_feature (70)..(70): Xaa is any aa, unknown, or other
  misc_feature (92)..(92): Xaa is any aa, unknown, or other
MEDEEMEKKVQQYLQRKGFRLTELALQEECNRLSTSAISDVALARSDNDPARYYDGYSRLRTWAYSSLDXYKHELLRVLYPVFIHSFMDLGXEG

SEQ ID NO: 22383 - DNA, 769 bp, Zea mays
  misc_feature: Ceres CLONE 1392124-F
  misc_feature (11)..(11): n is a, c, t, g, unknown, or other
  misc_feature (17)..(17): n is a, c, t, g, unknown, or other
  misc_feature (83)..(83): n is a, c, t, g, unknown, or other
  misc_feature (243)..(243): n is a, c, t, g, unknown, or other
gtgggtggggnaccccncccactcaacaaacccaccagcttggaccggcactcccctaaagtggagctccccgcggggggggncggctcttccactagaggatcccccgggctgcaggtttccgcacgagaccattacctagaacatcctaatcgaaaagtatcctcgtagcaaaattccagctacttgccaggcgatcccgtcaacggtttgtttgaagtaataggtgaggaaactgagcgncttgccagaaagtggcccgcgaaaaggtaggtgggtggaacccatccgcgcatgggagcgtgacctctgaccgttgatgtacgacgcggtgcactcgacgcggatgaccgtccaacttatacaacatagtgcgccgccgggacgttgcttctgccggctggggagaaccatgagggtccgagcgcggccgctgtggatgaagcgcgcagcctctccgaacgaggacgagcgccccctgaacatggcccacttctcggccgtggtggcgcacacgtaagagtcgtccccgtcagacgcggttcgtggcggagagaggcggcgaccaacctcccgccccggccggtgctgggtcggaagaaagtttgcattaaacggcgggctttcttcccgggccgccggccggggcgtctaggtgtgaggggccgtccggggcggggaccccccacggaaaagcggagcaacaggaacccaaccgaccgggggttgacgagggtccctcgaccggcgccgacgcctgccgccgggc

SEQ ID NO: 22384 - DNA, 661 bp, Zea mays
  misc_feature: Ceres CLONE 1392124-R
  misc_feature: Pfam Name: GMC_oxred_C Pfam Description: GMC oxidoreductase
  misc_feature: SWISSPROT Homolog: EC 4.1.2.10 Mandelonitrile lyase
ccaattgcggaccgggccccccctcgaggtcgacggtatcgataagcttttttttttttttttttaaaacgatgtgctgaattataccatccacattttgtgcaaattaatcggtgtggaattcatccattacaattagcatctccaattaacttgtacgatcgccactaaaagaatcttcaaggttaaacgcaccctgtagagatgtagagatgtgagtgagactaggcctttttctgcttcatccttccagaagcatcctctccttcaagagcttgacgcccatgtacctgccgagcatcatgaccgtggcctgcgggttggtgcccggcgaggcgttgaacgtggagccgtcgatgacgcggaggcgtcgagccgagcacctgtagtcgcggtcacgacccaggcgacctggaccccgcaggtagtgccagatgacatcactgtgtacctgcagaacgctccagcgccctggggtccccgcccaccggtacagcgtgttcccgggaactccgccctgaactttaacccggccggaaaacccaaattttggaaggtgaaccccgaagaaggccctgaaacggatcacccccttcaaaggggagaatgccccccaaaccaccggggggaaaggcctcccggggggcccaaaaaaatttaa

SEQ ID NO: 22385 - DNA, 731 bp, Zea mays
  misc_feature: Ceres CLONE 1392125-F
  misc_feature: Encodes the peptide sequence at SEQ ID NO. 22386
  misc_feature (443)..(443): n is a, c, t, g, unknown, or other
  misc_feature (444)..(444): n is a, c, t, g, unknown, or other
aagctggagctccccgcggtggcggccgctctagaactagtggatcccccgggctgcaggaattcgcacgagaccattacctagaacatcctaatcgaaaaactgccgcgccgccaccctctacagataaggaagaggaggagggcaggatgtcgcaccgtaagttcgagcacccgaggcacggctccctcggcttccttcccaggaagcgctcctcccgtcaccgcggaaaggtgaagtcattccctagggatgaccccaagaagccttgccatctcactgccttccttggctacgaggctggcatgactcacattgtccgtgaggttgagaagccaggatccaaactccataagaaggagacttgtgacgctgttaccatcattggaacccctcctactgtcattgttgggctcgtggcatatgtgaagactccccgtggnnctcgcacactcaactctgtttgggccccacatcttaccgaggagggaggaagaaggtctacaggacctgtgcaagaccaaaagaaggttttccccagcttgctccccaaaattgaaaaggggctggaaagaagaaattcaattggccttggaaaaataaaaaaaatggttgggttcccggggcttggccaaacccaatttaagaaataagggtttaaaaaaaaaagccccccggggggaatttgggcagggggccccttttgaaaagggggcattggtcaaattttt

SEQ ID NO: 22386 - protein, 167 aa, Zea mays
  misc_feature: Ceres CLONE 1392125-F
  misc_feature (51)..(166): Pfam Name: Ribosomal_L3 Pfam Description: Ribosomal protein L3
  misc_feature (99)..(99): Xaa is any aa, unknown, or other
MSHRKFEHPRHGSLGFLPRKRSSRHRGKVKSFPRDDPKKPCHLTAFLGYEAGMTHIVREVEKPGSKLHKKETCDAVTIIGTPPTVIVGLVAYVKTPRGXRTLNSVWAPHLTEEGGRRSTGPVQDQKKVFPSLLPKIEKGLERRNSIGLGKIKKMVGFPGLGQTQFKK

SEQ ID NO: 22387 - DNA, 691 bp, Zea mays
  misc_feature: Ceres CLONE 1392126-F
  misc_feature: Encodes the peptide sequence at SEQ ID NO. 22388
  misc_feature (245)..(245): n is a, c, t, g, unknown, or other
  misc_feature (281)..(281): n is a, c, t, g, unknown, or other
  misc_feature (365)..(365): n is a, c, t, g, unknown, or other
ggagctccccgcggtggcggccgctctataatagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggngcacggggttctcttcgggcccgccgcctggctcgncgctcgcgggcggcgccccgtcgtacaacagcgtgccaccgccccccgatgagatccagctcgcgaagcagcgcgcgcaggagnatcgcggcgcggatcttttacgccgcagagggcaagcgtcctcgcgtcgaccacggcgacgatgacagcggcggtttccgtggtaggcctggcagcacttggtggcggtggccgcatcggcggggggaggactcggcttctcgccctctgggcggaggggggcacgggggttttaatcccccaaattattttctcaaagcggggaacctcaggactcctcctttagggggggaattcggggaacagcacaaaagattggaattcccaaaggggaaggggtttggggttcaacacttggaaaacccccgggaaacttctttaaggaa

SEQ ID NO: 22388 - protein, 81 aa, Zea mays
  misc_feature: Ceres CLONE 1392126-F
  misc_feature (21)..(21): Xaa is any aa, unknown, or other
  misc_feature (33)..(33): Xaa is any aa, unknown, or other
  misc_feature (61)..(61): Xaa is any aa, unknown, or other
MADDHYSSKRKYDDPSPPPRXTGFSSGPPPGSXLAGGAPSYNSVPPPPDEIQLAKQRAQEXRGADLLRRRGQASSRRPRRR

SEQ ID NO: 22389 - DNA, 698 bp, Zea mays
  misc_feature: Ceres CLONE 1392130-F
  misc_feature: Encodes the peptide sequence at SEQ ID NO. 22390
  misc_feature (521)..(521): n is a, c, t, g, unknown, or other
  misc_feature (652)..(652): n is a, c, t, g, unknown, or other
  misc_feature (691)..(691): n is a, c, t, g, unknown, or other
  misc_feature (696)..(696): n is a, c, t, g, unknown, or other
cgctcagtactagtggatcccccgggctgcaggaattcgcacgagaccattacctagaacatcctaatcgaaaaattgggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggaaggtaggaggcctgaggggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgcctggttccgcgaccactggtcccgcgagcacgcccacctggacgagatagccgagcagctcgagttggtcgccctccttgcctacgatgaggatgaggacctcttctacggcgagnaggcccccgccgccgccgcccttaagacagattcggtgctcaaggcgctgaacttgggtccccgaaagagcgcgacgcccccgcggggttccgggagaaaccccagcactcgagaaaagcgaccagtacgncggcagcccaagagcagggctcctcgcgtgatccacagnctcgnta

SEQ ID NO: 22390 - protein, 136 aa, Zea mays
  misc_feature: Ceres CLONE 1392130-F
  misc_feature (79)..(79): Xaa is any aa, unknown, or other
  misc_feature (135)..(135): Xaa is any aa, unknown, or other
MSAVAVSSSLNPNAPLFIPAALLQVEDFSPQWWDLITTTAWFRDHWSREHAHLDEIAEQLELVALLAYDEDEDLFYGEXAPAAAALKTDSVLKALNLGPRKSATPPRGSGRNPSTREKRPVRRQPKSRAPRVIHXL

SEQ ID NO: 22391 - DNA, 674 bp, Zea mays
  misc_feature: Ceres CLONE 1392135-F
  misc_feature: Encodes the peptide sequence at SEQ ID NO. 22392
  misc_feature (573)..(573): n is a, c, t, g, unknown, or other
  misc_feature (612)..(612): n is a, c, t, g, unknown, or other
tccccgcggtggcggccgctctagaactagtggatcccccgggctgcaggaattcgcacgagaccattacctagaacatcctaatcgaaaaacatcgatcagtcgcgtgtctaggtttcctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacgaggtgatggccagcaagagcaagatatacttcgccatggagtacgtccnggggcggcgagctcttcgcccgcgtcggcccgcggcggnttcagggagacgcccgcggagaaggtacttccaccagtttcggtcgggggcgtcaacttctg

SEQ ID NO: 22392 - protein, 126 aa, Zea mays
  misc_feature: Ceres CLONE 1392135-F
  misc_feature: SWISSPROT Homolog: EC 2.7.11.1 Non-specific serine/threonine protein kinase
  misc_feature (93)..(93): Xaa is any aa, unknown, or other
  misc_feature (106)..(106): Xaa is any aa, unknown, or other
MEKKPTILMNRYELGRTLGQGTFAKVYHGRNLASGESVAIKVIDKEKVMRVGMIDQIKREISVMRLVRHPNVVQLHEVMASKSKIYFAMEYVXGRRALRPRRPAAXSGRRPRRRYFHQFRSGASTS

SEQ ID NO: 22393 - DNA, 679 bp, Zea mays
  misc_feature: Ceres CLONE 1392136-F
  misc_feature: Encodes the peptide sequence at SEQ ID NO. 22394
gctcttttccagtggatcccccgggctgcaggaattcgcacgagaccattacctagaacatcctaatcgaaaaaaccgcagcagggcgttgggcgagtgagtgagccagtgaggctgggatagcagcagcagcatcagtgcgccgcactcaacttctcttcttgccgtgcggtgcggcgcgacgcggagaggcaccgcacggccgcaagcaatgccgcgccggcagaggacgcgcagcagcgaggagctcaaggcggaggacttcgtcgactcggtgctcaacttcggcggcgaggaggaggatggggaagaggagaagcaggaggccggcggcgacggccagccggaggcggagttcaagtccaagaacctggaggccgagcgcaagcggcgcgtcaagctcaaccgcaacatcctcgcgctcagggccgtggtgccgaacatcaccaagatgagcaaggagtccaccctctcggacgctatcgacctcatcaagaagctccagaaccaggtccttgagctgcagcgccagctcgccgactctcccggagaggcctgagagaagcaggcaagcgcgtcgtgctctgaatccttcactgccacgaaaacatgccggatcagggccgatcgagctggttcctcgggggcatgcaagaccacctcaggatcctctgcaaga

SEQ ID NO: 22394 - protein, 115 aa, Zea mays
  misc_feature: Ceres CLONE 1392136-F
  misc_feature (51)..(98): Pfam Name: HLH Pfam Description: Helix-loop-helix DNA-binding domain
MPRRQRTRSSEELKAEDFVDSVLNFGGEEEDGEEEKQEAGGDGQPEAEFKSKNLEAERKRRVKLNRNILALRAVVPNITKMSKESTLSDAIDLIKKLQNQVLELQRQLADSPGEA

SEQ ID NO: 22395 - DNA, 665 bp, Zea mays
  misc_feature: Ceres CLONE 1392138-F
  misc_feature: Encodes the peptide sequence at SEQ ID NO. 22396
  misc_feature (260)..(260): n is a, c, t, g, unknown, or other
  misc_feature (354)..(354): n is a, c, t, g, unknown, or other
  misc_feature (467)..(467): n is a, c, t, g, unknown, or other
ggagctccccgcggtggcggccgctctagaactagtggatcccccgggctgcaggaattcgcacgagaccattacctagaacatcctaatcgaaaaattccagtcttttcagaacgagattgcatcgaggaaactacagaaaagggaccaaatcgaatccgtggtgcactgcccctccccctccctcacaagccgccgccgccgtgaggactccggcgaatggcgtcccgcgtcgcctcgggcctcctccgccgccgcgncgtcgccactctagggctactaaggagtcatacacatgtcagaaactacagcagtcaactttcagctttgattccagctacttctcaatgctcnaatctgacaagaagacgctattacttacctaatccatctctggaccaagtttggagtaggtcatttgcctcagacagcggagaacagttcgaggctggtgtggccttcatggntgaatctggaactgatggaactcttggtaacttcttaaagagcctggagacagagtcgaggccgatgaaccatagggcaaatgaaactgataggtccctataaatgtccaagtcctggagctggtgtaatgaaaaagtcattgctagggaagggaaacaggtactccaggcactaaagttggatacatatccaggctg

SEQ ID NO: 22396 - protein, 116 aa, Zea mays
  misc_feature: Ceres CLONE 1392138-F
  misc_feature (14)..(14): Xaa is any aa, unknown, or other
  misc_feature (83)..(83): Xaa is any aa, unknown, or other
MASRVASGLLRRRXVATLGLLRSHTHVRNYSSQLSALIPATSQCSNLTRRRYYLPNPSLDQVWSRSFASDSGEQFEAGVAFMXESGTDGTLGNFLKSLETESRPMNHRANETDRSL

SEQ ID NO: 22397 - DNA, 642 bp, Zea mays
  misc_feature: Ceres CLONE 1392141-F
  misc_feature: Translation starting site: 122
  misc_feature (599)..(599): n is a, c, t, g, unknown, or other
cgctcataactagtggatcccccgggctgcaggaattcgcacgagaccattacctagaacatcctaatcgaaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggctgcaggctaaagggctccacgctccttaccgaaggagtggtgacggatggatccgatgaatgggcaatctacggcgggaccggagagtttgctatggcgagaggtgtcgtcaaaagaggtacctttgcgatagggacggcgccgggaacactgacgagctcagcatgcaggttttctggccnggtgtttggctcatcacagcaaccaaacagcaggactccacat

SEQ ID NO: 22398 - DNA, 685 bp, Zea mays
  misc_feature: Ceres CLONE 1392142-F
  misc_feature: Encodes the peptide sequence at SEQ ID NO. 22399
  misc_feature (430)..(430): n is a, c, t, g, unknown, or other
  misc_feature (449)..(449): n is a, c, t, g, unknown, or other
  misc_feature (685)..(685): n is a, c, t, g, unknown, or other
aaagctggagctccccgcggtggcggccgctctagaactagtggatcccccgggctgcaggaattcgcacgagaccattacctagaacatcctaatcgaaaaacacacaacaccagctcatcacatccatctcattctactactgcctcagagaccaagctgctgcaaccggagaaggagatctattctacaaagtgaagtacttagcttgggacatggaaaccgtcgtgggagacctcatggcgaccgagctgaggcttggcctgccgggcaccgtggacgactgcagccagcaccagcagcagacccagctgaaggtggccgcgccgccgtccaaccctactaggggcaagaagcgccccgcccccgaggaggaggaggcaaacaagcgcgacgcggaggcagcacccccggcgccaagggcgcccgntggtcggatggccaccggntgaggtcgtacccggaagagctgcttccagcaggcaaggcagcaggccgtcagcagcagcagcaaggcggccgaccaagagggatgcttgcggcgcccgcgcccagctgcacggcggccgcagccgcctcaaacggcaccgccaggggccgggggccggctcattcgtcaaggtggaggatggacggcgccccgtacctgcggaagctcgaccctgggggatgacaaggggtaccn

SEQ ID NO: 22399 - protein, 78 aa, Zea mays
  misc_feature: Ceres CLONE 1392142-F
  misc_feature (72)..(72): Xaa is any aa, unknown, or other
METVVGDLMATELRLGLPGTVDDCSQHQQQTQLKVAAPPSNPTRGKKRPAPEEEEANKRDAEAAPPAPRAPXGRMATG

SEQ ID NO: 22400 - DNA, 719 bp, Zea mays
  misc_feature: Ceres CLONE 1392145-F
  misc_feature: Encodes the peptide sequence at SEQ ID NO. 22401
caccgcggtggcggccgctctattcaagtggatcccccgggctgcaggaatttgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaattgtgttgaaggctatgggacaggctataagcaaggcagtggctattgctgagatcataaagaagaggattcctggtttgcatcaagatacaataatcagttctgtcagtattactgatgtatgggagcccattggagaaggacttgtaccattgaagatgactcgtcatgtttcaatgatatcgatttcctttgtcacctaaggagcataacaagaattcacctgggtaatcagctcctcaaaatccgaaccttaagccacaagaaatctgcaacctcagaaatatcaa

SEQ ID NO: 22401 - protein, 115 aa, Zea mays
  misc_feature: Ceres CLONE 1392145-F
  misc_feature (18)..(88): Pfam Name: Alba Pfam Description: Alba
  misc_feature: SWISSPROT Homolog: EC 3.1.26.5 Ribonuclease P
MDRYQRVEKPPPEAAAIGENEIRITTQGLVRNYVTYATSLVQEKQVKEIVLKAMGQAISKAVAIAEIIKKRIPGLHQDTIISSVSITDVWEPIGEGLVPLKMTRHVSMISISFVT

SEQ ID NO: 22402 - DNA, 685 bp, Zea mays
  misc_feature: Ceres CLONE 1392148-F
  misc_feature: Encodes the peptide sequence at SEQ ID NO. 22403
  misc_feature (120)..(120): n is a, c, t, g, unknown, or other
  misc_feature (366)..(366): n is a, c, t, g, unknown, or other
  misc_feature (512)..(512): n is a, c, t, g, unknown, or other
  misc_feature (523)..(523): n is a, c, t, g, unknown, or other
  misc_feature (563)..(563): n is a, c, t, g, unknown, or other
  misc_feature (564)..(564): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaaaaaaaaaaaaaaaaaaaaatccggntcgctgaatcgtactatcgtgctctcgacagaaagcccggccgaaacccagccggaccaggaccaagccctgttcgccgtgcgcgcggtgccccgggccagatctgcgagatctgcaccgacaccgctacgcctatcacgagcctgtaggtggatgctctcgtgatctctcggaggccgcggggactgagcggcatctcggcggaggcgtagcctgcttagctggtggcctgccgagatgcagcgnaacggggtggtggaatgcagcgtgtgtcgctcccgggtggtggtgccgagtccccggagcgtgtccagggcatacgacaagcaccgcagcaagatgtcgtccaagttccgcgcgctcaaacgtcttcctcgttgtcggcgactgcnatccttgttgntctccagcccatcctagtgttcatgtcaaagtttgatggnnaaagttccagttcagtcccatcagtgttaacttttctgaccgaagggttaatgaaagtcatcttttgctattggtgatgctttaataattncagtctagaaaaggcaaaagggttgaagaa

SEQ ID NO: 22403 - protein, 60 aa, Zea mays
  misc_feature: Ceres CLONE 1392148-F
  misc_feature (52)..(52): Xaa is any aa, unknown, or other
  misc_feature (56)..(56): Xaa is any aa, unknown, or other
MQRNGVVECSVCRSRVVVPSPRSVSRAYDKHRSKMSSKFRALKRLPRCRRLXSLLXSSPS

SEQ ID NO: 22404 - DNA, 809 bp, Zea mays
  misc_feature: Ceres CLONE 1392149-F
  misc_feature: Encodes the peptide sequence at SEQ ID NO. 22405
  misc_feature (1)..(1): n is a, c, t, g, unknown, or other
  misc_feature (32)..(32): n is a, c, t, g, unknown, or other
  misc_feature (33)..(33): n is a, c, t, g, unknown, or other
  misc_feature (47)..(47): n is a, c, t, g, unknown, or other
  misc_feature (809)..(809): n is a, c, t, g, unknown, or other
nttccctcccccccccctccctcccccttttnnttgatgttggtttnatacaaaactggagctccccgcggtggcggccgctctagactagtggatcccccgggctgcaggaattcgcacgagaccattacctagaacatcctaatcgaaaattggctgctgctcccttctcccaccgaccaactcgatcccgcgccatggatcgcgccgaccccgcgcggggccgccttgccgtgctctcctcccacctccgtggtgcaggggccgaggaggcggcggtgctggagaggtcgccggtatccgcgccggcgcccgggccccgcgccggcgcgcttgccgtggtggacgggaggaccggaaagcggtacgaggtcaaggtctccctaagacggcaccgtgcgcgccaccgacttcaagaagattaccactggaaagggacgacaaggctctaaagatttatgatccctggttaccttaacactgccccctgttcgctcgtcccatctgctacatcgaatgcaggatgagggaaacccttcccctaaacggggttatcccaactcaaacaaattgcgctgacacagcagctcggttttgtagaaggcggcccccacccccctcaccggactgcgtaaaccctgccctacccccgacctttaatcgcgttaccccacccgaaaatttaccttaatttcccacagccacctccctcgtcgatcccaccacaaagtcacctccctatcctaccctccctatatcaataataatcgcgacacccatacaggtaagattactaacacatacgaccn

SEQ ID NO: 22405 - protein, 84 aa, Zea mays
  misc_feature: Ceres CLONE 1392149-F
MDRADPARGRLAVLSSHLRGAGAEEAAVLERSPVSAPAPGPRAGALAVVDGRTGKRYEVKVSLRRHRARHRLQEDYHWKGTTRL

SEQ ID NO: 22406 - DNA, 640 bp, Zea mays
  misc_feature: Ceres CLONE 1392152-F
  misc_feature (272)..(272): n is a, c, t, g, unknown, or other
  misc_feature (278)..(278): n is a, c, t, g, unknown, or other
  misc_feature (342)..(342): n is a, c, t, g, unknown, or other
  misc_feature (452)..(452): n is a, c, t, g, unknown, or other
  misc_feature (530)..(530): n is a, c, t, g, unknown, or other
tccccgcggtggcggccgctctagaactagtggatcccccgggctgcaggaattcgcacgagaccattacctagaacatcctaatcgaaaaattttttaactagtctaaatacttgacagaagaaattcccgttttcgcttgactattcttcttcgtccctgatttttatccccaaactcaccgccggggcacaacaatccagttctcctttcgccggaatctgtccctcctccccctcctccccgcctctgcgggtactggaccaccgtgnagcggncattcatccaggctaggtccattccttcctttgctcgttctcttctccatcgcggaagctccanccgagttgacgccagaagagaatcggtgccctagggtggtctcgcagattattttccagaagattgcagatcgagtcgaccctaatgcccacggtaaggctggcggcggnctgcccccttaccaacaacgggcgctccctgcccccggcaaggtccagttcccacgggacatgggatgatgcaccggnagggtcgtgatctatacaggccgctggggccgaggatgcactaccaacgcttggggacgggcccggtccggtcccctaagagatggtggctcgtgccccccacgcgagag

SEQ ID NO: 22407 - DNA, 664 bp, Zea mays
  misc_feature: Ceres CLONE 1392162-F
  misc_feature: Translation starting site: 242
  misc_feature: SWISSPROT Homolog: EC 3.5.1.14 Aminoacylase
  misc_feature (290)..(290): n is a, c, t, g, unknown, or other
  misc_feature (464)..(464): n is a, c, t, g, unknown, or other
tccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcggnagccggagttcgcggagtggcagcgcggcgtgcggcgccggatccaccagcacccggagctggccttccaggagcaccgcaccagcgcgctcgtgcgcgccgagctcgacgcgatcggcgtcccgtacgcctggcccgtcgcgcagaacgggcgtcgtggccaccatcaccggncccgccgcgggccccgtgttcgcgctccgcgccgacatggacgcgctccccatcaggaaatggaagaatgggagttcaagagcaaggaagacgggaagatggaggcgtggcgccctgacgcccacgtggcggtgcttcttgaagaactagggtgcttccgtctcggagggacgatttaagggactggaattttttttgcg

SEQ ID NO: 22408 - DNA, 707 bp, Zea mays
  misc_feature: Ceres CLONE 1392164-F
  misc_feature: Encodes the peptide sequence at SEQ ID NO. 22409
  misc_feature (707)..(707): n is a, c, t, g, unknown, or other
ccccgcggtggcggccgctctagtactagtggatcccccgggctgcaggaattcgcacgagaccattacctagaacatcctaatcgaaaaaaactagctgttagcctacctttcccctcccagccgtgggacgcaccaccctcagcctcccagctgccgcacacgtggaggctccacgcgaccacgcggcagcggcacgccggcacgcgcgccgcccggcgcccctcagcctcgcgccctcgccggccacgcgcctcagtcttgcgctctcgccgcgttaagccggtcagccttgcgggttgcggtctcgccgccgacgccgggcgccgggattgccggctgcccgccttgccggagacgggagacgccatgtccttgctgctcctgcccctctgtcgaacctccgcggaccgcgccgttccctggttgtcgtaggacgtcggcaggagtccctccgccgtcacccgtcagacgcgccaccgcggcgccgcctccccaggctcccctgctctgctccacagcttcagtgctccgtggtgcgatatcacctgtccatgctgaagcaagagctggaagactcttccagtaatcatgggtgcatgtgcctcttcatcttgtgggcgacccaaccatggcaggaaccagaaatcagcaaaggtcgcggcaattccatgtactccggcagcgcaggtaggtcgtggtgctgn

SEQ ID NO: 22409 - protein, 38 aa, Zea mays
  misc_feature: Ceres CLONE 1392164-F
MGACASSSCGRPNHGRNQKSAKVAAIPCTPAAQVGRGA

SEQ ID NO: 22410 - DNA, 684 bp, Zea mays
  misc_feature: Ceres CLONE 1392165-F
cgctctattctagtggatcccccgggctgcaggaattcgcacgagaccattacctagaacatcctaatcgaaaaatcacacatattattgaaactaactagcaacacagaaagcgcaatagtgtagcaaaactggcagtcaaaatattttgcctccttatgctccttgctctttctgcaagtgctgctaacgcgaccaattttctgcaatgctcacaagatccaattgcttcccttcttccctcatacctctcaccagcgacatcttcagtatgtgaaaacccaattcttcaaccctataggatccaacaggcaatcacagcaagcatcttacctttatcacccttgttcctccaacaaccgccagccctgttacaacaattacctttggtgcatttgttggaacaaagcatcaaggcacaacaactacaacaacctgtgctgacaaaccttgttgcctactctcagcaacaatagtttcttccattcaaccaactggctgcactgaactctgctgcttatttgcaacaacaacaacttccattcacccagctagatgctgcctacccccaacaatttcttccattcgactaactggctgcattgaactctgttgcttatttacaacagcaacaactaataccatgaaaccagctagctgttgcgagccctgctaccttcttga

SEQ ID NO: 22411 - DNA, 648 bp, Zea mays
  misc_feature: Ceres CLONE 1392167-F
  misc_feature: Encodes the peptide sequence at SEQ ID NO. 22412
  misc_feature (240)..(240): n is a, c, t, g, unknown, or other
  misc_feature (263)..(263): n is a, c, t, g, unknown, or other
  misc_feature (264)..(264): n is a, c, t, g, unknown, or other
  misc_feature (396)..(396): n is a, c, t, g, unknown, or other
ccccgcggtggcggccgctctagaactagtggatcccccgggctgcaggaattcgcacgagaccattacctagaacatcctaatcgaaaaatccgatctaaccctaaacccgaatcccaaacggaggagggcactcggcgaggcaggtggcgattctgcgattctcctgtcaccttccgtcgtctccatccccttccatttccggcgagggtcaaagcaggcctcttgctcttggggtgntttgagagaggagagaacatggnncgcggcggcgtgttggtggtgctcacggtgtcagcgctggcgggggcagcggccggcggtgatatcctcaccacgatgacgaggcacccccagatccctggatgctcaaacgatttatcctggtaaagtgcnaagctgggtcatggcaaagaaggtgcgagtttgttgcgtcggtgctcggtttgtcaaaaatcgtctccagggagagcacgcaaaccgactaaactcacgctggcagaccctatggactgctgctctcctccgaaacataggtctctggagagggtcttttaagtcaaaggggaaaggtgcaattcccaaaaaagcaaagttgctgaaagttgtgggggttccggtaaaagaaccaaaacatggccacgattg

SEQ ID NO: 22412 - protein, 43 aa, Zea mays
  misc_feature: Ceres CLONE 1392167-F
  misc_feature (2)..(2): Xaa is any aa, unknown, or other
MXRGGVLVVLTVSALAGAAAGGDILTTMTRHPQIPGCSNDLSW

SEQ ID NO: 22413 - DNA, 717 bp, Zea mays
  misc_feature: Ceres CLONE 1392171-F
  misc_feature: Translation starting site: 225
  misc_feature (717)..(717): n is a, c, t, g, unknown, or other
aaagctggagctccccgcggtggcggccgctctataactagtggatcccccgggctgcaggaattcgcacgagaccattacctagaacatcctaatcaaaaaatcccaaatagttactccactcccctcacccctcccgactcccgtgctctctctctctctctctctcggatccgaattgccagcgcaccagtcgagctcgcgggaactcgccggcaccggcgatggcctccgcctactggcgggacagggcggggcgcgcccacacgggttggggggagacgcgcgccccactcgcgcccatacctcccaaccctaaccccagccagccccacccgcgcgccgaagggtccaagttcaaagccgggggcggcaggctccttcgccggggaccgaataacttgagtttcccccccgccgtccctgggcccgggggaaggtaccgcccccccctgcaacctccccgcgcgtaataatacccatacataaccacctccccccctcctccgcgctcccgctggcagttcggcaggccccctcctgtgttgcgcgctccccgtggccggggtgccttgtcgttccctcttacacactccgcgaagtgaacacccgcgccccttcgggcgcgggctccctctccccatatgccacagctagccaaaactgcgcgcactcacgtctgacacttttaccaccgtcggaagacaaaacagcatn

SEQ ID NO: 22414 - DNA, 753 bp, Zea mays
  misc_feature: Ceres CLONE 1392172-F
  misc_feature: Encodes the peptide sequence at SEQ ID NO. 22415
  misc_feature (352)..(352): n is a, c, t, g, unknown, or other
  misc_feature (358)..(358): n is a, c, t, g, unknown, or other
  misc_feature (360)..(360): n is a, c, t, g, unknown, or other
  misc_feature (361)..(361): n is a, c, t, g, unknown, or other
  misc_feature (372)..(372): n is a, c, t, g, unknown, or other
  misc_feature (381)..(381): n is a, c, t, g, unknown, or other
ggagctccccgcggtggcggccgctctagaactagtggatcccccgggctgcaggaattcgcacgagaccattacctagaacatcctaatcgaaaaatctagtcatctcgtctcaggttgcggccgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcagaaagtccatgggcagtccgtgctgttgagcagaatctcttccctatcccgcatgacacccntgtatncnnacatgcctatnctggctacnatgggccccaggagtcataacatggggatgatggcactggctgaactcccatcgggaaggggaccattccctggtttgggtttggccccaaaaggaaaaggcttttcggggttttgggcccaactttagggggggggggttttcttggggggggccccaaaaaagggtgggcccccaatgggggggggacaggttttttcttccaaaacccgggagaaagggccaaaaggggggggttttttacaaccaaaaaaagtttttgggggcctctttttcccgcaaaaaaaaaaagaaggggtttctcccccccggggggaaaaaaaaaaatttgtggtttccctctcccccccccccccggggggtggtgtgggg

SEQ ID NO: 22415 - protein, 84 aa, Zea mays
  misc_feature: Ceres CLONE 1392172-F
  misc_feature (33)..(33): Xaa is any aa, unknown, or other
  misc_feature (35)..(35): Xaa is any aa, unknown, or other
  misc_feature (36)..(36): Xaa is any aa, unknown, or other
  misc_feature (39)..(39): Xaa is any aa, unknown, or other
MADELRSTSVGQKVHGQSVLLSRISSLSRMTPXYXXMPXLATMGPRSHNMGMMALAELPSGRGPFPGLGLAPKGKGFSGFWAQL

SEQ ID NO: 22416 - DNA, 650 bp, Zea mays
  misc_feature: Ceres CLONE 1392174-F
  misc_feature (215)..(215): n is a, c, t, g, unknown, or other
aaagctggagctccccgcggtggcggccgctctagaactagtggatcccccgggctgcaggaattcgcacgagaccattacctagaacatcctaatcgaaaaacacacccggaccccggtctgcgtttgtccctgcgggctgcggccctgcctcttctcgtctcccgttcccctcgccgcgtgagctctctctctctctctctctcctctggggngacgactgggcgcccgcacccctggcagccgccgccgcccagtccccgtcgggcccttcggcaggtcttcttcggcctcttcgccggcgacgagccgcaccaggcgtacatgtgtacacccagcccaggcccttaactgcgcccgcccctgcaactgattttcctgatggttcatgagaatttgcctgccagtagactgccaccccttcatttcccggaatatttcgtgggaatacccaccccgccacaaataacggatgaacattaacgccatccaaattaacttggcgagataccgagaacaaccacaattatgtctttgaggaatgcgttacttgtgttagatttgactcacggctatatccacagcacttctgacgccacccactacctcatatcgctttgacgccaactttaaacccaccaacccccaca

SEQ ID NO: 22417 - DNA, 694 bp, Zea mays
  misc_feature: Ceres CLONE 1392180-F
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (34)..(34): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (55)..(55): n is a, c, t, g, unknown, or other
gtgggttgggggnnccnnncncccnnncnnangnaanggaggggnnngggtcccntaaacaagctggagctccccgcggtggcggccgctctagaactagtggatcccccgggctgcaggaattcgcacgagaccattacctagaacatcctaatcgaaaaagaacccagagctccaaacctaggccggagccgcggtgcaagcagctacgtggattggacttggacgtctggctctggaggtcccaagttcccaacgcttgctggagttgagatctggtggggcttccggaggagacgcccgacggttttggcgaggttttggtgggctcccgggggggaccggggaaggggcatgggacccaccgcccccctttcaaaacggggaagggcgggaagggggcagagatgaaaccccccccccgcggggccgatccaacacgctaccgggtgtgagggggggcggccgggagaaaaaggtggggccacccccgccggcgggggggggctatggcaagcaccccgccccccccccctccccctccgcctcgtatttaatgctgtgactgcggcggccattgcccccgctcgtcgggcggggctcgggcccccaccccccggtctgggggcttcgggtgagttggcggcccgggcggggagcggcagaggggcggcacggggacggggcgaccgcg

SEQ ID NO: 22418 - DNA, 721 bp, Zea mays
  misc_feature: Ceres CLONE 1392182-F
  misc_feature: Encodes the peptide sequence at SEQ ID NO. 22419
  misc_feature (391)..(391): n is a, c, t, g, unknown, or other
aaagctggagctccccgcggtggcggccgctctagaactagtggatcccccgggctgcaggaattcgcacgagaccattacctagaacatcctaatcgaaaactttttttcttcgatctccgcaatctacagctttgcttctcccggctcgagcggctagggtttcgggagtgcgcggtgagacggcatgacaacgcggggagctaagcgcgcgggcacctccgaccccgccgcacccgatttaccaagtaagagagtaatggacggaccctcttttgatgttcacaggggcggagtcttcccatcagcatgtgatggcaggacccgctagtttagatcctcgggggggcgaaggctgctacaaaacatgggaggggattaaatacccagnttgcaagctggggttcaatttgcagctggcaaatcatccagctggaacttttggggaggacgggcccttaaaggattaactatccaggtggtttctggaaatcgggagaaaattttccggggatgggtgggcaactggggtaagggaaaaaacgaggcaggggtccaaaaaaggggggcttccctccccgagggcgagggggggggggggggaaaaagccccaattcgggcgcggagggcagaggggaaaggccgggctcttaaaaaacaagccacagggtgagaaaaacaaaaaagaaaagggggcccgaagtatgggaggttgcgacg

SEQ ID NO: 22419 - protein, 47 aa, Zea mays
  misc_feature: Ceres CLONE 1392182-F
MTTRGAKRAGTSDPAAPDLPSKRVMDGPSFDVHRGGVFPSACDGRTR

SEQ ID NO: 22420 - DNA, 733 bp, Zea mays
  misc_feature: Ceres CLONE 1392185-F
aaagctggagctccccgcggtggcggccgctctagaactagtggatcccccgggctgcaggaattcgcacgagaccattacctagaacatcctaatcaaaaaaactttagcagcaaaattcacccaaaagaaactcctgataaatagaaaaaggagggaaaaagaaaaacacttgcagcggcatccaccaccgaagctcccatcatcggtctatccctccgtgtcaaccccctcctcagaagttctaattgcagttcagcccctggccggtccgccgggccaccggaaggagccgctcgccggaggaagccccccatctccttgccctgcggcgggtataatggggttcccgctgtaccccatgaagacgcccacgcggttggctctgaagcaactaacttctttccgccataagctcagcttcctcctcctggtttcctctggagcccgccccaccccgcgacaaccacctcgggcggcggccccgctgtctggtggggcggtccttaaccaatccgttccaagagtagacgagaccacgcccctctgtgacctataaccttcctatttctgtcattcctacttaccgtatacaacctcctccttacccccgctaatcaaatccaataaactaaacgccaccgcactccaccctctgctgctcttccgcccccgcataaaaaacggtagaggcagccaacatcaatgtgtctcatataataccacattgcta

SEQ ID NO: 22421 - DNA, 839 bp, Zea mays
  misc_feature: Ceres CLONE 1392191-F
  misc_feature (28)..(28): n is a, c, t, g, unknown, or other
  misc_feature (32)..(32): n is a, c, t, g, unknown, or other
  misc_feature (493)..(493): n is a, c, t, g, unknown, or other
ttgtcctcccccccacccccccctcttnttgntttttttgttacccccccaaagctggcgctccccgcggtggcggccgctctagaatagtggatcccccgggctgcaggaattcgcacgagaccattacctagaacatcctaaaaaaaaaaaactcctcggccccagcattttcgtgcaaggggcgagccgccagctactgctggccttttccctcacacaagtcacacgcacacccgctagcccccgtcccccgtcccgcccgtaccttcctccgccacctccgtcctcgttccaaccgtgggcagcaggcaggcccaagtatctgcagaagattggtggagagaaagaagacggcaggcacccacgcaaatcaaacgtgctccgccacccctttggtttccggggaaccggcgccgtacgcccgaaaatcgagccgtcctccgaggaagatcgacggggctggataagcatttcacacccgtctcccggncccaaattcgacggtccagaaggctgcaaaattggaccccatcctcccggggttgaaacctccggcttgggggccctgcccaagagaaggcgcccaaaaatttaaccccccttttccccggggaaaaaaatccccttggaaaaaacccgggaggggattaatcgcgggaagaaaacttgtgcgtttaacacccaccgggcaccaagggaagaacgcgtgcggcttgggccaaaaggggggcgaggagccaagcgttagccgcccccactacgactcagtgggtttggccccgcctcgccgtgcgttcatggggcgcccctctcccggctcctttggggaaaacgca

SEQ ID NO: 22422 - DNA, 862 bp, Zea mays
  misc_feature: Ceres CLONE 1392195-F
  misc_feature: Encodes the peptide sequence at SEQ ID NO. 22423
  misc_feature (1)..(1): n is a, c, t, g, unknown, or other
  misc_feature (7)..(7): n is a, c, t, g, unknown, or other
  misc_feature (8)..(8): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (39)..(39): n is a, c, t, g, unknown, or other
  misc_feature (169)..(169): n is a, c, t, g, unknown, or other
  misc_feature (366)..(366): n is a, c, t, g, unknown, or other
  misc_feature (596)..(596): n is a, c, t, g, unknown, or other
nggcccnncccccnnnnnnnnntcccctccccgccgganttgggtagtttttcaaggctggagctccccgcggtggcggccgctctagaatagtggatcccccgggctgcaggaattcgcacgagaccattacctagaacatcctaatcgaaaaccatccatccatccngttagttagttagtaagttagttgagggagaagaagcaggggaggggaagcgatgagcaacttgctgcgggctcgccgccgcctggacctcctgcaggtggtgctcttcgccgctgtgctcctcgtcgtcgtcgccgacgccggggtgacgagcccgaaccgcggaagctggaaggcgacggtgaagatggcatggnaacgccgacgttttccggggttccggcgggggttacatggccccgcaaccatggggcccctccccgcttggggggcccagggaggtgacggttactggactgtgggcccccggggggtgcggccccatgggggctcggggcgtgcgggcggcggggtgggggggggcggggggggggcgggttggtgggttccccggggggagagggagtgggctgttggcggggaggtngtatggtggtggtgtgagtcctcgtcggtttgtgggttagcatgtccgccatcacgaggcgcgcccggtcttgggtaggcacccgcccgggcggcgcgggctccagggcccgccgcggccgcggggcccccgccggtcactacgggttgggtggggggggccgtgggggccgcgtgcgggggggcgggggtgcgttggtggggtggaggtgtatcttcgccgcacgtaaccgcggcaggccggccctgctgctgcgcgggggggcg

SEQ ID NO: 22423 - protein, 150 aa, Zea mays
  misc_feature: Ceres CLONE 1392195-F
  misc_feature (49)..(49): Xaa is any aa, unknown, or other
MSNLLRARRRLDLLQVVLFAAVLLVVVADAGVTSPNRGSWKATVKMAWXRRRFPGFRRGLHGPATMGPLPAWGAQGGDGYWTVGPRGVRPHGGSGRAGGGVGGGGGGAGWWVPRGEREWAVGGEVVWWWCESSSVCGLACPPSRGAPGLG

SEQ ID NO: 22424 - DNA, 647 bp, Zea mays
  misc_feature: Ceres CLONE 1392197-F
  misc_feature: Encodes the peptide sequence at SEQ ID NO. 22425
cgctctagaactagtggatcccccgggctgcaggaattcgcacgagaccattacctagaacatcctaatcgaaaaatcactcctcactcactcactcaaaacgaaagccagctcagctcatctgctcacacctcacaggctcacacccacaggccggccgccacagcaccgcggatagcagagcagagcggtgagctgcagagcagggtagccgaggtcgtcgtcgtcgtcgtcactcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgcagctgcgcaggcccatctcgctgggcgacccgtcgctgacggcgtcggcgcaggtgacgctggcctcccgcaaccccaacgaccgcgtgggcatcttctacaggcgcctggacgtgttcgtcacctaccgcgacgagggcgtgacggtgccgggtccctggcgccgcagaaccagggccgccggacttcccggctggcccccccggggtgggggcggagccatggccgttggcgcctat

SEQ ID NO: 22425 - protein, 134 aa, Zea mays
  misc_feature: Ceres CLONE 1392197-F
MSKDKHHKHEHHLRRCCGCMASCLLALVLIVAFVSLVVYLALRPSKPSFYLQDLQLRRPISLGDPSLTASAQVTLASRNPNDRVGIFYRRLDVFVTYRDEGVTVPGPWRRRTRAAGLPGWPPRGGGGAMAVGAY

SEQ ID NO: 22426 - DNA, 641 bp, Zea mays
  misc_feature: Ceres CLONE 1392198-F
  misc_feature: Translation starting site: 166
  misc_feature: Pfam Name: PRK Pfam Description: Phosphoribulokinase / Uridine kinase family
  misc_feature: SWISSPROT Homolog: EC 2.7.1.19 Phosphoribulokinase
  misc_feature (281)..(281): n is a, c, t, g, unknown, or other
  misc_feature (342)..(342): n is a, c, t, g, unknown, or other
  misc_feature (352)..(352): n is a, c, t, g, unknown, or other
  misc_feature (353)..(353): n is a, c, t, g, unknown, or other
  misc_feature (357)..(357): n is a, c, t, g, unknown, or other
  misc_feature (358)..(358): n is a, c, t, g, unknown, or other
  misc_feature (363)..(363): n is a, c, t, g, unknown, or other
  misc_feature (526)..(526): n is a, c, t, g, unknown, or other
  misc_feature (527)..(527): n is a, c, t, g, unknown, or other
cgctctagaactagtggatcccccgggctgcaggaattcgcacgagaccattacctagaacatcctaatcgaaaaattcttcttctcttcaagtgccactcccatccaccacaaggcttggcttggtgggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcgncggcggcaggaggcacggaggggcaaggagcttccaggtctcgtgctcgtcgacaagccgntggtgatggnnctgnncgcanactcagggtggcggaagagcaccttcatgcgcccgctcaccagcgtcttcggtggcgccgcgaagccgcccaagggcgggaacccggactccacacgctcatcagtgacaccacgacagtgatatgcctcgacgactaccattccctggacaggaacggcagnnaggagaaaaggtgtgaccgcccccgacctagggccaacactttgatctcatggatgagcaggggaaggcgatcaagaaagccaggcagtcaaaaacccatctacaccatgtccc

SEQ ID NO: 22427 - DNA, 722 bp, Zea mays
  misc_feature: Ceres CLONE 1392199-F
  misc_feature (354)..(354): n is a, c, t, g, unknown, or other
aagctggagctccccgcggtggcggccgctctataactagtggatcccccgggctgcaggaattcgcacgagaccattacctagaacatcctaatcgaaaactacatgccaaatctggaggcaagagaaccgggagagggcgtgttgggttgctcgtcgtgatcccggacggcaatacctgcccttgcctacttgccactgcttgcgtacactgatgtccttgttcaatcccctctagaaagtagaaacattgcttaattggcttggctattgctgttagctccacacaaaagagagaaccggcggcgagctaggagctagccatggacgaacacggcgcggtctcacccgtgnagcgtgctacgccgccccggcgggtgtgctgctccctgtggttgccctcccaggtgcttgaatggcgacctgggtggtcgcccccgctccttgaacccttccattgaggggcgagggcccgtcggctatccctcggcccggcccgctctaagtctaccacctccaaaagctccaccgcagctccccctcgctccgccctgccacgcgcccgccccccccggcccctcgtcgccccgccttcgcccccccccccgcggcccctcttctgttccccgccccccgcgctctgcctaaacccccctcctcccctcccacgctccctcctcaactcatcagtccggcgccagctctatctcgtgctccccccc

SEQ ID NO: 22428 - DNA, 882 bp, Zea mays
  misc_feature: Ceres CLONE 1392200-F
  misc_feature: Encodes the peptide sequence at SEQ ID NO. 22429
  misc_feature (22)..(22): n is a, c, t, g, unknown, or other
  misc_feature (27)..(27): n is a, c, t, g, unknown, or other
  misc_feature (28)..(28): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
ttttcccccccccccccccccntcccnnattatnnnaaacccaaanannnacaaagctggagctccaccgcggtggcggccgctctagaactagtggatcccccgggctgcaggaattcgcacgagaccattacctagaacatcctaaaaaaaaaaaaaaatcccagccttttgtttgcttctctgtctcctgctgattggtgtccccgggtccaggactcttgatttgctcctcgcgggggttcggtcccatggcggcagctgcgctggcaatggcagagcaggtggtgcccgagctccgagtgaggtgtgagacgccgccgtcgatgctgcccgaggtggcccgtgcaaatgcccccccaagatggacgcgggatttggaaaaacgacggtggtgaggcaggtccaaagaatggttccttctcctaccgaccattaaccttccccatcgggggcggggggggaaatcacttattcctcgtgcctctggcccccttaataagaaaaccactaacttccgcggcctcctttcgcaccgtcacacacattccaggcggcgaactgggctcaatacccttcgtccccgttgagaggttcatggacccaaaagaccacaactcacctccaattctcccgctcccccttgcggtgcggcgctgaggtccctcatcccccctcccccttcatctctcccactttacccgctcctcaggaatcgttatgagctacatatgtttccggcccctgcggattctctgtggatgtacactgctgttatttacctgctctcctcacccctccccgtcctcatcccgacctccccccgaggcgtctgatggacacaggtaaggggttaatttacatgggggtgcccagtcaccc

SEQ ID NO: 22429 - protein, 48 aa, Zea mays
  misc_feature: Ceres CLONE 1392200-F
MAAAALAMAEQVVPELRVRCETPPSMLPEVARANAPPRWTRDLEKRRW

SEQ ID NO: 22430 - DNA, 807 bp, Zea mays
  misc_feature: Ceres CLONE 1392202-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (46)..(46): n is a, c, t, g, unknown, or other
  misc_feature (722)..(722): n is a, c, t, g, unknown, or other
ttttctcccccnnnnncnnnncctccccccccccgcccacgaccanaacaaaacaatgtaaatccacgcagagacgaaacctctaaaatattggatcccccggtctgcaggaattcgcacgagaccattacctagaacatcctaaaaaaaatcttatttcactgccagccctctgaaaaaaaaattaaaaaatgaggtcccagttccacccacctagagagccaaaacagccggcggtgcccggcagccaaaacccacgttggattttgccgccgccgcctggagctagggcacaaggcaacgccggccggtgcaacatttatgcgtgtaccaggcagaccagtccggcagccacgcgtatacttctgccgcaaagctaaacgcgccactccgcgtgaagctgctctgctgctcccaacagacaccgcaccgactgtcaatggagcactgcaacgatctcaaaccccgcctgaggaggctagcctactactggtctgcgccccccatgccccgcccctccctgccccccacccaacccccatccacaaactacgagcgcccttcgcccgtagaacccccatactttcgtcccccccctcgccccgactaccctcattactgtccacaaacaatcccttctatcctcatcctgcgcttattctccacactaccccaccccctcttcacgccatcgaataaacactccaaccacaaaaaccccngaaatcatctaccacaccaacaaccactcacgaagacattgaatatagatatgaaagataaacaaaacaacaaagaaacgatcac

SEQ ID NO: 22431 - DNA, 801 bp, Zea mays
  misc_feature: Ceres CLONE 1392203-F
  misc_feature: Encodes the peptide sequence at SEQ ID NO. 22432
gggcccccccccccccccccgggttgtgatggttttattattttcaaccacaaaaatggagctccccgcggtggcggccgctctagaactagtggatcccccgggctgcaggaattcgcacgagaccattacctagaacatcctaatctaaaaaaaaccctcttcgtcgatcggtgtccctagcctccccctgcccggctgtcctcctcgatttcgcaagctcctggttacggcggcatctatcgttccgccgcaagggccgcatcgtctctctcgcgacgctgccccagaccgccgagataatggctggccaccgaaacagtcatggaaagcgccagtctgattttactgaaaatggaggcagtaacagaagaaatcctggggatgatacatatgaacctggcccctgatgacactgtgtatcgctacctctgtgcctctagaaaaattggcagtatcatctggcaggggcggcaaaaattggcaaagcagttgaggaactgagaccccaagctaagaatcggcaccggccgaagaggtccccctgcatggtcatggaccgaagttggtcaccatattctaagcaccaggccggaaaaaatactcactctccatagggcgactaaaaaaatgcagaggttggccctccatcaagaccggcccccctttttaggcgacgacggagaagaccgacgccccgcccctcacacgccgcccccgccgcaccccacctacagggacaaaagaaacaccagcaccatccacataacgactcgccaacaccatactgcttacatcacg

SEQ ID NO: 22432 - protein, 35 aa, Zea mays
  misc_feature: Ceres CLONE 1392203-F
MAGHRNSHGKRQSDFTENGGSNRRNPGDDTYEPGP

SEQ ID NO: 22433 - DNA, 894 bp, Zea mays
  misc_feature: Ceres CLONE 1392204-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (31)..(31): n is a, c, t, g, unknown, or other
  misc_feature (33)..(33): n is a, c, t, g, unknown, or other
  misc_feature (39)..(39): n is a, c, t, g, unknown, or other
  misc_feature (40)..(40): n is a, c, t, g, unknown, or other
nnnntttttnnnnnnnnnnnnccctttcttntnatttannttccaacccgggaacatggggctcgccgcggcgggcggccgctctagaactagtggatcccccggggctgcaggaattcgcacgagaccattacctagaacatcctaatcgaaaaatagcctcctcgtctcctcgagaactgtagcatcaccgcgccgcctttgattgagcagggactgggagagaggagaagagagggggaaagggggaaagaaaacgcttcttgttgcctttgggcttcagcgaatccgcgggaggatgcgcacgccgacgcataataatgtattcctgtttgggggcccctcaaattttattagccgagcaggcgactcgggcgctcttggttcctcgcgtacgccccgtcatctatggcatccggtggtggggggcggccgcctggggggcgcccgcagatggtgggagttcattcgctgacgcctaaatctctctggcgtcgcgcgccggcggtgtgagggaggatgccacccgtgtcgtcagataaaatatacgagacgcaccggttattcgtattctaagacgtggagggtagaggaagggcgggtaggtgaatgggtggtctaggggggagggaggaggatgtaggatgtgggaggggtgcggacgaaacagaggacgcaggataggtcggagaagggataatcgtggggcaatggagaatggggagcgaagatgtatgcgaacgcactatacaccggttacatgacttgagcgaggagggggagaggatgcggagagaaaattggggtagcatgaaaaggagcacatgtcaccacgcatccgtctccgcctcgccgcgcgcgcccaccgaccgcaactcgggcagcgtccacgct

SEQ ID NO: 22434 - DNA, 694 bp, Zea mays
  misc_feature: Ceres CLONE 1392207-F
  misc_feature: Translation starting site: 248
  misc_feature (436)..(436): n is a, c, t, g, unknown, or other
ggagctccccgcggtggcggccgctctagaatagtggatcccccgggctgcaggaattcgcacgagaccattacctagaacatcctaatcgaaaacttcagttttcacggcgggttgtcgtggcctgtggctgggagcctgggtggctgtgggcaggagtatgccaagatgatcgagacaccaacaaaccaaacaccatccgccacgaccacgactcccacgagagagcggaggaggagggggagcaatggcagagccgggccagcagttgctgcggtcgttcgtggaggtggcagcgggctcgcacttccctatccagaacctgcccttcggggtcttccgccggcgggggtcggccaccgcaggctccgcggccccggggtgggccatcgggggacttcgcgctcgacctcgccaccgtcggccgacgcgggtnctctttcgacggggccgcgctctccgggctccccgtgcttccaccaggagacgctcaacatgtttctttggggatgggcccaccggcgttggagggaggccccccccacgcctacaaaaaatcctctcagccgacgagccagttcttgcgtgacaacgaaaccctgaaggaataaatgtcttattcccatgagtggaaatcgagatggttctaccaatccccgggttggaggttacaaaaaattctttttggtccggg

SEQ ID NO: 22435 - DNA, 636 bp, Zea mays
  misc_feature: Ceres CLONE 1392213-R
  misc_feature (222)..(222): n is a, c, t, g, unknown, or other
  misc_feature (231)..(231): n is a, c, t, g, unknown, or other
  misc_feature (254)..(254): n is a, c, t, g, unknown, or other
  misc_feature (553)..(553): n is a, c, t, g, unknown, or other
cgaattgggtaccgggccccccctcgaggtcgacggtatcgatattttttttttttttttttacgagaatgcacagcaacttcgtctacggaaaatcagcaaacgtacagcaacaccaagcaaacgaaacaacaaatccagggtacatccacctacatacaccaccacgtaaaacccaactagcgcggagtagagtatgcacagcggcacgggagtaggccnggagcactnggaacggccccatcaattcaagncgcccgggaaccgtcgcccgccggctttgtccttccacccgggttacgggctgggggccttccttgccttgtaaaccccggggggcccccccccccccccccgggggggaaaattacccccccccaaaaaaataagggggggggggtttttcccccccgaaagaaaaattaggggccccaaaacccctttttttgggtcccccccccccggaaaaccccctttttattgtaaaaaaaaggcccccccaaaaaaaagcccccccccctggtgaaaaaaaaaaaaaacctttttttttatncccctcttttttaaaaccccccccccggtgtttttttttaaaaaaaggggggggggggggccgcccccccccccccccctatc

SEQ ID NO: 22436 - DNA, 798 bp, Zea mays
  misc_feature: Ceres CLONE 1392214-F
  misc_feature (1)..(1): n is a, c, t, g, unknown, or other
  misc_feature (27)..(27): n is a, c, t, g, unknown, or other
  misc_feature (41)..(41): n is a, c, t, g, unknown, or other
ncccccccccaaaaccccccccacaanaaaacaccgcgctnccccccttggcgctccccgcggtgggggccgctctagaatagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgaaacgcaaaccttcgcatttcaggctgagatcaaaccagctgctctcactcatcatcaacacccttctaacctccaacaaggagaaccttcctcccggagtttattctccaactctctccgatgccgcggacaaaatcaggttcaagagtctcactgacaaaagcaagttcgatgcggagccttgagcttcttcatccacctggccccagacaaggcccacgaaccacgctctccatcatcggacagcggcttccgtcatgaccaagtccgaaccttgccaaacaacctcggaaaccatccgccaggtcccgataccaaagcgagtcatggaaaacccctttgttgccggccgtttattccgtccatggattggccaaggtcccggcggcccgatttcaaactctggccaaaccttcctcccccaaataaaagtcggcccgcccccccacccgggcgccggccgtttaaccgcgacaggcatgggggggagaaagccccccggggcgggggggggtcgtttttcctgggggaaccccggcgaaccgcccccaagggcaaatacaactccttgcacc

SEQ ID NO: 22437 - DNA, 809 bp, Zea mays
  misc_feature: Ceres CLONE 1392216-F
  misc_feature: Encodes the peptide sequence at SEQ ID NO. 22438
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (27)..(27): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
aaaactcccccnnnnccccccccaccnaaacaannnaatccagccccccacagtggagctccccgcggtggcggccgctctagaactagtggatcccccgggctgcaggaattcgcacgagaccattacctagaacatcctaatcgaaaacatccagagaagctagagtccaggtctcactcgcgaccgagagccacagagaaatggggggccctggtcgtccctggcgccggcacgtcttcctcgtcgtgtcgctgcagcttctccttgtggcgccatggcaggacgagacggccgctcgagctctcaatttcaccaggcaggatttccccagggccttcgtctttggtgccggcacgtcagcttaccagtacgaaggggcaaccgatgaagacggaaggaccccaaggatatgggacaacttttactcatggcaggtaggatgccgaacaagagcactggcgacctagggggcggacggcctaacacaaattacagggaagacggggcacctggaggagtgaaccctgggccctggagggccctaccggttcctcccatttccttgggcccaagctttatttcccaagagggaaggagggggcccatccccaccccgaggggggccttgagggtattaaccaaccaaccctcataccagtgggcgcagggcaaaagccgcgggaaatttagggcaacaccgggtgggcccctttggtccccgcctggggattaaccccctcacagatccccgtgggagggacagagattacaccccgggtttggcctggaccccaccgaagggcgcg

SEQ ID NO: 22438 - protein, 88 aa, Zea mays
  misc_feature: Ceres CLONE 1392216-F
  misc_feature: SWISSPROT Homolog: EC 3.2.1.21 Beta-glucosidase
MGGPGRPWRRHVFLVVSLQLLLVAPWQDETAARALNFTRQDFPRAFVFGAGTSAYQYEGATDEDGRTPRIWDNFYSWQVGCRTRALAT

SEQ ID NO: 22439 - DNA, 657 bp, Zea mays
  misc_feature: Ceres CLONE 1392219-F
  misc_feature: Encodes the peptide sequence at SEQ ID NO. 22440
  misc_feature (220)..(220): n is a, c, t, g, unknown, or other
  misc_feature (222)..(222): n is a, c, t, g, unknown, or other
  misc_feature (223)..(223): n is a, c, t, g, unknown, or other
  misc_feature (270)..(270): n is a, c, t, g, unknown, or other
ggagctcaccgcggtggcggccgctctagaactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttcccacaccaggaaacagcccactaaccccgccccgcatgggcggncnntcgcgctcagacactcgcccccggcgccggcgccgccgccgcgccgnttctcgtcgccgctaccccgtcgcgcgccgtcgtccccgtcgccgtccgcctcctcgggcgcaaagctcggaagccctcgccctctcccgggggcttccccacgacgccgacgactcgctcgacaacccggatctggggcctttcctcctcaagcagcgcgcgacgccatgttgtcaagcgagggccggtgcccccccccgcccactcaagttcgccaagcgcgccgccatggcgctcaaacgaacgcggcgagggccccaaattcaaacttgccataaacctccacgtcgccgccggaattcaattggggcctcggcccgcaaggttaaccccatccccgtccccaaaggggggccgttaaaaataccaccccccccccaaaaggc

SEQ ID NO: 22440 - protein, 182 aa, Zea mays
  misc_feature: Ceres CLONE 1392219-F
  misc_feature (74)..(74): Xaa is any aa, unknown, or other
  misc_feature (75)..(75): Xaa is any aa, unknown, or other
GAHRGGGRSRTSGSPGLQEFARDHYLEHPNRKPEWYRATCSRRQPPRSLLDDTQLVLPSHTRKQPTNPAPHGRXXALRHSPPAPAPPPRRFSSPLPRRAPSSPSPSASSGAKLGSPRPLPGASPRRRRLARQPGSGAFPPQAARDAMLSSEGRCPPPPTQVRQARRHGAQTNAARAPNSNLP

SEQ ID NO: 22441 - DNA, 889 bp, Zea mays
  misc_feature: Ceres CLONE 1392221-F
  misc_feature: Encodes the peptide sequence at SEQ ID NO. 22442
  misc_feature (18)..(18): n is a, c, t, g, unknown, or other
  misc_feature (20)..(20): n is a, c, t, g, unknown, or other
  misc_feature (22)..(22): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
caccaccccctcctctcncncnaatttcccttcatnnnttctttttcccccaaactggagctccccgcggtggcggccgctctagaactagtggatcccccgggctgcaggaattcgcacgagaccattacctagaacatcctaatcgaaaaatccccacacgcgcccacctcctctgctctctcctctcccccacctctgcgtccgtgcgttgtgtttgtttaggcggcaaccgcgaggcgcaatggcggccgggcgagagctggtggtgagtttcggcgagatgttgatagacttcgtgcccaccgtggacggggtctcgctggcggaggcgccggccttcctcaaggcgcccgggggcgcgcccgccaacgtcgccatcgcggtctcgcgcctcggggggggggccgccttttgccggccaagctccggcgacgacgagtttcggccggaatgttccgccgccaatcctcccgggaaaaacgggcggtccaaccgaccgggggcggttcgtctttccaattcccgggggcggcggaaaccgcgccttcgcccttccggtccacccttgccgccgcccaaaagggggaaaaccgacgaagtttcattggtttcttaccccggcaaacccccaaggggcttggaacattggcctccttcaacccggcccgaaaaaagtcttcacacggtccaaaggcttcattcaagaaagggggttggggggtcccttcccaacctaacaggaatcaaaataaactcttggaattgcgctggaaccccttggcccgaaaaaaacaaacactccccccggggcccaattggaaaatttgccacaaaaaacggcaagggggccattggtctctcctttaatgaacccaaacaccggggg

SEQ ID NO: 22442 - protein, 215 aa, Zea mays
  misc_feature: Ceres CLONE 1392221-F
  misc_feature: SWISSPROT Homolog: EC 2.7.1.4 Fructokinase
MAAGRELVVSFGEMLIDFVPTVDGVSLAEAPAFLKAPGGAPANVAIAVSRLGGGAAFCRPSSGDDEFRPECSAANPPGKNGRSNRPGAVRLSNSRGRRKPRLRPSGPPLPPPKRGKTDEVSLVSYPGKPPRGLEHWPPSTRPEKSLHTVQRLHSRKGVGGSLPNLTGIKINSWNCAGTPWPEKNKHSPRGPIGKFATKNGKGAIGLSFNEPKHRG

SEQ ID NO: 22443 - DNA, 712 bp, Zea mays
  misc_feature: Ceres CLONE 1392225-F
  misc_feature: Encodes the peptide sequence at SEQ ID NO. 22444
  misc_feature (457)..(457): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
aagctggagctccccgcggtggcggccgctctataactagtggatcccccgggctgcaggaattcgcacgagaccattacctagaacattctaatcgaaaaaccactactcgtgcccgtgcggtggttcgaccagatccatctcacacccttatcctctttacgcctcaccactacagagaaaaagagaaacctgcgagcgacggggactatggccgccactcgcaccgccctggccctgctagggcacgagggcatggaatctgggcccaggccggcggcgccgcgccgcagcaggctacgcgtcgtcgccgtcgcgctgcggaccaggcccaccagcctcgcggccccgggtctcccgcccgcggcgccggagcccgtgctgccgtcgccgcccgtggccgcgggcgccgcggcggtgctgctcgaggcggacgtgccgcccgccgacctccggngcgcggcggtgatgtgcccggagctgctgtccgtgtccgcggagggcgtcgaggccgcgctccggttcctcacggaggaggcgggcgtcgacgaggccgaacctccgcgcgtgttccggcggggcccgcgcctgctcgttttctcccgtggcgaggcggcttggacccaaggcaccaattcctggcggcggtgcatgccggggcgtactcctgagaaggcagcgcgctctgacgccggggnnnnnnnnnnnnnnn

SEQ ID NO: 22444 - protein, 162 aa, Zea mays
  misc_feature: Ceres CLONE 1392225-F
  misc_feature (83)..(83): Xaa is any aa, unknown, or other
MAATRTALALLGHEGMESGPRPAAPRRSRLRVVAVALRTRPTSLAAPGLPPAAPEPVLPSPPVAAGAAAVLLEADVPPADLRXAAVMCPELLSVSAEGVEAALRFLTEEAGVDEAEPPRVFRRGPRLLVFSRGEAAWTQGTNSWRRCMPGRTPEKAARSDAG

SEQ ID NO: 22445 - DNA, 729 bp, Zea mays
  misc_feature: Ceres CLONE 1392226-F
  misc_feature: Translation starting site: 205
  misc_feature: Pfam Name: OmpH Pfam Description: Outer membrane protein (OmpH-like)
  misc_feature (413)..(413): n is a, c, t, g, unknown, or other
aaagctggagctcaccgcggtggcggccgctctagaactagtggatcccccgggctgcaggaattcgcacgagaccattacctagaacatcctaatcgaaaaaatactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcaaggaggagggcggcgcccgatgggtgagcagggtgaaggcatgctccacgacaagggccgacggcgtcgcaggcgctggacgtggcgacgcttgtcccgcttgggcggctgctgctggtgctgccgggctggccgttacgncctccgggttggggcttgccggggccacaccggtgtcctgattctaagcccggtggtgtccccggcggggtgctcattgggaaggccggaatggtttccttaccgccgggggcctggggctccgggggcttgccttcgtccaggggcctgcccaaaaggggggggaggggttccaggcgaccccggattaaatgggaggagggccaccccaagaattggggaaggccccgggccaaacggggaccacaaaaaccgcggaggaggggccaggccctccgagggaaagggcccaagaaggccccgcccccgggagaat

SEQ ID NO: 22446 - DNA, 739 bp, Zea mays
  misc_feature: Ceres CLONE 1392230-F
  misc_feature: Encodes the peptide sequence at SEQ ID NO. 22447
  misc_feature (385)..(385): n is a, c, t, g, unknown, or other
  misc_feature (435)..(435): n is a, c, t, g, unknown, or other
  misc_feature (528)..(528): n is a, c, t, g, unknown, or other
  misc_feature (554)..(554): n is a, c, t, g, unknown, or other
  misc_feature (591)..(591): n is a, c, t, g, unknown, or other
aagctggagctccccgcggtggcggccgctctagaactagtggatcccccgggctgcaggaattcgcacgagaccattacctagaacatcctaatcgaaaaagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcgntggcatcattgagccctcgctgcaggcgctcgctcgcaaagtacaccagnacaagatgatctggcgcaaatgctatgcacggctgcaccctaaggctgtcaactgcccgcagaagaaagtgtgtcacagcaaccagctgaggnccaagaagagatcaagaactgaggtngtgctgctagtcaggttcatggaacatggtggttggnttgtgaaccgtgtttgttacgaactgaatttttgtttgggtgttgaaccgtgtttgtttaccgaactattggcccttattgtatgttttaccatgtgggcgatgcccaatactatatggcgatggccactttgctattggagttttgg

SEQ ID NO: 22447 - protein, 192 aa, Zea mays
  misc_feature: Ceres CLONE 1392230-F
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature (75)..(75): Xaa is any aa, unknown, or other
  misc_feature (92)..(92): Xaa is any aa, unknown, or other
  misc_feature (123)..(123): Xaa is any aa, unknown, or other
  misc_feature (144)..(144): Xaa is any aa, unknown, or other
MQIFVKTLTGKTITLEVESSDTIDNVKAKIQDKEGIPPDQQRLIFAGKQLEDGRTLADYNIQKESTLHLVLRLRXGIIEPSLQALARKVHQXKMIWRKCYARLHPKAVNCPQKKVCHSNQLRXKKRSRTEVVLLVRFMEHGGWXVNRVCYELNFCLGVEPCLFTELLALIVCFTMWAMPNTIWRWPLCYWSF

SEQ ID NO: 22448 - DNA, 686 bp, Zea mays
  misc_feature: Ceres CLONE 1392231-F
  misc_feature: Encodes the peptide sequence at SEQ ID NO. 22449
  misc_feature (345)..(345): n is a, c, t, g, unknown, or other
  misc_feature (555)..(555): n is a, c, t, g, unknown, or other
  misc_feature (567)..(567): n is a, c, t, g, unknown, or other
  misc_feature (568)..(568): n is a, c, t, g, unknown, or other
  misc_feature (645)..(645): n is a, c, t, g, unknown, or other
  misc_feature (646)..(646): n is a, c, t, g, unknown, or other
  misc_feature (648)..(648): n is a, c, t, g, unknown, or other
aagctggagctccccgcggtggcggccgctctagaatagtggatcccccgggctgcaggaattcgcacgagaccattacctagaacatcctaatcgaaaaaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaagggcaagatccaggacaaggaaggcattcccccggaccagcagcgggtcatctttcgctggcaagcagctcgaggacgggngcacacttgccgactaacacatccagaaggagagcaccctccaccctggtctccgcctcaggggagggatggagatcttcttcaaaacctccctggaagactatcacctccgagtggagtctctgaaccatcgacacgtcaaggccagatcccggaaaagagggtttccctcgcgacaagaggggttcattttttgttggaaaaactcanagagggggaacnnctggccgctacaacttcaaagggagaccccccccttgggggtgggttccagggggggatggcaaatttttcggaaanntnaacttcagggaaaaattccccctggggggggggttttt

SEQ ID NO: 22449 - protein, 167 aa, Zea mays
  misc_feature: Ceres CLONE 1392231-F
  misc_feature (6)..(68): Pfam Name: ubiquitin Pfam Description: Ubiquitin family
  misc_feature (54)..(54): Xaa is any aa, unknown, or other
  misc_feature (124)..(124): Xaa is any aa, unknown, or other
  misc_feature (128)..(128): Xaa is any aa, unknown, or other
  misc_feature (154)..(154): Xaa is any aa, unknown, or other
  misc_feature (155)..(155): Xaa is any aa, unknown, or other
MQIFVKTLTGKTITLEVESSDTIDNVKGKIQDKEGIPPDQQRVIFRWQAARGRXHTCRLTHPEGEHPPPWSPPQGRDGDLLQNLPGRLSPPSGVSEPSTRQGQIPEKRVSLATRGVHFLLEKLXEGEXLAATTSKGDPPLGGGFQGGMANFSEXXTSGKNSPWGGGF

SEQ ID NO: 22450 - DNA, 747 bp, Zea mays
  misc_feature: Ceres CLONE 1392233-F
  misc_feature: Encodes the peptide sequence at SEQ ID NO. 22451
  misc_feature (408)..(408): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (439)..(439): n is a, c, t, g, unknown, or other
  misc_feature (454)..(454): n is a, c, t, g, unknown, or other
  misc_feature (457)..(457): n is a, c, t, g, unknown, or other
  misc_feature (458)..(458): n is a, c, t, g, unknown, or other
  misc_feature (461)..(461): n is a, c, t, g, unknown, or other
  misc_feature (462)..(462): n is a, c, t, g, unknown, or other
  misc_feature (480)..(480): n is a, c, t, g, unknown, or other
  misc_feature (481)..(481): n is a, c, t, g, unknown, or other
  misc_feature (510)..(510): n is a, c, t, g, unknown, or other
tccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaaacgagagaccgctgctccggcggtggagacccgagtcgtcgtcgctaaggagccggagccggtggaggccgagactgagactgagaccanggagnnncgagccgttgctgaaccgaccgangcaaagcccaagaancannagnncgagcccgcgccgccgcnncaaaaaccgaggtcaagaaccaaaaacgnaggccgcccgccccgacaaaaaaaacgaaggtggttgtggccccggtcgaggcttcttagaccgaaaaaacccccagaaacaaaaaggggggggtgtggggggctaacgcgggggggggggggggcccccccctgtttttttcccccccccgggggcccacaccacaaagaaaaaaagggggcccccttttcccaaggggccctaaaaaaatcccccggaggaggtccccccccgcc

SEQ ID NO: 22451 - protein, 172 aa, Zea mays
  misc_feature: Ceres CLONE 1392233-F
  misc_feature (60)..(60): Xaa is any aa, unknown, or other
  misc_feature (62)..(62): Xaa is any aa, unknown, or other
  misc_feature (70)..(70): Xaa is any aa, unknown, or other
  misc_feature (75)..(75): Xaa is any aa, unknown, or other
  misc_feature (76)..(76): Xaa is any aa, unknown, or other
  misc_feature (77)..(77): Xaa is any aa, unknown, or other
  misc_feature (78)..(78): Xaa is any aa, unknown, or other
  misc_feature (84)..(84): Xaa is any aa, unknown, or other
  misc_feature (94)..(94): Xaa is any aa, unknown, or other
MAAVEVQVPTAAPVEEAAQLAAASAVETPKRETAAPAVETRVVVAKEPEPVEAETETETXEXRAVAEPTXAKPKXXXXEPAPPXQKPRSRTKNXGRPPRQKKRRWLWPRSRLLRPKKPPETKRGGCGGLTRGGGGAPPCFFPPPGGPHHKEKKGAPFSQGALKKSPGGGPPP

SEQ ID NO: 22452 - DNA, 810 bp, Zea mays
  misc_feature: Ceres CLONE 1392235-F
  misc_feature (9)..(9): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (810)..(810): n is a, c, t, g, unknown, or other
tccttactntcccccccggcccacgccccccaannnttgagtatctttcaagctggagctccccgcggtggcggccgctctattaatagtggatcccccgggctgcaggaattcgcacgagaccattacctagaacatcctaatcgaaaaaaaactcctcggccccagcattttcgtgcaaggggcgagccgccagctactgctggccttttccctcacacaagtcacacgcacacccgctagcccccgtcccccgtcccgcccgtaccttcctccgccgcctccgtcctcgttccaaccgtgggcagcaggcaggcccaagtatctgcaggagattgttggagagaaagaagacggcaggcacccacgcagatcaaacgtgctccgccacctttggttttcggcgaatccgcggccgtacgccgtaaatccgagccgtctcccgagcagaatcgacgcgctgcataagcaatttcgacccgtctccggccaaatcaaccgcccagagtggcaaaatggacccattctccgggttgacctccggtttggtgcctgcccgagaagcgcccaaagttccccccccttctcgggaaaaacctcccttgaaaaaccctgaggggcaaccgccggaaagttgtgtttaaggcgggggccctggaaaaatgggggattggcatatgggcgggggcctccaaggccggccaaggcaaaagttttgtttgccccccccaattggggggcccactcggtttttcagggttggggcccccccctctcctggaaaaaattacccccgggagccggccccan

SEQ ID NO: 22453 - DNA, 727 bp, Zea mays
  misc_feature: Ceres CLONE 1392236-F
  misc_feature: Translation starting site: 186
  misc_feature (310)..(310): n is a, c, t, g, unknown, or other
  misc_feature (328)..(328): n is a, c, t, g, unknown, or other
  misc_feature (333)..(333): n is a, c, t, g, unknown, or other
  misc_feature (337)..(337): n is a, c, t, g, unknown, or other
  misc_feature (338)..(338): n is a, c, t, g, unknown, or other
  misc_feature (370)..(370): n is a, c, t, g, unknown, or other
  misc_feature (427)..(427): n is a, c, t, g, unknown, or other
  misc_feature (455)..(455): n is a, c, t, g, unknown, or other
  misc_feature (477)..(477): n is a, c, t, g, unknown, or other
  misc_feature (519)..(519): n is a, c, t, g, unknown, or other
ggagctccccgcggtggcggccgctctataactagtggatcccccgggctgcaggaattcgcacgagaccattacctagaacatcctaatcgaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtgggcgaggcgcccaaggcgatgaatgcgcccaaggagaagatgcgcctaangagaagaagcgtccgcgncgatnaagnncggcgcgcaccctccctacgctgagatgattngtagagcgatcgctgcccctcaggaaaaggaaaggggtcgagctcgttggccatcancaagtacgtcgagggggagcacgggggnaagctccccaaccacttcccgnaggaagttcaccgtgcatttgaaaaaactccctgccgcccgnaaagttgaagagggttaaaaaactcttttaaggtgcccgggcaccgaggccaagcccaagggcggccaggcccaggggacccaagggccggggccaagcccaagccctctccccaaaggggaaaagccaaaaaccgtttggtaaaccccaaggggggggtttcccccaagcccagggcccagggccagaggccaaggccaagggccca

SEQ ID NO: 22454 - DNA, 753 bp, Zea mays
  misc_feature: Ceres CLONE 1392238-F
  misc_feature: Encodes the peptide sequence at SEQ ID NO. 22455
  misc_feature (447)..(447): n is a, c, t, g, unknown, or other
aagctggagctccccgcggtggcggccgctctataactagtggatcccccgggctgcaggaattcgcacgagaccattacctagaacatcctaatcaaaaatatctcctcaaggcacgttcaccacagtcctctctttccccggcaccaccaccacccaggctaaccggactggaccgagtgttgaacaacactgagggcgaggcagatagagcgacggcaggcatggtgagccgtgaaaatttgcacctggtgctggacccggcgtctctgggcgcgccgtgggccgacccgtccgccgcagagatcccgccgcagctcctcgccgcgctgggagagtacctctcctccacccgcgccgagggcggcgacgtcgcgacggaggcggacgacgagttcatgatgcacgatttcaaggtgcggcggtgcgcgcgcgcgcggagccacnactggacggcgtgcccctacgcgcacccgggggaggccgcgcgacgccgagacccgcgccgcgtgacctacgccggggaagccgagcccggattttcggctccgcccggacgcgggatggcccgtgcccccacggttacgccttgacccttccccccaggaaccccttcaagtggagggtcgaactgcttcgcatagccaaatccctgaagggcccgaggggccccattccagggagccaaattctttcttggccctccggggtggatgggaccctcccacttgggggggccttaatataaaaaaa

SEQ ID NO: 22455 - protein, 122 aa, Zea mays
  misc_feature: Ceres CLONE 1392238-F
  misc_feature (75)..(75): Xaa is any aa, unknown, or other
MVSRENLHLVLDPASLGAPWADPSAAEIPPQLLAALGEYLSSTRAEGGDVATEADDEFMMHDFKVRRCARARSHXWTACPYAHPGEAARRRDPRRVTYAGEAEPGFSAPPGRGMARAPTVTP

SEQ ID NO: 22456 - DNA, 700 bp, Zea mays
  misc_feature: Ceres CLONE 1392243-F
  misc_feature: Encodes the peptide sequence at SEQ ID NO. 22457
  misc_feature (615)..(615): n is a, c, t, g, unknown, or other
aagctggagctccccgcggtggcggccgctctataactagtggatcccccgggctgcaggaattcgcacgagaccattacctagaacatcctaatcgaaaagcaacacagacgccgccgccgcccaaagaaagacgtcaactccaggagacaagatagtgagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaccaaactcagtgcttgtgttcgagattgaagtcctcagtgcccagtaattcgcatctgtcagctatgggaacgttggccatgcttctcaagtatgaaataattccgttgtcacctcatgctacatacagcagattggtgttacgagttnaatcctgtgaaactttagcatcctgtaaccgtgaatgtcgagtttatggagttccttgtgtgcgccctcaggtcagttctcgtca

SEQ ID NO: 22457 - protein, 174 aa, Zea mays
  misc_feature: Ceres CLONE 1392243-F
  misc_feature (11)..(102): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
  misc_feature (147)..(147): Xaa is any aa, unknown, or other
MGFEKQILRSGTGPKPIKGQKVTVHCTGYGKDRDLSKKFWSTKDPGQQPFSFSIGQGSVIKGWDEGVMTMQVGEVARIQCTPDYAYGAGGFPAWGIHQTQCLCSRLKSSVPSNSHLSAMGTLAMLLKYEIIPLSPHATYSRLVLRVXSCETLASCNRECRVYGVPCVRPQVSSR

SEQ ID NO: 22458 - DNA, 680 bp, Zea mays
  misc_feature: Ceres CLONE 1392244-F
  misc_feature: Translation starting site: 199
  misc_feature (422)..(422): n is a, c, t, g, unknown, or other
  misc_feature (445)..(445): n is a, c, t, g, unknown, or other
tccccgcggtggcggccgctctagaactagtggatcccccgggctgcaggaattcgcacgagaccattacctagaacatcctaatcgaaaactcacaaaaccctcgccagcttatcccccttccctccctcacacgatctctcctcgacggctaacccggattgccgtctcaggctcgggatccgggcgctcgcggcgatggacggcggcggcggcgctggcggcgcggagggggagctcacggcgcaggagacagcgctctacgaccgccagatccgcgtctggggcgtcgatgcccagaagagttctgcaagaatattgttctagctggagttggaagtttatccttgatggatgataatgtagtcacagaggaggatctgaatgcaaatttcttaattcctcctgatgagagcatatantggtggtagatctcgagccccangtttggctgcgagtcttttgataggatttccaatccctaaggggttaaaaaagtttttcgggggaaaaaaaagggggccccccccccccttttttttgggggggggggggaaatttcctctcttcgggaaggagaagcacccccggttggggtggtgttattataatatggggggggcgttttttttattaaataaaaaaaaaaaaaaaaattgttttttttttaaaaaaaaaaa

SEQ ID NO: 22459 - DNA, 669 bp, Zea mays
  misc_feature: Ceres CLONE 1392246-F
  misc_feature: Translation starting site: 166
aagctggagctccccgcggtggcggccgctctagtaatagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctggggacggtgctgatcctcctcgcagggcgcttcatggggaagagagtggtgtttctcaagcagctcaagtctggcctgctccttatctctggggcttttcagatcaatggagtaccgatccgccgtgtgaacccagacctatgtcattgctacatcacccaaagttgaatctctggtggtgatggcccccagtttgatgaccagtactttggccaggaaaaaaaagcaaaaggggaaaaaacccagggcgaacttttttaaaaaaaaaaagg

SEQ ID NO: 22460 - DNA, 730 bp, Zea mays
  misc_feature: Ceres CLONE 1392247-F
  misc_feature: Encodes the peptide sequence at SEQ ID NO. 22461
  misc_feature (620)..(620): n is a, c, t, g, unknown, or other
aaagtggagctccccgcggtggcggccgctctagaactagtggatcccccgggctgcaggaattcgcacgagaccattacctagagcatcctaatcgaaaaaaaaacctatcaggtattcggtaccattgccatcactctctagcacgccgcacaagacatcagccagacttcccaatttccggccacaaccatacctgctacgcttgcgccgccgcctccccccttgtcttcgcttcccgtgcaagcttcaccgccgccgtctccgactcccttcgcgatgcgaccgctttcgcgccacgattcctctatccccgccttccccgcccgcggcggttcttgcacttgaccgacccaatccgcctatctgttcccctcttccgtgcgagaggtactatcgccggccgtttcgtttcgaggctgatcggatcggcggaagatgtgccgcgacgctgaggatacttcgtctccggtgtcctcgtcggaattggagcaggaagacgacgacgattgctacctgagcgatcagggggacgatgccctagaagagtctgttctccatgttctcgacgacgaccacctcgaggactgccgttgatctgcctcatctgtgatcaccangtcatcacttttggtgacgcatgtgactgcgtcggctctcccccagtcggttccacactatacgctatactgatacgctgatgcttagtctcatctttttcgcacgccag

SEQ ID NO: 22461 - protein, 52 aa, Zea mays
  misc_feature: Ceres CLONE 1392247-F
MCRDAEDTSSPVSSSELEQEDDDDCYLSDQGDDALEESVLHVLDDDHLEDCR
